(12) United States Patent
Sastry-Dent et al.

(10) Patent No.: US 10,093,940 B2
(45) Date of Patent: Oct. 9, 2018

(54) OPTIMAL MAIZE LOCI

(71) Applicant: Dow AgroSciences LLC, Indianapolis, IN (US)

(72) Inventors: Lakshmi Sastry-Dent, Avon, IN (US); Zehui Cao, Westfield, IN (US); Shreedharan Sriram, Indianapolis, IN (US); Steven R. Webb, Westfield, IN (US); Debra L. Camper, Indianapolis, IN (US)

(73) Assignee: Dow AgroSciences LLC, Indianapolis, IN (US)

( * ) Notice: Subject to any disclaimer, the term of this patent is extended or adjusted under 35 U.S.C. 154(b) by 826 days.

(21) Appl. No.: 14/531,739

(22) Filed: Nov. 3, 2014

(65) Prior Publication Data
US 2015/0128310 A1     May 7, 2015

Related U.S. Application Data

(60) Provisional application No. 61/899,598, filed on Nov. 4, 2013.

(51) Int. Cl.
*C12N 15/82* (2006.01)
*A01H 5/10* (2018.01)

(52) U.S. Cl.
CPC .......... *C12N 15/8213* (2013.01); *A01H 5/10* (2013.01); *C12N 15/8243* (2013.01); *C12N 15/8273* (2013.01); *C12N 15/8274* (2013.01); *C12N 15/8286* (2013.01)

(58) Field of Classification Search
None
See application file for complete search history.

(56) References Cited

U.S. PATENT DOCUMENTS

| | | | |
|---|---|---|---|
| 4,769,061 A | 9/1988 | Comai | |
| 4,810,648 A | 3/1989 | Stalker | |
| 4,940,835 A | 7/1990 | Fraley et al. | |
| 5,789,538 A | 8/1998 | Rebar et al. | |
| 5,925,523 A | 7/1999 | Dove et al. | |
| 6,007,988 A | 12/1999 | Choo et al. | |
| 6,013,453 A | 1/2000 | Choo et al. | |
| 6,140,081 A | 10/2000 | Barbas | |
| 6,200,759 B1 | 3/2001 | Dove et al. | |
| 6,242,568 B1 | 6/2001 | Barbas et al. | |
| 6,453,242 B1 | 9/2002 | Eisenberg et al. | |
| 6,479,626 B1 | 11/2002 | Kim et al. | |
| 6,534,261 B1 | 3/2003 | Cox et al. | |
| 6,599,692 B1 | 6/2003 | Case et al. | |
| 6,689,558 B2 | 2/2004 | Case | |
| 6,794,136 B1 | 9/2004 | Eisenberg et al. | |
| 6,903,185 B2 | 6/2005 | Kim et al. | |
| 7,030,215 B2 | 4/2006 | Liu et al. | |
| 7,067,317 B2 | 6/2006 | Rebar et al. | |
| 7,070,934 B2 | 7/2006 | Cox, III et al. | |
| 7,153,949 B2 | 12/2006 | Kim et al. | |
| 7,253,273 B2 | 8/2007 | Collingwood | |
| 7,262,054 B2 | 8/2007 | Jamieson et al. | |
| 7,361,635 B2 | 4/2008 | Miller et al. | |
| 7,462,758 B2 | 12/2008 | Biesgen | |
| 8,420,782 B2 | 4/2013 | Bonas et al. | |
| 8,440,431 B2 | 5/2013 | Voytas et al. | |
| 2003/0232410 A1 | 12/2003 | Liljedahl et al. | |
| 2005/0026157 A1 | 2/2005 | Baltimore et al. | |
| 2005/0064474 A1 | 3/2005 | Holmes et al. | |
| 2005/0208489 A1 | 9/2005 | Carroll et al. | |
| 2005/0267061 A1 | 12/2005 | Martin | |
| 2006/0188987 A1 | 8/2006 | Guschin et al. | |
| 2007/0022485 A1 | 1/2007 | Takeda et al. | |
| 2007/0134796 A1 | 6/2007 | Holmes et al. | |
| 2007/0218528 A1 | 9/2007 | Miller | |
| 2007/0271629 A1 | 11/2007 | Ananiev et al. | |
| 2007/0271636 A1 | 11/2007 | Nelson et al. | |
| 2008/0131962 A1 | 6/2008 | Miller | |
| 2008/0182332 A1 | 7/2008 | Cai | |
| 2009/0111119 A1 | 4/2009 | Doyon et al. | |
| 2009/0117617 A1 | 5/2009 | Holmes et al. | |
| 2009/0205083 A1 | 8/2009 | Gupta et al. | |
| 2009/0263900 A1 | 10/2009 | DeKelver et al. | |
| 2010/0047805 A1 | 2/2010 | Wang | |
| 2010/0199389 A1 | 8/2010 | Butler et al. | |
| 2011/0041195 A1 | 2/2011 | Doyon | |
| 2011/0145940 A1 | 6/2011 | Voytas et al. | |
| 2011/0167521 A1 | 6/2011 | DeKelver et al. | |
| 2011/0189775 A1 | 8/2011 | Ainley et al. | |
| 2011/0201055 A1 | 8/2011 | Doyon et al. | |
| 2011/0207221 A1 | 8/2011 | Cost et al. | |

(Continued)

FOREIGN PATENT DOCUMENTS

| | | |
|---|---|---|
| EP | 0 242 246 | 11/1992 |
| GB | 2338237 | 8/1998 |

(Continued)

OTHER PUBLICATIONS

Valton et al 2012 (The Journal of Biological Chemistry 287:36 p. 30139-30150) of record.*
McCarty et al 2005 (The Plant Journal 2005 44: p. 52-61).*
Ainley et al., "Trait Stacking Via Targeted Genome Editing," *Plant Biotechnol. J.* 11(9):1126-1134 (2013).
Beerli et al., Toward Controlling Gene Expression at Will: Specific Regulation of the ERBB-2/HER-2 Promoter by Using Polydactyl Zinc Finger Proteins Constructed from Modular Building Blocks, *PNAS USA* 95(25):14628-14633 (1998).
Beerli et al., "Engineering Polydactyl Zinc-Finger Transcription Factors," *Nature Biotechnol.* 20:135-141(2002).
Bibikova et al., "Stimulation of Gomologous Recombination Through Targeted Cleavage by Chimeric Nucleases," *Mol. Cell. Biol.* 21(1):289-297 (2001).
Bibikova et al., "Enhancing Gene Targeting With Designed Zinc Finger Nucleases," *Science* 300(5620):764 (2003).
Bitinate et al., "Foki Dimerization Is Required for DNA Cleavage," *PNAS USA* 95:10570-10575 (1998).

(Continued)

*Primary Examiner* — Matthew R Keogh
(74) *Attorney, Agent, or Firm* — Sean M. Russell; Barnes & Thornburg LLP

(57) ABSTRACT

As disclosed herein, optimal native genomic loci from maize plants have been identified that represent best sites for targeted insertion of exogenous sequences.

19 Claims, 28 Drawing Sheets

Specification includes a Sequence Listing.

(56) References Cited

U.S. PATENT DOCUMENTS

| | | | |
|---|---|---|---|
| 2011/0229582 | A1 | 9/2011 | Fischer et al. |
| 2011/0239315 | A1 | 9/2011 | Bonas et al. |
| 2011/0281361 | A1 | 11/2011 | DeKelver et al. |
| 2011/0287545 | A1 | 11/2011 | Cost et al. |
| 2011/0301073 | A1 | 12/2011 | Gregory et al. |
| 2013/0239252 | A1 | 9/2013 | Wigge et al. |
| 2013/0254932 | A1 | 9/2013 | Nott et al. |
| 2014/0283166 | A1 | 9/2014 | Chomet et al. |

FOREIGN PATENT DOCUMENTS

| | | |
|---|---|---|
| WO | WO 93/19181 | 9/1993 |
| WO | WO 95/19431 | 7/1995 |
| WO | WO 96/06166 | 2/1996 |
| WO | WO 96/30517 | 10/1996 |
| WO | WO 98/53057 | 11/1998 |
| WO | WO 98/53058 | 11/1998 |
| WO | WO 98/53059 | 11/1998 |
| WO | WO 98/53060 | 11/1998 |
| WO | WO 98/54311 | 12/1998 |
| WO | WO 00/27878 | 5/2000 |
| WO | WO 01/60970 | 8/2001 |
| WO | WO 01/88197 | 11/2001 |
| WO | WO 02/016536 | 2/2002 |
| WO | WO 02/077227 | 10/2002 |
| WO | WO 02/099084 | 12/2002 |
| WO | WO 03/016496 | 2/2003 |
| WO | WO 05/012515 | 2/2005 |
| WO | WO 05/107437 | 11/2005 |
| WO | WO 07/014275 | 2/2007 |
| WO | WO 07/053482 | 5/2007 |
| WO | WO 13/144663 | 3/2013 |

OTHER PUBLICATIONS

Bonas et al., "Genetic and Structural Characterization of the Avirulence Gene AVRBS3 From Xanthomonas Campestris Pv. Vesicatori," *Gen. Genet.* 218:127-136 (1989).
Cai et al., Targeted Transgene Integration in Plant Cells Using Designed Zinc Finger Fases, *Plant Mol. Biol.* 69(6):699-709 (2009).
Choo et al., Advances in Zinc Finger Engineering, *Curr. Opin. Struct. Biol.* 10:411-416 (2000).
Curtin et al., "Targeted Mutagenesis of Duplicated Genes in Soybean With Zinc-Finger Fases," *Plant Physiology* 156:466-473 (2011).
D'Halluin et al., "Homologous Recombination: A Basis for Targeted Genome Optimization in Crop Species Such As Maize," *Plant Biotechnology Journal* 6(1):93-102 (2008).
DeGreef et al., "Evaluation of Herbicide Resistance in Transgenic Crops Under Field Conditions," *Nat Biotechnology* 7:61-64 (1989).
Doyon et al., "Heritable Targeted Gene Disruption in Zebrafish Using Designed Zinc-Finger Nucleases," *Nat. Biotechnol.* 26:702-708 (2008).
Elliott et al., "Isolation and Characterization of Fruit Vacuolar Invertase Genes from Two Tomato Species and Temporal Differences in MRNA Levels During Fruit Ripening," *Plant Molec. Biol.* 21:515-524 (1993).
Fisher et al., Starch Branching Enzyme II From Maize Endosperm ,*Plant Physiol.* 102:1045-1046 (1993).
Geiser et al., "The Hypervariable Region in the Genes Coding for Entomopathogenic Crystal Proteins of Bacillus Thuringiensis: Nucleotide Sequence of the KURHD1 Gene of Subsp. Kurstaki HD1," *Gene* 48:109-118 (1986).
Guerts et al., Knockout Rats Via Embryo Micronjection of Zinc-Finger Nucleases,*Science* 325(5939):433(2009).
Haft et al., "A Guild of 45 CRISPR-Associated (CAS) Protein Families and Multiple CRISPR/CAS Subtypes Exist in Prokaryotic Genomes," *PLoS Comput. Biol.* 1:e60 (2005) <http://www.jcvi.org/cms/nc/publications/listing/browse/3/article//Haft/#sthash.bXXP6pOi.dpuf>.

Hayes et al., "Molecular Cloning and Heterologous Expression of a CDNA Encoding a Mouse Glutathione S-Transferase YC Subunit Possessing High Catalytic Activity for Aflatoxin B1-8,9-Epdxide," *Biochem. J.* 285:173-180.
Heuer et al., "Repeat Domain Diversity of AVRBS3-Like Genes in *Ralstonia solanacearum* Strains and Association With Host Preferences in the Field," *Appl. and Envir. Micro.* 73(13):4379-4384 (2007).
Isalan et al., "A Rapid, Generally Applicable Method to Engineer Zinc Fingers Illustrated by Targeting the HIV-1 Promoter," *Nature Biotechnol.* 19:656-660 (2001).
Jansen et al., "Identification of Genes That Are Associated With DNA Repeats in Prokaryotes," *Mol. Microbiol.* 43:1565-1575 (2002).
Jones et al., "Isolation of the Tomato CF-9 Gene for Resistance to Cladosporium Fulvum by Transposon Tagging," *Science* 266:789-793 (1994).
Kay et al., "A Bacterial Effector Acts as a Plant Transcription Factor and Induces a Cell Size Regulator," *Science* 318:648-651 (2007).
Kim et al., "Chimeric Restriction Enzyme:GAL4 Fusion to FOKL Cleavage Domain," *J. Biol. Chem.* 379:489-495 (1998).
Kim et al., "Getting a Handhold on DNA: Design of Poly-Zinc Finger Proteins With Femtomolar Dissociation Constants," *PNAS USA* 95:2812-2817 (1998).
Kim et al., "Design of TATA Box-Binding Protlinyzinc Finger Fusions for Targeted Regulation of Gene Expression," *PNAS* 94:3616-3620 (1997).
Kim et al., "Site-Specific Cleavage of DNA-RNA Hybrids by Zinc Finger/FOKI Cleavage Domain Fusions," *Gene* 203:43-49 (1997).
Kim et al., "Construction of a Z-DNA-Specific Restriction Endonuclease," *PNAS* 94:12875-12879 (1997).
Kim et al., "Hybrid Restriction Enzymes: Zinc Finger Fusions to FOK I Cleavage Domain," *PNAS* 93:1156-1160 (1996).
Kim et al., "Chimeric Restriction Endonuclease," *PNAS* 91:883-887 (1994).
Knutson et al., "Modification of Brassica Seed Oil by Antisense Expression of a Stearoyl-Acyl Carrier Protein Desaturase Gene," *Proc. Natl. Acad. Sci. U.S.A.*, 89:2624-2628 (1992).
Kumar et al., "Controlling Transgene Integration in Plants," *Trends Plant Sci.* 6:155-159 (2001).
Le et al., "Simultaneous Generation and Germline Transmission of Multiple Gene Mutations in Rat Using CRISPR-CAS Systems," *Nature Biotechnology* 31:684-686 (2013).
Lee et al., "The Molecular Basis of Sulfonylurea Herbicide Resistance in Tobacco," *EMBO J.* 7(5):1241 (1988).
Liu et al., "Design of Polydactyl Zinc-Finger Proteins for Unique Addressing Within Complex Genomes," *PNAS USA* 94:5525-5530 (1997).
Makarova et al., "A Putative RNA-Interference-Based Immune System Inprokaryotes: Computational Analysis of the Predicted Enzymatic Machinery, Functional Analogies With Eukaryotic RNAI, and Hypothetical Mechanisms of Action," *Biol. Direct.* 1:7 (2006).
Makarova et al., "A DNA Repair System Specific for the Thermophilic Archaea and Bacteria Predicted by Genomic Context Analysis," *Nucleic Acids Res.* 30:482-496 (2002).
Mani et al., "Binding of Two Zinc Finger Nuclease Monomers to Two Specific Sites is Required for Effective Double-Strand DNA Cleavage," *Biochem. Biophys. Res. Commun.* 334:1191-1197 (2005).
Martin et al., "Map-Based Cloning of a Protein Kinase Gene Conferring Disease Resistance to Tomato," *Science* 262:1432-1436 (1993).
Miki et al., "Transformation of *Brassica napus* Canola Cultivars With *Arabidopsis thaliana* Acetohydroxy Acid Synthase Genes and Analysis of Herbicide Resistance," *Theor. Appl. Genet.* 80:449 (1990).
Mindrinos et al., "The *A. Thaliana* Disease Resistance Gene RPS2 Encodes a Protein Containing a Nucleotide-Binding Site and Leucine-Rich Repeats," *Cell* 78:1089 (1994).
Moehle et al., "Targeted Gene Addition Into a Specified Location in the Human Genome Using Designed Zinc Finger Nucleases," *Proc. Natl. Acad. Sci. USA* 104(9):3055-3060 (2007).
Nekrasov et al., "Targeted Mutagenesis in the Model Plant *Nicotiana benthamiana* Using CAS9 RNA-Guided Endonuclease," *Nature Biotechnology* 31:691-693 (2013).

(56) References Cited

OTHER PUBLICATIONS

Pabo et al., "Design and Set Fction of Novel CYS2HIS2 Zincfinger Proteins," *Ann. Rev. Biochem* 70:313-340 (2001).
Paszkowski et al., "Gene Targeting in Plants," *EMBO J.* 7:4021-4026 (1988).
Pen et al., "Production of Active Bacillus Licheniformis Alpha-Amylase in Tobacco and Its Application in Starch Liquefaction," *BioTechnology* 10:292 (1992).
Przibilla et al., "Site-Specific Mutagenesis of the D1 Subunit of Photosystem II in Wild-Type Chlamydomona," *Plant Cell* 3:169-174 (1991).
Puchta et al., "Homologous Recombination in Plant Cells Is Enhanced by In Vivo Induction of Double Strand Breaks Into DNA by a Site-Specific Endonuclease," *Nucleic Acid Research* 21:5034-5040 (1993).
Raboy et al., "A Survey of Maize Kernel Mutants for Variation in Phytic Acid," *Maydica* 35:383-390 (1990).
Roberts et al., "Rebase: Restriction Enzymes and Methyltransferases," *Nucleic Acids Res.* 31:418-420 (2003).
Scheffler et al., "Desaturase Multigene Families of *Brassica napus* Arose Through Genome Duplication," *TAG* 94(5):583-591 (1997).
Schierholt et al., "Mapping a High Oleic Acid Mutation in Winter Oilseed Rape (*Brassica napus* L.)" *TAG* 101(5-6):897-901 (2000).
Schierholt et al., "Inheritance of High Oleic Acid Mutations in Winter Oilseed Rape (*Brassica napus* L.)" *Crop Sci.* 41:1444-1449 (2001).
Schornack et al., "Gene-For-Gene-Mediated Recognition of Nuclear-Targeted AVRBS3-Like Bacterial Effector Proteins," *J. Plant Physiol.* Recognition 163(3):256-272 (2006).
Segal, "Custom DNA-Binding Proteins Come of Age: Polydactyl Zinc-Finger Proteins," *Curr. Opin. Biotechnol.* 12:632-637 (2001).
Shan et al., "Targeted Genome Modification of Crop Plants Using a CRISPR-CAS System," *Nature Biotechnology* 31:686-680 (2013).
Shiroza et al., "Sequence Analysis of the *Streptococcus* Mutans Fructosyltransferase Gene and Flanking Regions," *J. Bacteriol.* 170(2):810-816 (1988).
Shukla et al., "Precise Genome Modification in the Crop Species *Zea mays* Using Zinc-Finger Nucleases," *Nature* 459:437-441 (2009).
Siebert et al., "Efficient Repair of Genomic Double-Strand Breaks by Homologous Recombination Between Directly Repeated Sequences in the Plant Genome," *Plant Cell* 14:1121-1131 (2002).
Smith et al., "A Detailed Study of the Substrate Specificity of a Chimeric Restriction Enzyme," *Nucleic Acids Res.* 27:674-681 (1999).
Smith et al., "Requirements for Finger Cleavage by Chimeric Restriction Enzymes With Zinc Finger DNA-Recognition Domains," *Nucleic Acids Res.* 28:3361-3369 (2000).
Sogaard et al., "Site-Directed Mutagenesis of Histidine 93, Aspartic Acid 180, Glutamic Acid 205, Hisitidine 290, and Aspartic Acid 291 at the Active Site and Tryptophan 279 at the Raw Starch Binding Site in Barley A-Amylase 1," *J. Biol. Chem.* 268:22480 (1993).
Steinmetz et al., "The DNA Sequence of the Gene for the Secreted *Bacillus subtilis* Enzyme Levansucrase and Its Genetic Control Sites," *Mol. Gen. Genet.* 20:220 (1985).
Terada et al., "Efficient Gene Targeting by Homologous Recombination in Rice," *Nat. Biotechnol* 20(10):1030 (2002).
Terada et al., "Gene Targeting by Homologous Recombination in Rice," *Nat. Biotechnol.* 20(10):1030 (2002).
Urnov et al., "Genome Editing With Engineered Zinc Finger Nucleases," *Nature Reviews* 11:636-546(2010).
Urnov et al., "Highly Efficient Endogenous Human Gene Correction Using Designed Zinc-Finger Nucleases," *Nature* 435:646-651 (2005).
Van Hartingsveldt et al., "Cloning, Characterization and Overexpression of the Phytase-Encoding Gene (PHYA) of Aspergillus and Niger," *Gene* 127:87-94 (1993).
Wah et al., "Structure of FOKI Has Implications for DNA Cleavage," *PNAS USA* 95:10564-10569 (1998).
Wu et al., "Custom-Designed Zinc Finger Nucleases: What Is Next?," *Cell. Mol. Life Sci.* 64:2933-2944 (2007).

Eqyuem et al., "Characterization of Three Loci for Homologous Gene Targeting and Transgene Expression," *Biotechnology and Bioengineering*, vol. 110, No. 8, Aug. 2013.
Akhtar, et al., "Chromatin Position Effects Assayed by Thousands of Reporters Integrated in Parallel," *Cell* 154, 914-927, Aug. 15, 2013.
Tillo et al., "G+C content dominates intrinsic nucleosome occupancy," *BMC Bioinformatics* 2009, 10:442, Dec. 22, 2009, available at http://www.biomedcentral.com/1471-2105/10/442.
Krebs et al., "Keys to Open Chromatin for Transcription Activation: FACT and ASFL," *Molecular Cell* 34, May 29, 2009.
Perez-Pinera et al., "Gene targeting to the ROSA26 locus directed by engineered zinc finger nucleases," *Nucleic Acids Research*, 2011, 1-12.
Sadelain et al., "Safe harbours for the integration of new DNA in the human genome," Nature Reviews | Cancer, vol. 12, Jan. 2012.
Silva et al., "Meganucleases and Other Tools for Targeted Genome Engineering: Perspectives and Challenges for Gene Therapy," *Current Gene Therapy*, 2011, 11, 11-27.
International Search Report, International Application No. PCT/US2014/063733, dated Feb. 19, 2015.
International Search Report, International Application No. PCT/US2014/063731, dated Apr. 23, 2015.
Jaffe et al., "Methylation of Chloroplast DNA Does Not Affect Viability and Maternal Inheritance in Tobacco and May Provide a Strategy Towards Transgene Containment," *Plant Cell Rep.*, 2008, vol. 27, 1377-1384.
Wilson et al., "European Nucleotide Archive (ENA); Accession AC194735," Issued Sep. 24, 2013. Retrieved from http://www.ebi.ac.uk/cgi-bin/sva/sva.pl?session=%Ftmp%2FSESSION14771-1419864810-1&index=2&view=1971381962.
Civardi et al., "The Relationship Between Genetic and Physical Distances in the Cloned A1-H2 Interval of the *Zea mays* L. Genome," *Proc. Nat. Acad. Sci.*, Aug. 1994, vol. 91, 8268-8272.
GenBank AC193791. *Zea mays* chromosome 4 clone CH201—121F3, *Sequencing in Progress*, 9 unordered pieces, (Sep. 24, 2013). Retrieved from the Internet on Jan. 7, 2014: http://www.ncbi.nih.gov/nuccore/545481188?sat=18&satkey=19102542>; nucleotide 141371-144762, 100% identity to SEQ ID No. 387.
Valton et al., 5' Cytosine-Phosphoguanine (CpG) Methylation Impacts the Activity of Natural and Engineere Meganucleases, JBC (2012) vol. 287 (36) pp. 30139-30150.
Daboussi et al., Chromosomal Contxt and Epigenetic Mechanisms Control the efficacy of Genome Editing by Rare-Cutting Designer Endonucleases, Nuc Acids Research (2012) vol. 40(13) pp. 6367-6379.
Gao et al., Heritable Targeted Mutagenesis in Maize using a Designed Endonuclease, The Plant Journal, (2009), vol. 61 (1) pp. 176-187.
C. D. Day et al: "Transgene integration into the same chromosome location can produce alleles that express at a predictable level, or alleles that are differentially silenced", Genes & Development, vol. 14, No. 22, Nov. 15, 2000 (Nov. 15, 2000), pp. 2869-2880.
Benjamin Jaffa CR et al: "Methylation of chloroplast DNA does not affect viability and maternal inheritance in tobacco and may provide a strategy towards transgene containment", Plant Cell Reports, Springer, Berlin, DE, vol. 27, No. 8, Jun. 7, 2008 (Jun. 7, 2008), pp. 1377-1384.
Wilson et al: "Sequence Version Archive AC194735", European Nucleotide Archive (ENA), Sep. 24, 2013 (Sep. 24, 2013), XP055339598; Retrieved from the Internet.
Laura Civardi et al: "The Relationship Between Genetic and Physical Distances in the Cloned AI-H2 Interval of the *Zea Mays* L. Genome", Proc. Nati. Acad. Sci, Aug. 1, 1994 (Aug. 1, 1994), pp. 8268-8272.
P. S. Schnable et al: "The B73 Maize Genome: Complexity, Diversity, and Dynamics", Science, vol. 326, No. 5956, Nov. 20, 2009 (Nov. 20, 2009), pp. 1112-1115.
Steve R. Eichten et al: "Heritable Epigenetic Variation among Maize Inbreds", PLoS Genetics, vol. 7, No. 11, Nov. 17, 2011 (Nov. 17, 2011), p. e1002372.

(56) References Cited

OTHER PUBLICATIONS

Neil A. Youngson et al: "Transgenerational Epigenetic Effects", Annual Review of Genomics and Human Genetics, vol. 9, No. 1, Sep. 1, 2008 (Sep. 1, 2008), pp. 233-257.

* cited by examiner

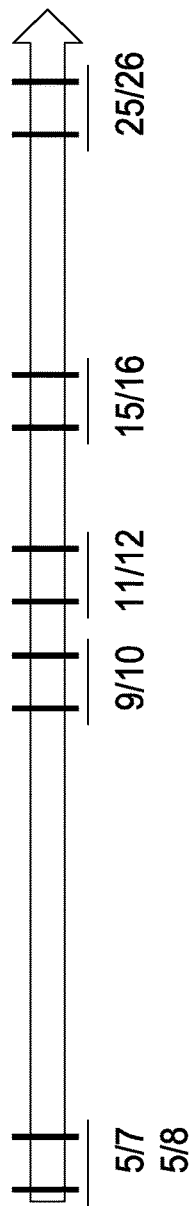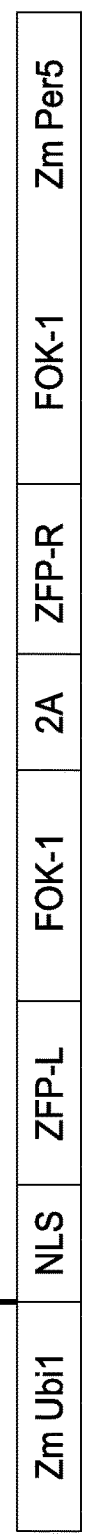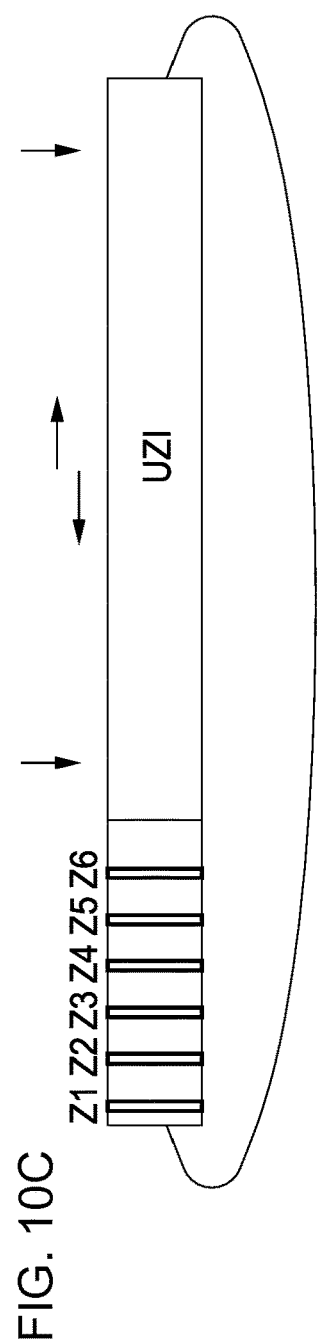

| ID | Name | Treatment | # Indels/1M HQ reads |
|---|---|---|---|
| optimal_loci_204637 | OGL1 | C | 115.1827783 |
| | | ZFN 111879 | 2458.971273 |
| optimal_loci_204726 | OGL2 | C | 10.86457474 |
| | | ZFN 111885 | 102.9851891 |
| optimal_loci_31710 | OGL 11 | C | 1359.364352 |
| | | ZFN 117402 | 8209.320688 |
| optimal_loci_156393 | OGL 12 | C | 368.6331485 |
| | | ZFN 117404 | 7748.53473 |
| optimal_loci_157315 | OGL 13 | C | 79.11178495 |
| | | ZFN 117429 | 453.3253803 |
| optimal_loci_197372 | OGL 14 | C | 48.99318995 |
| | | ZFN 117406 | 277.1403482 |
| optimal_loci_198387 | OGL 15 | C | 45.49262935 |
| | | ZFN 117408 | 622.2166624 |
| optimal_loci_232228 | OGL 16 | C | 163.1649867 |
| | | ZFN 117411 | 5980.912998 |
| optimal_loci_285621 | OGL 17 | C | 0 |
| | | ZFN 117413 | 4.815941547 |

OPTIMAL MAIZE LOCI

CROSS-REFERENCE TO RELATED APPLICATIONS

This application claims the benefit, under 35 U.S.C. § 119(e), to U.S. Provisional Patent Application No. 61/899,598, filed on Nov. 4, 2013, the contents of which are incorporated by reference in their entirety into the present application.

REFERENCE TO SEQUENCE LISTING SUBMITTED ELECTRONICALLY

The official copy of the sequence listing is submitted electronically via EFS-Web as an ASCII formatted sequence listing with a file named "232313_SEQ LIST_ST25.txt," created on Oct. 30, 2014, and having a size of 13 megabytes and is filed concurrently with the specification. The sequence listing contained in this ASCII formatted document is part of the specification and is herein incorporated by reference in its entirety.

REFERENCE TO TABLE LISTING SUBMITTED ELECTRONICALLY

The official copy of the table listing is submitted electronically via EFS-Web as a .PDF formatted table listing with a file named "Table 3", created on Nov. 4, 2013, and having a size of 8.32 megabytes and is filed concurrently with the specification. The table listing contained in this .PDF formatted document is part of the specification and is herein incorporated by reference in its entirety.

BACKGROUND

The maize genome was successfully transformed with transgenes in the early 1990's. Over the last twenty years, numerous methodologies have been developed for transforming the maize genome, wherein a transgene is stably integrated into the maize genome. This evolution of maize transformation methodologies has resulted in the capability to successfully introduce a transgene comprising an agronomic trait within the maize genome. The introduction of insect resistance and herbicide tolerant traits within maize plants in the late—1990's provided producers with a new and convenient technological innovation for controlling insects and a wide spectrum of weeds, which was unparalleled in cultivation farming methods. Currently, transgenic maize is commercially available throughout the world, and new transgenic maize products such as Enlist™ Corn offer improved solutions for ever-increasing weed challenges. The utilization of transgenic maize in modern agronomic practices would not be possible, but for the development and improvement of maize transformation methodologies.

However, current maize transformation methodologies rely upon the random insertion of transgenes within the maize genome. Reliance on random insertion of genes into a genome has several disadvantages. The transgenic events may randomly integrate within gene transcriptional sequences, thereby interrupting the expression of endogenous traits and altering the growth and development of the maize plant. In addition, the transgenic events may indiscriminately integrate into locations of the corn genome that are susceptible to gene silencing, culminating in the reduced or complete inhibition of transgene expression either in the first or subsequent generations of transgenic maize plants. Finally, the random integration of transgenes within the maize genome requires considerable effort and cost in identifying the location of the transgenic event and selecting transgenic events that perform as designed without agronomic impact to the plant. Novel assays must be continually developed to determine the precise location of the integrated transgene for each transgenic event, such as a maize event. The random nature of maize transformation methodologies results in a "position-effect" of the integrated transgene, which hinders the effectiveness and efficiency of maize transformation methodologies.

Targeted genome modification of plants has been a long-standing and elusive goal of both applied and basic research. Targeting genes and gene stacks to specific locations in the Zea mays genome will improve the quality of transgenic events, reduce costs associated with production of transgenic events and provide new methods for making transgenic plant products such as sequential gene stacking. Overall, targeting trangenes to specific genomic sites is likely to be commercially beneficial. Significant advances have been made in the last few years towards development of methods and compositions to target and cleave genomic DNA by site specific nucleases (e.g., Zinc Finger Nucleases (ZFNs), Meganucleases, Transcription Activator-Like Effector Nucleases (TALENS) and Clustered Regularly Interspaced Short Palindromic Repeats/CRISPR-associated nuclease (CRISPR/Cas) with an engineered crRNA/tracr RNA), to induce targeted mutagenesis, induce targeted deletions of cellular DNA sequences, and facilitate targeted recombination of an exogenous donor DNA polynucleotide within a predetermined genomic locus. See, for example, U.S. Patent Publication No. 20030232410; 20050208489; 20050026157; 20050064474; and 20060188987, and International Patent Publication No. WO 2007/014275, the disclosures of which are incorporated by reference in their entireties for all purposes. U.S. Patent Publication No. 20080182332 describes use of non-canonical zinc finger nucleases (ZFNs) for targeted modification of plant genomes and U.S. Patent Publication No. 20090205083 describes ZFN-mediated targeted modification of a plant EPSPs genomic locus. Current methods for targeted insertion of exogenous DNA typically involve co-transformation of plant tissue with a donor DNA polynucleotide containing at least one transgene and a site specific nuclease (e.g., ZFN) which is designed to bind and cleave a specific genomic locus of an actively transcribed coding sequence. This causes the donor DNA polynucleotide to stably insert within the cleaved genomic locus resulting in targeted gene addition at a specified genomic locus comprising an actively transcribed coding sequence.

An alternative approach is to target the transgene to preselected target nongenic loci within the corn genome. In recent years, several technologies have been developed and applied to plant cells for the targeted delivery of a transgene within the corn genome. However, much less is known about the attributes of genomic sites that are suitable for targeting. Historically, non-essential genes and pathogen (viral) integration sites in genomes have been used as loci for targeting. The number of such sites in genomes is rather limiting and there is therefore a need for identification and characterization of targetable optimal genomic loci that can be used for targeting of donor polynucleotide sequences. In addition to being amenable to targeting, optimal genomic loci are expected to be neutral sites that can support transgene expression and breeding applications. A need exists for compositions and methods that define criteria to identify optimal nongenic loci within the corn genome for targeted transgene integration.

SUMMARY

In accordance with one embodiment a recombinant sequence is provided comprising an optimal nongenic maize genomic sequence and an exogenous sequence, wherein the exogenous sequence is inserted into the optimal nongenic maize genomic sequence. In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), loci_232228_G1 (SEQ ID NO: 4529) with a DNA of interest inserted into the nongenic sequence. In one embodiment, the insertion of the DNA of interest into the optimal nongenic maize genomic sequence modifies the original sequence of the nongenic loci by alterations of the nongenic loci sequence proximal to the insertion site. Such modifications include, for example, deletions, inversions, insertions, and duplications of the nongenic loci sequence. In a further aspect, an embodiment relates to a DNA of interest, wherein the DNA of interest is inserted into said nongenic sequence. In another aspect, an embodiment comprises the recombinant sequence, wherein a DNA of interest is inserted proximal to a zinc finger target site of Table 8. In another aspect, an embodiment comprises the recombinant sequence, wherein a DNA of interest is inserted at a zinc finger target site of Table 8. In another embodiment, the recombinant sequence comprises an inserted DNA of interest that further comprises an analytical domain. In another embodiment, the recombinant sequence comprises an inserted DNA of interest that does not encode a peptide. In a further embodiment, the recombinant sequence comprises a DNA of interest that encodes a peptide. In yet another embodiment, the recombinant sequence comprises an inserted DNA of interest that further comprises a gene expression cassette. In an embodiment, the gene expressions cassette contains a gene comprising an insecticidal resistance gene, herbicide tolerance gene, nitrogen use efficiency gene, water use efficiency gene, nutritional quality gene, DNA binding gene, and selectable marker gene. In a further embodiment, the recombinant sequence comprises two or more gene expression cassettes. In another embodiment, the recombinant sequence comprises two or more of said nongenic sequences each comprise an inserted DNA of interest to produce two or more recombinant sequences wherein the two or more recombinant sequences that are located on a same chromosome. In an additional embodiment, the recombinant sequence comprises the DNA of interest and/or the nongenic sequence are modified during insertion of said DNA of interest into the nongenic sequence. In another embodiment, the subject disclosure relates to a maize plant, maize plant part, or maize plant cell comprising a recombinant sequence comprising a nucleic acid sequence of at least 1 Kb and having at least 90%, 95%, or 99% sequence identity with a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), loci_232228_G1 (SEQ ID NO: 4529) with a DNA of interest inserted into the nongenic sequence.

In a further embodiment, the disclosure relates to a method of making a transgenic plant cell comprising a DNA of interest. In another aspect of the disclosure, the method comprises selecting a target nongenic maize genomic locus having at least 90%, 95%, or 99% sequence identity with a target nongenic maize genomic locus selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), and loci_232228_G1 (SEQ ID NO: 4529); selecting a site specific nuclease that specifically binds and cleaves said target nongenic maize genomic locus; introducing said site specific nuclease into a maize plant cell; introducing the DNA of interest into the plant cell; inserting the DNA of interest into said target nongenic maize genomic loci; and, selecting transgenic plant cells comprising the DNA of interest targeted to said nongenic locus. In a further aspect, an embodiment relates to a method of making a transgenic plant cell. In another embodiment, the DNA of interest comprises an analytical domain. In an embodiment, the DNA of interest does not encode a peptide. In yet another embodiment, the DNA of interest encodes a peptide. In a further embodiment, the DNA of interest comprises a gene expression cassette comprising a transgene. In another embodiment, the DNA of interest comprises two or more gene expression cassettes. In a subsequent embodiment, the site specific nuclease is selected from the group consisting of a zinc finger nuclease, a CRISPR nuclease, a TALEN, a homing endonuclease or a meganuclease. In an embodiment, the DNA of interest is integrated within said nongenic locus via a homology directed repair integration method. In another embodiment, the DNA of interest is integrated within said nongenic locus via a non-homologous end joining integration method. In a further embodiment, the method of making a transgenic plant cell provides for two or more of said DNA of interest that are inserted into two or more of said target nongenic maize genomic loci. In another embodiment, the method of making a transgenic plant cell comprises two or more of said target nongenic maize genomic loci that are located on a same chromosome. In an additional embodiment, the method of making a transgenic plant cell comprises the DNA of interest and/or the nongenic sequence that are modified during insertion of said DNA of interest into the nongenic sequence.

In accordance with one embodiment, a purified maize polynucleotide loci is disclosed herein, wherein the purified sequence comprises a nongenic sequence of at least 1 Kb. In one embodiment the nongenic sequence is hypomethylated, exemplifies evidence of recombination and is located in proximal location to an expressing genic region in the maize genome. In one embodiment, the nongenic sequence has a length ranging from about 1 Kb to about 8.4 Kb. In one embodiment, the DNA of interest comprises exogenous DNA sequences, including for example regulatory sequences, restriction cleavage sites, RNA encoding regions or protein encoding regions. In one embodiment, the DNA of interest comprises a gene expression cassette comprising one or more transgenes. In another embodiment, the purified sequence comprises a nongenic sequence having at least 90%, 95%, or 99% sequence identity with a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), and loci_232228_G1 (SEQ ID NO: 4529). In a further embodiment, the purified nongenic maize genomic loci comprise a DNA of interest, wherein said DNA of interest is inserted into said nongenic sequence. In another aspect, an embodiment comprises the purified nongenic maize genomic loci, wherein said DNA of interest is inserted proximal to a zinc finger target site of Table 8. In a different aspect, an embodiment comprises the purified nongenic maize genomic loci, wherein said DNA of interest is inserted between a pair of zinc finger target sites selected from Table 8. In yet another aspect, an embodiment comprises the purified nongenic maize genomic loci and a DNA of interest inserted into the nogenic maize genomic loci, wherein said DNA of interest comprises an analytical domain. In another aspect, an embodiment comprises the purified recombinant nongenic maize genomic loci, wherein said DNA of interest does not encode a peptide. In a subsequent aspect, an embodiment comprises the purified recombinant nongenic maize genomic loci, wherein said DNA of interest encodes a peptide. In an embodiment, the purified recombinant nongenic maize genomic loci comprises a gene expression cassette, wherein the gene cassette comprises a gene including, for example, an insecticidal resistance gene, herbicide tolerance gene, nitrogen use efficiency gene, water use efficiency gene, nutritional quality gene, DNA binding gene, and selectable marker gene. In one embodiment a DNA of interest is inserted into the nogenic maize genomic loci using a site specific nuclease wherein the site specific nuclease is selected from the group consisting of a zinc finger nuclease, a CRISPR nuclease, a TALEN, a homing endonuclease or a meganuclease. In an embodiment, the said DNA of interest is integrated within said nongenic sequence via a homology directed repair integration method. In another embodiment, the said DNA of interest is integrated within said nongenic sequence via a non-homologous end joining integration method. In a further embodiment, the DNA of interest comprises two or more gene expression cassettes. In a further embodiment, two or more of DNA of interest are inserted into two or more of said target nongenic maize genomic loci. In one embodiment, two or more of said target nongenic maize genomic loci are provided wherein each comprise an inserted DNA of interest to produce two or more recombinant sequences wherein the said target nongenic maize genomic lociare located on a same chromosome. In an additional embodiment, the purified nongenic maize genomic comprises the DNA of interest and/or the nongenic sequence that are modified during insertion of said DNA of interest into the nongenic sequence. In another embodiment, the DNA of interest is inserted via a homology directed repair or a non-homologous end joining repair mechanism.

In another embodiment, the subject disclosure provides for a plant comprising a recombinant sequence, said recombinant sequence comprising: a DNA of interest and a nucleic acid sequence having at least 90%, 95%, or 99% sequence identity with a nongenic sequence, wherein the DNA of interest is inserted into said nongenic sequence. In another embodiment, the nongenic sequence is selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), and loci_232228_G1 (SEQ ID NO: 4529). In an additional embodiment, the plant comprises two or more of said recombinant sequences. In a further embodiment the plant comprises two recombinant sequences that are located on the same chromosome. In another embodiment the plant comprises a DNA of interest inserted proximal to a zinc finger target site of Table 8. In one embodiment the plant comprises a DNA of interest inserted between a pair of zinc finger target sites selected from Table 8. In an embodiment, said DNA of interest comprises an analytical domain. In a further embodiment, said DNA of interest does not encode a peptide. In yet another embodiment, said DNA of interest encodes a peptide. In a subsequent embodiment, said DNA of interest comprises a gene expression cassette encoding a gene product, including for example, an insecticidal resistance gene, herbicide tolerance gene, nitrogen use efficiency gene, water use efficiency gene, nutritional quality gene, DNA binding gene, and selectable marker gene. In another embodiment the plant comprises a DNA of interest and/or a nongenic sequence that are modified during insertion of said DNA of interest into said nongenic sequence.

In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_137693_G1 (SEQ ID NO:387), loci_203075_G1 (SEQ ID NO:2030), and loci_204637_G1 (SEQ ID NO:2731), with a DNA of interest inserted into the nongenic sequence.

In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_265551_G1 (SEQ ID NO:463), loci_128078_G1 (SEQ ID NO:560), loci_168286_G1 (SEQ ID NO:573), loci_3733_G1 (SEQ ID NO:1268), and loci_232484_G1 (SEQ ID NO:2053), with a DNA of interest inserted into the nongenic sequence.

In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_127268_G1 (SEQ ID NO:2709), loci_232222_G1 (SEQ ID NO:3357), and loci_204726_G1 (SEQ ID NO:424), with a DNA of interest inserted into the nongenic sequence.

In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_136086_G1 (SEQ ID NO:4425), loci_203704_G1 (SEQ ID NO:2033), loci_291068_G1 (SEQ ID NO:3230), loci_43577_G1 (SEQ ID NO:3428), and loci_232228_G1 (SEQ ID NO: 4529) with a DNA of interest inserted into the nongenic sequence.

In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), and loci_204637_G1 (SEQ ID NO:2731), with a DNA of interest inserted into the nongenic sequence.

In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_127268_G1 (SEQ ID NO:2709), loci_204637_G1 (SEQ ID NO:2731), loci_232222_G1 (SEQ ID NO:3357), and loci_204726_G1 (SEQ ID NO:424), with a DNA of interest inserted into the nongenic sequence.

In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_136086_G1 (SEQ ID NO:4425), loci_203704_G1 (SEQ ID NO:2033), loci_127268_G1 (SEQ ID NO:2709), loci_291068_G1 (SEQ ID NO:3230), loci_232222_G1 (SEQ ID NO:3357), loci_43577_G1 (SEQ ID NO:3428), loci_204726_G1 (SEQ ID NO:424), and loci_232228_G1 (SEQ ID NO: 4529) with a DNA of interest inserted into the nongenic sequence.

BRIEF DESCRIPTION OF THE DRAWINGS

FIG. 10A-10C. Illustrates the constructs used for targeting and validation of the universal donor polynucleotide system integration within the Zea mays optimal genomic loci targeting and validation. FIG. 10A) ZFN design space with location of the ZFN pairs as previously shown in pDAB111845 of FIG. 5. The ZFN pairs are labelled numerically and correspond with specific ZFN binding sequences that are specifically recognized by ZFN proteins for binding and cleavage. FIG. 10B) Configuration of the ZFN expression construct. The ZFN expression construct contains a constitutive plant promoter (Zm Ubi1) which is used to drive expression of the ZFN protein. The ZFN protein contains the nuclear localization sequence (NLS), the zinc finger proteins (ZFP-L and ZFP-R, where L indicates left hand binding ZFN protein and R indicates right hand binding protein), Fok-1 endonuclease (Fok1) and the self-hydrolyzing 2A (2A). FIG. 10C) universal donor polynucleotide for NHEJ mediated targeting of Zea mays optimal genomic loci. Z1-Z6 represent ZFN binding sites specific for a Zea mays optimal genomic loci target. The number of ZFN sites can vary from 3-6. Vertical arrows show unique restriction sites and horizontal arrows represent potential PCR primer sites. The universal donor polynucleotide system is a short (110 bp) sequence that is common to donors used for integration within Zea mays optimal genomic loci.

FIG. 24A illustrates a distribution of the polynucleotide sequence lengths of the optimal genomic loci (OGL). FIG. 24B illustrates the distribution of expressed nucleic acid sequences relative to their proximity (log scale) to the optimal genomic loci (OGL). FIG. 24C illustrates the distribution of the optimal nongenic maize loci relative to their recombination frequency.

FIG. 25A illustrates the distribution of the optimal genomic loci sequences relative to their distance to actively transcribed endogenous genes. FIG. 25B illustrates the distribution of the optimal genomic loci sequences relative to their distance to the chromosomal centromere.

DETAILED DESCRIPTION

Definitions

Figure 1:
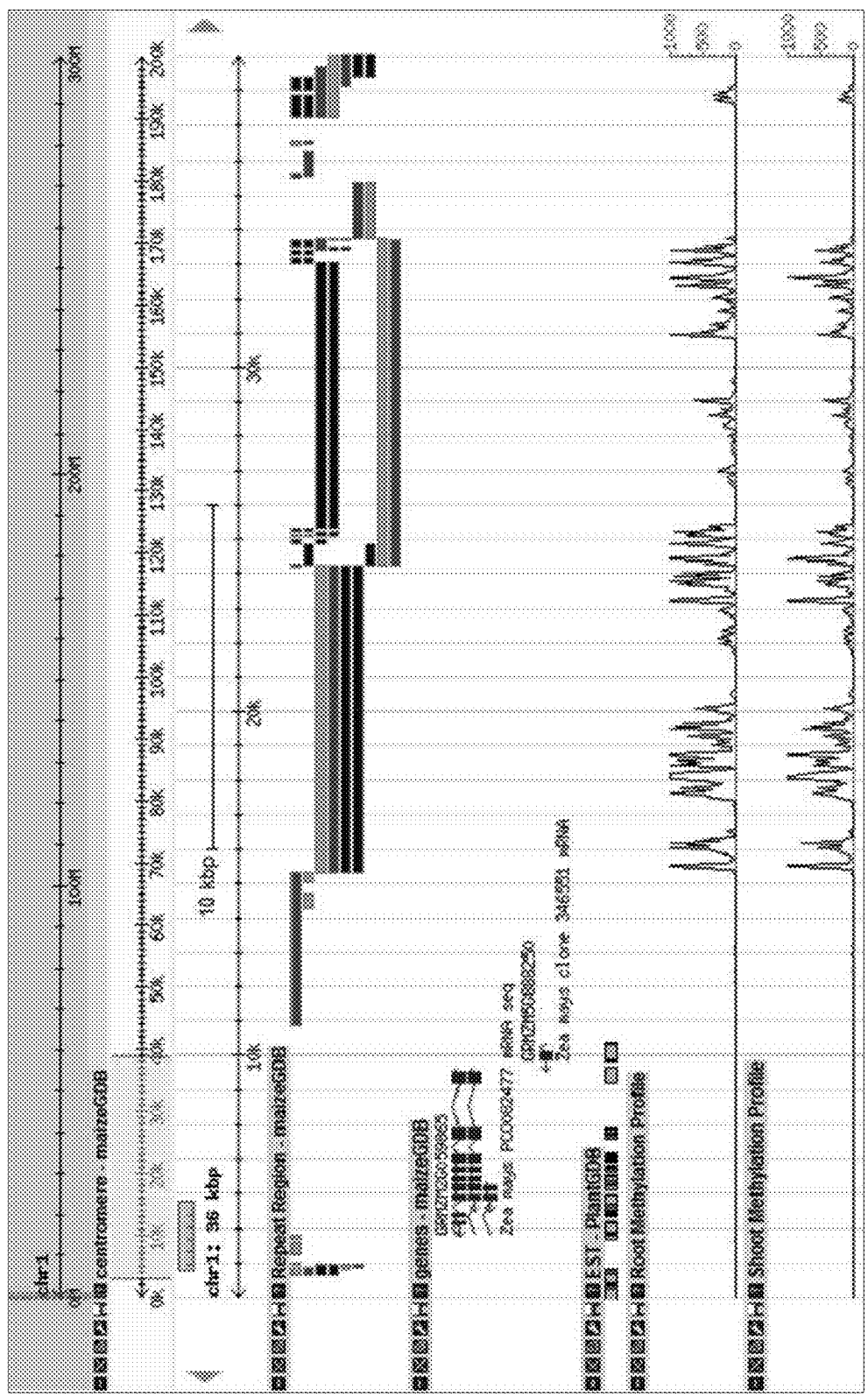
FIG. 1. Illustrates a screen-shot sample of a wiggle plot for the DNA methylation profile of root and shoot tissues obtained from Zea mays c.v. B73 chromosome number 1.

In describing and claiming the invention, the following terminology will be used in accordance with the definitions set forth below.

The term "about" as used herein means greater or lesser than the value or range of values stated by 10 percent, but is not intended to designate any value or range of values to only this broader definition. Each value or range of values preceded by the term "about" is also intended to encompass the embodiment of the stated absolute value or range of values.

As used herein, the term "plant" includes a whole plant and any descendant, cell, tissue, or part of a plant. The term "plant parts" include any part(s) of a plant, including, for example and without limitation: seed (including mature seed and immature seed); a plant cutting; a plant cell; a plant cell culture; a plant organ (e.g., pollen, embryos, flowers, fruits, shoots, leaves, roots, stems, and explants). A plant tissue or plant organ may be a seed, callus, or any other group of plant cells that is organized into a structural or functional unit. A plant cell or tissue culture may be capable of regenerating a plant having the physiological and morphological characteristics of the plant from which the cell or tissue was obtained, and of regenerating a plant having substantially the same genotype as the plant. In contrast, some plant cells are not capable of being regenerated to produce plants. Regenerable cells in a plant cell or tissue culture may be embryos, protoplasts, meristematic cells, callus, pollen, leaves, anthers, roots, root tips, silk, flowers, kernels, ears, cobs, husks, or stalks.

Plant parts include harvestable parts and parts useful for propagation of progeny plants. Plant parts useful for propagation include, for example and without limitation: seed; fruit; a cutting; a seedling; a tuber; and a rootstock. A harvestable part of a plant may be any useful part of a plant, including, for example and without limitation: flower; pollen; seedling; tuber; leaf; stem; fruit; seed; and root.

A plant cell is the structural and physiological unit of the plant. Plant cells, as used herein, includes protoplasts and protoplasts with a cell wall. A plant cell may be in the form of an isolated single cell, or an aggregate of cells (e.g., a friable callus and a cultured cell), and may be part of a higher organized unit (e.g., a plant tissue, plant organ, and plant). Thus, a plant cell may be a protoplast, a gamete producing cell, or a cell or collection of cells that can regenerate into a whole plant. As such, a seed, which comprises multiple plant cells and is capable of regenerating into a whole plant, is considered a "plant part" in embodiments herein.

The term "protoplast", as used herein, refers to a plant cell that had its cell wall completely or partially removed, with the lipid bilayer membrane thereof naked. Typically, a protoplast is an isolated plant cell without cell walls which has the potency for regeneration into cell culture or a whole plant.

As used herein the terms "native" or "natural" define a condition found in nature. A "native DNA sequence" is a DNA sequence present in nature that was produced by natural means or traditional breeding techniques but not generated by genetic engineering (e.g., using molecular biology/transformation techniques).

As used herein, "endogenous sequence" defines the native form of a polynucleotide, gene or polypeptide in its natural location in the organism or in the genome of an organism.

The term "isolated" as used herein means having been removed from its natural environment.

The term "purified", as used herein relates to the isolation of a molecule or compound in a form that is substantially free of contaminants normally associated with the molecule or compound in a native or natural environment and means having been increased in purity as a result of being separated from other components of the original composition. The term "purified nucleic acid" is used herein to describe a nucleic acid sequence which has been separated from other compounds including, but not limited to polypeptides, lipids and carbohydrates.

The terms "polypeptide", "peptide" and "protein" are used interchangeably to refer to a polymer of amino acid residues. The term also applies to amino acid polymers in which one or more amino acids are chemical analogues or modified derivatives of a corresponding naturally-occurring amino acids.

As used herein the terms "optimal maize genomic loci", "optimal nongenic maize loci", "optimal nongenic loci", or "optimal genomic loci (OGL)" are used interchangably to designate a native DNA sequence found in the nuclear genome of a maize plant that has the following properties: nongenic, hypomethylated, targetable, and in proximal location to a genic region, wherein the genomic region around the optimal maize genomic loci exemplifies evidence of recombination.

As used herein, the terms "nongenic maize sequence" or "nongenic maize genomic sequence" are used interchangeably to designate a native DNA sequence found in the nuclear genome of a maize plant, having a length of at least 1 Kb, and devoid of any open reading frames, gene sequences, or gene regulatory sequences. Furthermore, the nongenic maize sequence does not comprise any intron sequence (i.e., introns are excluded from the definition of nongenic). The nongenic sequence cannot be transcribed or translated into protein. Many plant genomes contain nongenic regions. As much as 95% of the genome can be nongenic, and these regions may be comprised of mainly repetitive DNA.

As used herein, a "genic region" is defined as a polynucleotide sequence that comprises an open reading frame encoding an RNA and/or polypeptide. The genic region may also encompass any identifiable adjacent 5' and 3' non-coding nucleotide sequences involved in the regulation of expression of the open reading frame up to about 2 Kb upstream of the coding region and 1 Kb downstream of the coding region, but possibly further upstream or downstream. A genic region further includes any introns that may be present in the genic region. Further, the genic region may comprise a single gene sequence, or multiple gene sequences interspersed with short spans (less than 1 Kb) of nongenic sequences.

As used herein a "nucleic acid of interest", "DNA of interest", or "donor" is defined as a nucleic acid/DNA sequence that has been selected for site directed, targeted insertion into the maize genome. A nucleic acid of interest can be of any length, for example between 2 and 50,000 nucleotides in length (or any integer value therebetween or thereabove), preferably between about 1,000 and 5,000 nucleotides in length (or any integer value therebetween). A nucleic acid of interest may comprise one or more gene expression cassettes that further comprise actively transcribed and/or translated gene sequences. Conversely, the nucleic acid of interest may comprise a polynucleotide sequence which does not comprise a functional gene expression cassette or an entire gene (e.g., may simply comprise regulatory sequences such as a promoter), or may not contain any identifiable gene expression elements or any actively transcribed gene sequence. The nucleic acid of interest may optionally contain an analytical domain. Upon insertion of the nucleic acid of interest into the maize genome, the inserted sequences are referred to as the "inserted DNA of interest". Further, the nucleic acid of interest can be DNA or RNA, can be linear or circular, and can be single-stranded or double-stranded. It can be delivered to the cell as naked nucleic acid, as a complex with one or more delivery agents (e.g., liposomes, poloxamers, T-strand encapsulated with proteins, etc.,) or contained in a bacterial or viral delivery vehicle, such as, for example, *Agrobacterium tumefaciens* or an adenovirus or an adeno-associated Virus (AAV), respectively.

As used herein the term "analytical domain" defines a nucleic acid sequence that contains functional elements that assist in the targeted insertion of nucleic acid sequences. For example, an analytical domain may contain specifically designed restriction enzyme sites, zinc finger binding sites, engineered landing pads or engineered transgene integration platforms and may or may not comprise gene regulatory elements or an open reading frame. See, for example, U.S. Patent Publication No 20110191899, incorporated herein by reference in its entirety.

As used herein the term "selected maize sequence" defines a native genomic DNA sequence of maize that has been chosen for analysis to determine if the sequence qualifies as an optimal nongenic maize genomic loci.

As used herein, the term "hypomethylation" or "hypomethylated", in reference to a DNA sequence, defines a reduced state of methylated DNA nucleotide residues in a given sequence of DNA. Typically, the decreased methylation relates to the number of methylated adenine or cytosine residues, relative to the average level of methylation found in nongenic sequences present in the maize genome.

As used herein a "targetable sequence" is a polynucleotide sequence that is sufficiently unique in a nuclear genome to allow site specific, targeted insertion of a nucleic acid of interest into one specific sequence.

As used herein the term "non-repeating" sequence is defined as a sequence of at least 1 Kb in length that shares less than 40% identity to any other sequence within the *Zea mays* genome. Calculations of sequence identity can be determined using any standard technique known to those skilled in the art including, for example, scanning a selected maize sequence against the *Zea mays* c.v. B73 genome using a BLAST™ based homology search using the NCBI BLAST™ software (version 2.2.23) run using the default parameter settings (Stephen F. Altschul et al (1997), "Gapped BLAST and PSI-BLAST: a new generation of protein database search programs", Nucleic Acids Res. 25:3389-3402). For example, as the selected maize sequences (from the *Zea mays* c.v. B73 genome) were analyzed, the first BLAST™ hit identified from such a search represents the *Zea mays* c.v. B73 sequence itself. The second BLAST™ hit for each selected maize sequence was identified and the alignment coverage (represented as the percent of the selected maize sequence covered by the BLAST™ hit) of the hit was used as a measure of uniqueness of the selected maize sequence within the *Zea mays* genome. These alignment coverage values for the second BLAST™ hit ranged from a minimum of 0% to a maximum of 39.98% sequence identity. Any sequences that aligned at higher levels of sequence identity were not considered.

The term "in proximal location to a genic region" when used in reference to a nongenic sequence defines the relative location of the nongenic sequence to a genic region. Specifically, the number of genic regions within a 40 Kb neighborhood (i.e., within 40 Kb on either end of the selected optimal maize genomic loci sequence) is analyzed. This analysis was completed by assaying gene annotation information and the locations of known genes in the *Zea mays* genome were extracted from Maize Genome Database. For each of the 5,286 optimal nongenic maize genomic loci, a 40 Kb window around the optimal genomic loci sequence was defined and the number of annotated genes with locations overlapping this window was counted. The number of genic regions ranged from a minimum of 1 gene to a maximum of 9 genes within the 40 Kb neighborhood.

The term "known maize coding sequence" as used herein relates to any polynucleotide sequence identified from the Maize Genomic Database (available at www.maizegdb.org and Monaco, M., et al., Maize Metabolic Network Construction and Transcriptome Analysis. doi:10.3835/plantgenome2012.09.0025; Posted online 23 Jan. 2013) that comprise an open reading frame, either before or after processing of intron sequences, and are transcribed into mRNA and optionally translated into a protein sequence when placed under the control of the appropriate genetic regulatory elements. The known maize coding sequence can be a cDNA sequence or a genomic sequence. In some instances, the known maize coding sequence can be annotated as a functional protein. In other instances, the known maize coding sequence may not be annotated.

The term "predicted maize coding sequence" as used herein relates to any Expressed Sequence Tag (EST) polynucleotide sequences described in the Maize Genomic Database. ESTs are identified from cDNA libraries constructed using oligo(dT) primers to direct first-strand synthesis by reverse transcriptase. The resulting ESTs are single-pass sequencing reads of less than 500 bp obtained from either the 5' or 3' end of the cDNA insert. Multiple ESTs may be aligned into a single contig. The identified EST sequences are uploaded into the Maize Genomic Database, and can be searched via bioinformatics methods to predict corresponding genomic polynucleotide sequences that comprise a coding sequence that is transcribed into mRNA and optionally translated into a protein sequence when placed under the control of the appropriate genetic regulatory elements.

The term "evidence of recombination" as used herein relates to the meiotic recombination frequencies between any pair of *Zea mays* genomic markers across a chromosome region comprising the selected maize sequence. The recombination frequencies were calculated based on the ratio of the genetic distance between markers (in centimorgan (cM)) to the physical distance between the markers (in megabases (Mb)). For a selected maize sequence to have evidence of recombination, the selected maize sequence must contain at least one recombination event between two markers flanking the selected maize sequence as detected using a high resolution marker dataset generated from multiple mapping populations. (See for example, Jafar Mammadov, Wei Chen, Anastasia Chueva, Karthik Muthuraman, Ruihua Ren, David Meyer, and Siva Kumpatla. 2011. Distribution of Recombinant Frequencies across the Maize Genome. 52$^{nd}$ Annual Maize Genetics Conference).

As used herein the term "relative location value" is a calculated value defining the distance of a genomic locus from its corresponding chromosomal centromere. For each selected maize sequence, the genomic distance from the native location of the selected maize sequence to the centromere of the chromosome that it is located on, is measured (in Bp). The relative location of selected maize sequence within the chromosome is represented as the ratio of its genomic distance to the centromere relative to the length of the specific chromosomal arm (measured in Bp) that it lies on. These relative location values for the optimal nongenic maize genomic loci dataset ranged from a minimum of 0.00373 to a maximum of 0.99908 ratio of genomic distance.

The term "exogenous DNA sequence" as used herein is any nucleic acid sequence that has been removed from its native location and inserted into a new location altering the sequences that flank the nucleic acid sequence that has been moved. For example, an exogenous DNA sequence may comprise a sequence from another species.

"Binding" refers to a sequence-specific, interaction between macromolecules (e.g., between a protein and a nucleic acid). Not all components of a binding interaction need be sequence-specific (e.g., contacts with phosphate residues in a DNA backbone), as long as the interaction as a whole is sequence-specific. Such interactions are generally characterized by a dissociation constant (Kd). "Affinity" refers to the strength of binding: increased binding affinity being correlated with a lower binding constant (Kd).

A "binding protein" is a protein that is able to bind to another molecule. A binding protein can bind to, for example, a DNA molecule (a DNA-binding protein), an RNA molecule (an RNA-binding protein) and/or a protein molecule (a protein-binding protein). In the case of a protein-binding protein, it can bind to itself (to form homodimers, homotrimers, etc.) and/or it can bind to one or more molecules of a different protein or proteins. A binding protein can have more than one type of binding activity. For example, zinc finger proteins have DNA-binding, RNA-binding and protein-binding activity.

As used herein the term "zinc fingers," defines regions of amino acid sequence within a DNA binding protein binding domain whose structure is stabilized through coordination of a zinc ion.

A "zinc finger DNA binding protein" (or binding domain) is a protein, or a domain within a larger protein, that binds DNA in a sequence-specific manner through one or more zinc fingers, which are regions of amino acid sequence within the binding domain whose structure is stabilized through coordination of a zinc ion. The term zinc finger DNA binding protein is often abbreviated as zinc finger protein or ZFP. Zinc finger binding domains can be "engineered" to bind to a predetermined nucleotide sequence. Non-limiting examples of methods for engineering zinc finger proteins are design and selection. A designed zinc finger protein is a protein not occurring in nature whose design/composition results principally from rational criteria. Rational criteria for design include application of substitution rules and computerized algorithms for processing information in a database storing information of existing ZFP designs and binding data. See, for example, U.S. Pat. Nos. 6,140,081; 6,453,242; 6,534,261 and 6,794,136; see also WO 98/53058; WO 98/53059; WO 98/53060; WO 02/016536 and WO 03/016496.

A "TALE DNA binding domain" or "TALE" is a polypeptide comprising one or more TALE repeat domains/units. The repeat domains are involved in binding of the TALE to its cognate target DNA sequence. A single "repeat unit" (also referred to as a "repeat") is typically 33-35 amino acids in length and exhibits at least some sequence homology with other TALE repeat sequences within a naturally occurring TALE protein. See, e.g., U.S. Patent Publication No. 20110301073, incorporated by reference herein in its entirety.

The CRISPR (Clustered Regularly Interspaced Short Palindromic Repeats)/Cas (CRISPR Associated) nuclease system. Briefly, a "CRISPR DNA binding domain" is a short stranded RNA molecule that acting in concert with the CAS enzyme can selectively recognize, bind, and cleave genomic DNA. The CRISPR/Cas system can be engineered to create a double-stranded break (DSB) at a desired target in a genome, and repair of the DSB can be influenced by the use of repair inhibitors to cause an increase in error prone repair. See, e.g., Jinek et al (2012) Science 337, p. 816-821, Jinek et al, (2013), eLife 2:e00471, and David Segal, (2013) eLife 2:e00563).

Zinc finger, CRISPR and TALE binding domains can be "engineered" to bind to a predetermined nucleotide sequence, for example via engineering (altering one or more amino acids) of the recognition helix region of a naturally occurring zinc finger. Similarly, TALEs can be "engineered" to bind to a predetermined nucleotide sequence, for example by engineering of the amino acids involved in DNA binding (the repeat variable diresidue or RVD region). Therefore, engineered DNA binding proteins (zinc fingers or TALEs) are proteins that are non-naturally occurring. Non-limiting examples of methods for engineering DNA-binding proteins are design and selection. A designed DNA binding protein is a protein not occurring in nature whose design/composition results principally from rational criteria. Rational criteria for design include application of substitution rules and computerized algorithms for processing information in a database storing information of existing ZFP and/or TALE designs and binding data. See, for example, U.S. Pat. Nos. 6,140,081; 6,453,242; and 6,534,261; see also WO 98/53058; WO 98/53059; WO 98/53060; WO 02/016536 and WO 03/016496 and U.S. Publication Nos. 20110301073, 20110239315 and 20119145940.

A "selected" zinc finger protein, CRISPR or TALE is a protein not found in nature whose production results primarily from an empirical process such as phage display, interaction trap or hybrid selection. See e.g., U.S. Pat. No. 5,789,538; U.S. Pat. No. 5,925,523; U.S. Pat. No. 6,007,988; U.S. Pat. No. 6,013,453; U.S. Pat. No. 6,200,759; WO 95/19431; WO 96/06166; WO 98/53057; WO 98/54311; WO 00/27878; WO 01/60970 WO 01/88197 and WO 02/099084 and U.S. Publication Nos. 20110301073, 20110239315 and 20119145940.

"Recombination" refers to a process of exchange of genetic information between two polynucleotides, including but not limited to, donor capture by non-homologous end joining (NHEJ) and homologous recombination. For the purposes of this disclosure, "homologous recombination (HR)" refers to the specialized form of such exchange that takes place, for example, during repair of double-strand breaks in cells via homology-directed repair mechanisms. This process requires nucleotide sequence homology, uses a "donor" molecule to template repair of a "target" molecule (i.e., the nucleotide sequence that experienced the double-strand break), and is variously known as "non-crossover gene conversion" or "short tract gene conversion," because it leads to the transfer of genetic information from the donor to the target. Without wishing to be bound by any particular theory, such transfer can involve mismatch correction of heteroduplex DNA that forms between the broken target and the donor, and/or "synthesis-dependent strand annealing," in which the donor is used to resynthesize genetic information that will become part of the target, and/or related processes. Such specialized HR often results in an alteration of the sequence of the target molecule such that part or all of the sequence of the donor polynucleotide is incorporated into the target polynucleotide. For HR-directed integration, the donor molecule contains at least 2 regions of homology to the genome ("homology arms") of least 50-100 base pairs in length. See, e.g., U.S. Patent Publication No. 20110281361. In the methods of the disclosure, one or more targeted nucleases as described herein create a double-stranded break in the target sequence (e.g., cellular chromatin) at a predetermined site, and a "donor" polynucleotide, having homology to the nucleotide sequence in the region of the break for HR mediated integration or having no homology to the nucleotide sequence in the region of the break for NHEJ mediated integration, can be introduced into the cell. The presence of the double-stranded break has been shown to facilitate integration of the donor sequence. The donor sequence may be physically integrated or, alternatively, the donor polynucleotide is used as a template for repair of the break via homologous recombination, resulting in the introduction of all or part of the nucleotide sequence as in the donor into the cellular chromatin. Thus, a first sequence in cellular chromatin can be altered and, in certain embodiments, can be converted into a sequence present in a donor polynucleotide. Thus, the use of the terms "replace" or "replacement" can be understood to represent replacement of one nucleotide sequence by another, (i.e., replacement of a sequence in the informational sense), and does not necessarily require physical or chemical replacement of one polynucleotide by another. In any of the methods described herein, additional pairs of zinc-finger proteins, CRISPRS or TALEN can be used for additional double-stranded cleavage of additional target sites within the cell.

Any of the methods described herein can be used for insertion of a donor of any size and/or partial or complete inactivation of one or more target sequences in a cell by targeted integration of donor sequence that disrupts expression of the gene(s) of interest. Cell lines with partially or completely inactivated genes are also provided.

Furthermore, the methods of targeted integration as described herein can also be used to integrate one or more exogenous sequences. The exogenous nucleic acid sequence can comprise, for example, one or more genes or cDNA molecules, or any type of coding or noncoding sequence, as well as one or more control elements (e.g., promoters). In addition, the exogenous nucleic acid sequence (transgene) may produce one or more RNA molecules (e.g., small hairpin RNAs (shRNAs), inhibitory RNAs (RNAis), micro-RNAs (miRNAs), etc.), or protein.

"Cleavage" as used herein defines the breakage of the phosphate-sugar backbone of a DNA molecule. Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends. In certain embodiments, fusion polypeptides are used for targeted double-stranded DNA cleavage. A "cleavage domain" comprises one or more polypeptide sequences which possesses catalytic activity for DNA cleavage. A cleavage domain can be contained in a single polypeptide chain or cleavage activity can result from the association of two (or more) polypeptides.

A "cleavage half-domain" is a polypeptide sequence which, in conjunction with a second polypeptide (either identical or different) forms a complex having cleavage activity (preferably double-strand cleavage activity). The terms "first and second cleavage half-domains;" "+ and − cleavage half-domains" and "right and left cleavage half-domains" are used interchangeably to refer to pairs of cleavage half-domains that dimerize.

An "engineered cleavage half-domain" is a cleavage half-domain that has been modified so as to form obligate heterodimers with another cleavage half-domain (e.g., another engineered cleavage half-domain). See, also, U.S. Patent Publication Nos. 2005/0064474, 20070218528, 2008/0131962 and 2011/0201055, incorporated herein by reference in their entireties.

A "target site" or "target sequence" refers to a portion of a nucleic acid to which a binding molecule will bind, provided sufficient conditions for binding exist.

Nucleic acids include DNA and RNA, can be single- or double-stranded; can be linear, branched or circular; and can be of any length. Nucleic acids include those capable of forming duplexes, as well as triplex-forming nucleic acids. See, for example, U.S. Pat. Nos. 5,176,996 and 5,422,251. Proteins include, but are not limited to, DNA-binding proteins, transcription factors, chromatin remodeling factors, methylated DNA binding proteins, polymerases, methylases, demethylases, acetylases, deacetylases, kinases, phosphatases, integrases, recombinases, ligases, topoisomerases, gyrases and helicases.

A "product of an exogenous nucleic acid" includes both polynucleotide and polypeptide products, for example, transcription products (polynucleotides such as RNA) and translation products (polypeptides).

A "fusion" molecule is a molecule in which two or more subunit molecules are linked, for example, covalently. The subunit molecules can be the same chemical type of molecule, or can be different chemical types of molecules. Examples of the first type of fusion molecule include, but are not limited to, fusion proteins (for example, a fusion between a ZFP DNA-binding domain and a cleavage domain) and fusion nucleic acids (for example, a nucleic acid encoding the fusion protein described supra). Examples of the second type of fusion molecule include, but are not limited to, a fusion between a triplex-forming nucleic acid and a polypeptide, and a fusion between a minor groove binder and a nucleic acid. Expression of a fusion protein in a cell can result from delivery of the fusion protein to the cell or by delivery of a polynucleotide encoding the fusion protein to a cell, wherein the polynucleotide is transcribed, and the transcript is translated, to generate the fusion protein. Trans-splicing, polypeptide cleavage and polypeptide ligation can also be involved in expression of a protein in a cell. Methods for polynucleotide and polypeptide delivery to cells are presented elsewhere in this disclosure.

For the purposes of the present disclosure, a "gene", includes a DNA region encoding a gene product (see infra), as well as all DNA regions which regulate the production of the gene product, whether or not such regulatory sequences are adjacent or operably linked to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

"Gene expression" refers to the conversion of the information, contained in a gene, into a gene product. A gene product can be the direct transcriptional product of a gene (e.g., mRNA, tRNA, rRNA, antisense RNA, interfering RNA, ribozyme, structural RNA or any other type of RNA) or a protein produced by translation of a mRNA. Gene products also include RNAs which are modified, by processes such as capping, polyadenylation, methylation, and editing, and proteins modified by, for example, methylation, acetylation, phosphorylation, ubiquitination, ADP-ribosylation, myristilation, and glycosylation.

Sequence identity: The term "sequence identity" or "identity," as used herein in the context of two nucleic acid or polypeptide sequences, refers to the residues in the two sequences that are the same when aligned for maximum correspondence over a specified comparison window.

As used herein, the term "percentage of sequence identity" refers to the value determined by comparing two optimally aligned sequences (e.g., nucleic acid sequences, and amino acid sequences) over a comparison window, wherein the portion of the sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleotide or amino acid residue occurs in both sequences to yield the number of matched positions, dividing the number of matched positions by the total number of positions in the comparison window, and multiplying the result by 100 to yield the percentage of sequence identity.

Methods for aligning sequences for comparison are well-known in the art. Various programs and alignment algorithms are described in, for example: Smith and Waterman (1981) Adv. Appl. Math. 2:482; Needleman and Wunsch (1970) J. Mol. Biol. 48:443; Pearson and Lipman (1988) Proc. Natl. Acad. Sci. U.S.A. 85:2444; Higgins and Sharp (1988) Gene 73:237-44; Higgins and Sharp (1989) CABIOS 5:151-3; Corpet et al. (1988) Nucleic Acids Res. 16:10881-90; Huang et al. (1992) Comp. Appl. Biosci. 8:155-65; Pearson et al. (1994) Methods Mol. Biol. 24:307-31; Tatiana et al. (1999) FEMS Microbiol. Lett. 174:247-50. A detailed consideration of sequence alignment methods and homology calculations can be found in, e.g., Altschul et al. (1990) J. Mol. Biol. 215:403-10. The National Center for Biotechnology Information (NCBI) Basic Local Alignment Search Tool (BLAST™; Altschul et al. (1990)) is available from several sources, including the National Center for Biotechnology Information (Bethesda, Md.), and on the internet, for use in connection with several sequence analysis programs. A description of how to determine sequence identity using this program is available on the internet under the "help" section for BLAST™. For comparisons of nucleic acid sequences, the "Blast 2 sequences" function of the BLAST™ (Blastn) program may be employed using the default parameters. Nucleic acid sequences with even greater similarity to the reference sequences will show increasing percentage identity when assessed by this method.

Specifically hybridizable/Specifically complementary: As used herein, the terms "specifically hybridizable" and "specifically complementary" are terms that indicate a sufficient degree of complementarity, such that stable and specific binding occurs between the nucleic acid molecule and a target nucleic acid molecule. Hybridization between two nucleic acid molecules involves the formation of an anti-parallel alignment between the nucleic acid sequences of the two nucleic acid molecules. The two molecules are then able to form hydrogen bonds with corresponding bases on the opposite strand to form a duplex molecule that, if it is sufficiently stable, is detectable using methods well known in the art. A nucleic acid molecule need not be 100% complementary to its target sequence to be specifically hybridizable. However, the amount of sequence complementarity that must exist for hybridization to be specific is a function of the hybridization conditions used.

Hybridization conditions resulting in particular degrees of stringency will vary depending upon the nature of the hybridization method of choice and the composition and length of the hybridizing nucleic acid sequences. Generally, the temperature of hybridization and the ionic strength (especially the Na+ and/or Mg++ concentration) of the hybridization buffer will determine the stringency of hybridization, though wash times also influence stringency. Calculations regarding hybridization conditions required for attaining particular degrees of stringency are known to those of ordinary skill in the art, and are discussed, for example, in Sambrook et al. (ed.) Molecular Cloning: A Laboratory Manual, 2nd ed., vol. 1-3, Cold Spring Harbor Laboratory Press, Cold Spring Harbor, N.Y., 1989, chapters 9 and 11; and Hames and Higgins (eds.) Nucleic Acid Hybridization, IRL Press, Oxford, 1985. Further detailed instruction and guidance with regard to the hybridization of nucleic acids may be found, for example, in Tijssen, "Overview of principles of hybridization and the strategy of nucleic acid probe assays," in Laboratory Techniques in Biochemistry and Molecular Biology-Hybridization with Nucleic Acid Probes, Part I, Chapter 2, Elsevier, N.Y., 1993; and Ausubel et al., Eds., Current Protocols in Molecular Biology, Chapter 2, Greene Publishing and Wiley-Interscience, NY, 1995.

As used herein, "stringent conditions" encompass conditions under which hybridization will only occur if there is less than 20% mismatch between the hybridization molecule and a sequence within the target nucleic acid molecule. "Stringent conditions" include further particular levels of stringency. Thus, as used herein, "moderate stringency" conditions are those under which molecules with more than 20% sequence mismatch will not hybridize; conditions of "high stringency" are those under which sequences with more than 10% mismatch will not hybridize; and conditions of "very high stringency" are those under which sequences with more than 5% mismatch will not hybridize. The following are representative, non-limiting hybridization conditions.

High Stringency condition (detects sequences that share at least 90% sequence identity): Hybridization in 5×SSC buffer (wherein the SSC buffer contains a detergent such as SDS, and additional reagents like salmon sperm DNA, EDTA, etc.) at 65° C. for 16 hours; wash twice in 2×SSC buffer (wherein the SSC buffer contains a detergent such as SDS, and additional reagents like salmon sperm DNA, EDTA, etc.) at room temperature for 15 minutes each; and wash twice in 0.5×SSC buffer (wherein the SSC buffer contains a detergent such as SDS, and additional reagents like salmon sperm DNA, EDTA, etc.) at 65° C. for 20 minutes each.

Moderate Stringency condition (detects sequences that share at least 80% sequence identity): Hybridization in 5×-6×SSC buffer (wherein the SSC buffer contains a detergent such as SDS, and additional reagents like salmon sperm DNA, EDTA, etc.) at 65-70° C. for 16-20 hours; wash twice in 2×SSC buffer (wherein the SSC buffer contains a detergent such as SDS, and additional reagents like salmon sperm DNA, EDTA, etc.) at room temperature for 5-20 minutes each; and wash twice in 1×SSC buffer (wherein the SSC buffer contains a detergent such as SDS, and additional reagents like salmon sperm DNA, EDTA, etc.) at 55-70° C. for 30 minutes each.

Non-stringent control condition (sequences that share at least 50% sequence identity will hybridize): Hybridization in 6×SSC buffer (wherein the SSC buffer contains a detergent such as SDS, and additional reagents like salmon sperm DNA, EDTA, etc.) at room temperature to 55° C. for 16-20 hours; wash at least twice in 2×-3×SSC buffer (wherein the SSC buffer contains a detergent such as SDS, and additional reagents like salmon sperm DNA, EDTA, etc.) at room temperature to 55° C. for 20-30 minutes each.

As used herein, the term "substantially homologous" or "substantial homology," with regard to a contiguous nucleic acid sequence, refers to contiguous nucleotide sequences that hybridize under stringent conditions to the reference nucleic acid sequence. For example, nucleic acid sequences that are substantially homologous to a reference nucleic acid sequence are those nucleic acid sequences that hybridize under stringent conditions (e.g., the Moderate Stringency conditions set forth, supra) to the reference nucleic acid sequence. Substantially homologous sequences may have at least 80% sequence identity. For example, substantially homologous sequences may have from about 80% to 100% sequence identity, such as about 81%; about 82%; about 83%; about 84%; about 85%; about 86%; about 87%; about 88%; about 89%; about 90%; about 91%; about 92%; about 93%; about 94% about 95%; about 96%; about 97%; about 98%; about 98.5%; about 99%; about 99.5%; and about 100%. The property of substantial homology is closely related to specific hybridization. For example, a nucleic acid molecule is specifically hybridizable when there is a sufficient degree of complementarity to avoid non-specific binding of the nucleic acid to non-target sequences under conditions where specific binding is desired, for example, under stringent hybridization conditions.

In some instances "homologous" may be used to refer to the relationship of a first gene to a second gene by descent from a common ancestral DNA sequence. In such instances, the term, homolog, indicates a relationship between genes separated by the event of speciation (see ortholog) or to the relationship between genes separated by the event of genetic duplication (see paralog). In other instances "homologous" may be used to refer to the level of sequence identity between one or more polynucleotide sequences, in such instances the one or more polynucelotide sequences do not necessarily descend from a common ancestral DNA sequence. Those with skill in the art are aware of the interchangeably of the term "homologous" and appreciate the proper application of the term.

As used herein, the term "ortholog" (or "orthologous") refers to a gene in two or more species that has evolved from a common ancestral nucleotide sequence, and may retain the same function in the two or more species.

As used herein, the term "paralogous" refers to genes related by duplication within a genome. Orthologs retain the same function in the course of evolution, whereas paralogs evolve new functions, even if these new functions are unrelated to the original gene function.

As used herein, two nucleic acid sequence molecules are said to exhibit "complete complementarity" when every nucleotide of a sequence read in the 5' to 3' direction is complementary to every nucleotide of the other sequence when read in the 3' to 5' direction. A nucleotide sequence that is complementary to a reference nucleotide sequence will exhibit a sequence identical to the reverse complement sequence of the reference nucleotide sequence. These terms and descriptions are well defined in the art and are easily understood by those of ordinary skill in the art.

When determining the percentage of sequence identity between amino acid sequences, it is well-known by those of skill in the art that the identity of the amino acid in a given position provided by an alignment may differ without affecting desired properties of the polypeptides comprising the aligned sequences. In these instances, the percent sequence identity may be adjusted to account for similarity between conservatively substituted amino acids. These adjustments are well-known and commonly used by those of skill in the art. See, e.g., Myers and Miller (1988) Computer Applications in Biosciences 4:11-7. Statistical methods are known in the art and can be used in analysis of the identified 5,286 optimal genomic loci.

As an embodiment, the identified optimal genomic loci comprising 5,286 individual optimal genomic loci sequences can be analyzed via an F-distribution test. In probability theory and statistics, the F-distribution is a continuous probability distribution. The F-distribution test is a statistical significance test that has an F-distribution, and is used when comparing statistical models that have been fit to a data set, to identify the best-fitting model. An F-distribution is a continuous probability distribution, and is also known as Snedecor's F-distribution or the Fisher-Snedecor distribution. The F-distribution arises frequently as the null distribution of a test statistic, most notably in the analysis of variance. The F-distribution is a right-skewed distribution. The F-distribution is an asymmetric distribution that has a minimum value of 0, but no maximum value. The curve reaches a peak not far to the right of 0, and then gradually approaches the horizontal axis the larger the F value is. The F-distribution approaches, but never quite touches the horizontal axis. It will be appreciated that in other embodiments, variations on this equation, or indeed different equations, may be derived and used by the skilled person and are applicable to the analysis of 5,286 individual optimal genomic loci sequences.

Operably linked: A first nucleotide sequence is "operably linked" with a second nucleotide sequence when the first nucleotide sequence is in a functional relationship with the second nucleotide sequence. For instance, a promoter is operably linked to a coding sequence if the promoter affects the transcription or expression of the coding sequence. When recombinantly produced, operably linked nucleotide sequences are generally contiguous and, where necessary to join two protein-coding regions, in the same reading frame. However, nucleotide sequences need not be contiguous to be operably linked.

The term, "operably linked," when used in reference to a regulatory sequence and a coding sequence, means that the regulatory sequence affects the expression of the linked coding sequence. "Regulatory sequences," "regulatory elements", or "control elements," refer to nucleotide sequences that influence the timing and level/amount of transcription, RNA processing or stability, or translation of the associated coding sequence. Regulatory sequences may include promoters; translation leader sequences; introns; enhancers; stem-loop structures; repressor binding sequences; termination sequences; polyadenylation recognition sequences; etc. Particular regulatory sequences may be located upstream and/or downstream of a coding sequence operably linked thereto. Also, particular regulatory sequences operably linked to a coding sequence may be located on the associated complementary strand of a double-stranded nucleic acid molecule.

When used in reference to two or more amino acid sequences, the term "operably linked" means that the first amino acid sequence is in a functional relationship with at least one of the additional amino acid sequences.

The disclosed methods and compositions include fusion proteins comprising a cleavage domain operably linked to a DNA-binding domain (e.g., a ZFP) in which the DNA-binding domain by binding to a sequence in the *Zea mays* optimal genomic locus directs the activity of the cleavage domain to the vicinity of the sequence and, hence, induces a double stranded break in the optimal genomic locus. As set forth elsewhere in this disclosure, a zinc finger domain can be engineered to bind to virtually any desired sequence. Accordingly, one or more DNA-binding domains can be engineered to bind to one or more sequences in the optimal genomic locus. Expression of a fusion protein comprising a DNA-binding domain and a cleavage domain in a cell, effects cleavage at or near the target site.

EMBODIMENTS

Targeting transgenes and transgene stacks to specific locations in the *Zea mays* genome will improve the quality of transgenic events, reduce costs associated with production of transgenic events and provide new methods for making transgenic plant products such as sequential gene stacking. Overall, targeting trangenes to specific genomic sites is likely to be commercially beneficial. Significant advances have been made in the last few years towards development of site-specific nucleases such as ZFNs, CRISPRs, and TALENs that can facilitate addition of donor polynucleotides to pre-selected sites in plant and other genomes. However, much less is known about the attributes of genomic sites that are suitable for targeting. Historically, non-essential genes and pathogen (viral) integration sites in genomes have been used as loci for targeting. The number of such sites in genomes is rather limiting and there is therefore a need for identification and characterization of optimal genomic loci that can be used for targeting of donor polynucleotide sequences. In addition to being amenable to targeting, optimal genomic loci are expected to be neutral sites that can support transgene expression and breeding applications.

Applicants have recognized that additional criteria are desirable for insertion sites and have combined these criteria to identify and select optimal sites in the maize genome for the insertion of exogenous sequences. For targeting purposes, the site of selected insertion needs to be unique and in a non-repetitive region of the *Zea mays* genome. Likewise, the optimal genomic site for insertion should possess minimal undesirable phenotypic effects and be susceptible to recombination events to facilitate introgression into agronomically elite lines using traditional breeding techniques. In order to identify the genomic loci that meet the listed criteria, the *Zea mays* genome was scanned using a customized bioinformatics approach and genome scale datasets to identify novel genomic loci possessing characteristics that are beneficial for the integration of polynucleotide donor sequence and the subsequent expression of a inserted coding sequence.

I. Identification of Nongenic Maize Genomic Loci

In accordance with one embodiment a method is provided for identifying optimal nongenic maize genomic sequence for insertion of exogenous sequences. The method comprises the steps of first identifying maize genomic sequences of at least 1 Kb in length that are hypomethylated. In one embodiment the hypomethylated genomic sequence is 1, 1.5, 2, 2.5, 3, 3.5, 4, 4.5, 5, 5.5, 6, 6.5, 7, 7.5, 8, 8.5, 9, 10, 11, 12, 13, 14, 15, 16 or 17 Kb in length. In one embodiment the hypomethylated genomic sequence is about 1 to about 4 Kb in length and in a further embodiment is about 2 Kb in length. A sequence is considered hypomethylated if it has less than 1% DNA methylation within the sequence. In one embodiment the methylation status is measured based on the presence of 5-methylcytosine at one or more CpG dinucleotides, CHG or CHH trinucleotides within a selected maize sequence, relative to the amount of total cytosines found at corresponding CpG dinucleotides, CHG or CHH trinucleotides within a normal control DNA sample. CHH methylation indicates a 5-methylcytosine followed by two nucleotides that many not be guanine and CHG methylation refers to a 5-methylcytosine preceding an adenine, thymine or cytocine based followed by guanine. More particularly, in one embodiment the selected maize sequence has less than 1, 2 or 3 methylated nucleotides per 500 nucleotides of the selected maize sequence. In one embodiment the selected maize sequence has less than one, two, or three 5-methylcytosines at CpG dinucleotides per 500 nucleotides of the selected maize sequence. In one embodiment the selected maize sequence is 1 to 4 Kb in length and comprises a 1 Kb sequence devoid of 5-methylcytosines. In one embodiment the selected maize sequence is 1, 1.5, 2, 2.5, 3, 3.5, 4, 4.5, 5, 5.5, 6, 6.5, 7, 7.5, 8, or 8.5 Kb in length and contains 1 or 0 methylated nucleotides in its entire length. In one embodiment the selected maize sequence is 1, 1.5, 2, 2.5, 3, 3.5, 4, 4.5, 5, 5.5, 6, 6.5, 7, 7.5, 8, or 8.5 Kb in length and contains no 5-methylcytosines at CpG dinucleotides within in its entire length. In accordance with one embodiment the methylation of a selected maize sequence may vary based on source tissue. In such embodiments the methylation levels used to determine if a sequence is hypomethylated represents the average amount of methylation in the sequences isolated from two or more tissues (e.g., from root and shoot).

In addition to the requirement that an optimal genomic site be hypomethylated, the selected maize sequence must also be nongenic. Accordingly, all hypomethylated genomic sequences are further screened to eliminate hypomethylated sequences that contain a genic region. This includes any open reading frames regardless of whether the transcript encodes a protein. Hypomethylated genomic sequences that include genic regions, including any identifiable adjacent 5' and 3' non-coding nucleotide sequences involved in the regulation of expression of an open reading frame and any introns that may be present in the genic region, are excluded from the optimal nongenic maize genomic locus of the present disclosure.

Optimal nongenic maize genomic loci must also be sequences that have demonstrated evidence of recombination. In one embodiment the selected maize sequence must be one where at least one recombination event has been detected between two markers flanking the selected maize sequence as detected using a high resolution marker dataset generated from multiple mapping populations. In one embodiment the pair of markers flanking a 0.5, 1, 1.5 Mb maize genomic sequence comprising the selected maize sequence are used to calculate the recombinant frequency for the selected maize sequence. Recombination frequencies between each pairs of markers (measured in centimorgan (cM)) to the genomic physical distance between the markers (in Mb)) must be greater than 0 cM/Mb. In one embodiment the recombination frequency for a 1 Mb maize genomic sequence comprising the selected maize sequence ranges from about 0.00041 to about 4.0. In one embodiment the recombination frequency for a 1 Mb maize genomic sequence comprising the selected maize sequence ranges from about 0.5 to about 5.0. In one embodiment an optimal genomic loci is one where recombination events have been detected within the selected maize sequence.

An optimal nongenic maize genomic loci will also be a targetable sequence, i.e., a sequence that is relatively unique in the maize genome such that a gene targeted to the selected maize sequence will only insert in one location of the maize genome. In one embodiment the entire length of the optimal genomic sequence shares less than 30%, 35%, or 40%, sequence identity with another sequence of similar length contained in the maize genome. Accordingly in one embodiment the selected maize sequence cannot comprise a 1 Kb sequence that shares more than 25%, 30%, 35%, or 40% sequence identity with another 1 Kb sequence contained in the maize genome. In a further embodiment the selected maize sequence cannot comprise a 500 bp sequence that shares more than 30%, 35%, or 40% sequence identity with another 500 bp sequence contained in the maize genome. In one embodiment the selected maize sequence cannot comprise a 1 KB sequence that shares more than 40% sequence identity with another 1 Kb sequence contained in the maize genome.

An optimal nongenic maize genomic loci will also be proximal to a genic region. More particularly, a selected maize sequence must be located in the vicinity of a genic region (e.g., a genic region must be located within 40 Kb of genomic sequence flanking and contiguous with either end of the selected maize as found in the native genome). In one embodiment a genic region is located within 10, 20, 30 or 40 Kb of contiguous genomic sequence located at either end of the selected maize sequence as found in the native maize genome. In one embodiment two or more genic regions are located within 10, 20, 30 or 40 Kb of contiguous genomic sequence flanking the two ends of the selected maize sequence. In one embodiment 1-9 genic regions are located within 10, 20, 30 or 40 Kb of contiguous genomic sequence flanking the two ends of the selected maize sequence. In one embodiment two or more genic regions are located within a 20, 30 or 40 Kb genomic sequence comprising the selected maize sequence. In one embodiment 1-9 genic regions are located within a 40 Kb genomic sequence comprising the selected maize sequence. In one embodiment the genic region located within a 10, 20, 30 or 40 Kb of contiguous genomic sequence flanking the selected maize sequence comprises a known gene in the Zea mays genome.

In accordance with one embodiment a modified nongenic maize genomic loci is provided wherein the loci is at least 1 KB in length, is nongenic, comprises no methylated cytosine residues, has a recombination frequency of greater than 0.00041 cM/Mb over a 1 Mb genomic region encompassing the maize genomic loci and a 1 Kb sequence of the maize genomic loci shares less than 40% sequence identity with any other 1 Kb sequence contained in the maize genome, wherein the nongenic maize genomic loci is modified by the insertion of a DNA of interest into the nongenic maize genomic loci.

In accordance with one embodiment a method for identifying optimal nongenic maize genomic loci is provided. In some embodiments, the method first comprises screening the maize genome to create a first pool of selected maize sequences that have a minimal length of 1 Kb and are hypomethylated, optionally wherein the genomic sequence has less than 1% methylation or wherein the genomic sequence is devoid of any methylated cytosine residues. This first pool of selected maize sequences can be further screened to eliminate loci that do not meet the requirements for optimal nongenic maize genomic loci. Maize genomic sequences that encode maize transcripts, share greater than 40% or higher sequence identity with another sequence of similar length, do not exhibit evidence of recombination, and do not have a known open reading frame within 40 Kb of the selected maize sequence, are eliminated from the first pool of sequences, leaving a second pool of sequences that qualify as optimal nongenic maize loci. In one embodiment any selected maize sequences that do not have a known maize gene, or a sequence comprising a 2 Kb upstream and/or 1 Kb downstream region of a known maize gene, within 40 Kb of one end of said nongenic sequence are eliminated from the first pool of sequences. In one embodiment any selected maize sequences that do not contain a known gene that expresses a protein within 40 Kb of the selected maize sequence are eliminated. In one embodiment any selected maize sequences that do not have a recombination frequency of greater than 0.00041 cM/Mb are eliminated.

Using these selection criteria applicants have identified select optimal genomic loci of *Zea mays* that serve as optimal nongenic maize genomic loci, the sequences of which are disclosed as SEQ ID NO: 1-SEQ ID NO: 5,286. The present disclosure also encompasses natural variants or modified derivatives of the identified optimal nongenic maize genomic loci wherein the variant or derivative loci comprise a sequence that differs from any sequence of SEQ ID NO: 1-SEQ ID NO: 5,286 by 1, 2, 3, 4, 5, 6, 7, 8, 9 or 10 nucleotides. In one embodiment optimal nongenic maize genomic loci for use in accordance with the present disclosure comprise sequences selected from SEQ ID NO: 1-SEQ ID NO: 5,286 or sequences that share 90%, 91%, 92%, 93%, 94%, 95%, 96%, 97%, 98% or 99% sequence identity with a sequence selected from SEQ ID NO: 1-SEQ ID NO: 5,286.

In another embodiment, optimal nongenic maize genomic loci for use in accordance with the present disclosure comprise sequences selected from any variety of maize or corn plants. In a further embodiment optimal nongenic maize genomic loci for use in accordance with the present disclosure comprise sequences selected from yellow corn inbreds. Accordingly, a yellow corn inbred includes dent or flint yellow corn inbred plants, including agronomically elite varieties thereof. In a subsequent embodiment, optimal nongenic maize genomic loci for use in accordance with the present disclosure comprise sequences selected from transformable corn lines. In an embodiment, representative transformable corn lines include; Hi-II, B73, B104, Mo 17, W22, A188, H99, and derivatives thereof. One of skill in the art will appreciate that as a result of phylogenetic divergence, various types of corn lines do not contain identical genomic DNA sequences, and that polymorphisms or allelic variation may be present within genomic sequences. In an embodiment, the present disclosure encompasses such polymorphism or allelic variations of the identified optimal nongenic maize genomic loci wherein the polymorphisms or allelic variation comprise a sequence that differs from any sequence of SEQ ID NO: 1-SEQ ID NO: 5,286 by 1, 2, 3, 4, 5, 6, 7, 8, 9 or 10 nucleotides. In a further embodiment, the present disclosure encompasses such polymorphisms or allelic variations of the identified optimal nongenic maize genomic loci wherein the polymorphisms or allelic variations comprise a sequence that shares 90%, 91%, 92%, 93%, 94%, 95%, 96%, 97%, 98% or 99% sequence identity with any sequence of SEQ ID NO: 1-SEQ ID NO: 5,286.

The identified optimal genomic loci comprising 5,286 individual sequences can be categorized into various sub-groupings by further analysis using a multivariate analysis method. Application of any multivariate analysis statistical programs is used to uncover the latent structure (dimensions) of a set of variables. A number of different types of multivariate algorithms can be used, for example the data set can be analyzed using multiple regression analysis, logistic regression analysis, discriminate analysis, multivariate analysis of variance (MANOVA), factor analysis (including both common factor analysis, and principal component analysis), cluster analysis, multidimensional scaling, correspondence analysis, conjoint analysis, canonical analysis, canonical correlation, and structural equation modeling.

In accordance with one embodiment the optimal nongenic maize genomic loci are further analyzed using multivariate data analysis such as Principal Component Analysis (PCA). Only a brief description will be given here, more information can be found in H. Martens, T. Naes, Multivariate Calibration, Wiley, N.Y., 1989. PCA evaluates the underlying dimensionality (latent variables) of the data, and gives an overview of the dominant patterns and major trends in the data. In one embodiment, the optimal nongenic maize genomic loci can be sorted into clusters via a principal component analysis (PCA) statistical method. The PCA is a mathematical procedure that uses an orthogonal transformation to convert a set of observations of possibly correlated variables into a set of values of linearly uncorrelated variables called principal components. The number of principal components is less than or equal to the number of original variables. This transformation is defined in such a way that the first principal component has the largest possible variance (that is, accounts for as much of the variability in the data as possible), and each succeeding component in turn has the highest variance possible under the constraint that it be orthogonal to (i.e., uncorrelated with) the preceding components. Principal components are guaranteed to be independent if the data set is jointly normally distributed. PCA is sensitive to the relative scaling of the original variables. Examples of the use of PCA to cluster a set of entities based on features of the entities include; Ciampitti, I. et al., (2012) Crop Science, 52(6); 2728-2742, Chemometrics: A Practical Guide, Kenneth R. Beebe, Randy J. Pell, and Mary Beth Seasholtz, Wiley-Interscience, 1 edition, 1998, U.S. Pat. No. 8,385,662, and European Patent No. 2,340,975.

In accordance with one embodiment a principal component analysis (PCA) was conducted on the 5,286 optimal maize genomic loci using the following 10 features for each identified optimal maize genomic loci:

1. Length of the hypo-methylated region around the optimal genomic loci (OGL)
    a. Genome wide methylation profiles for root and shoot tissues were established using Illumina/Solexa 1G parallel sequencing data after digesting genomic DNA with a methylation-sensitive restriction enzyme (Wang et al., (2009) Genome-Wide and Organ-Specific Landscapes of Epigenetic Modifications and Their Relationships to mRNA and Small RNA Transcriptomes in Maize. *Plant Cell* 21(4): 1053-1069). Sequences mapping to the genome indicated the presence of DNA methylation at the mapped locations and chromosomal stretches without mapped sequences indicated an absence of methylation (hypo-methylation). The length of the hypo-methylated region around each of the OGLs was calculated using the described methylation profiles.
2. Rate of Recombination in a 1 MB region around the OGL
    a. For each OGL, a pair of markers on either side of the OGL, within a 1 Mb window, was identified. Recombination frequencies between each pairs of markers across the chromosome were calculated based on the ratio of the genetic distance between markers (in centimorgan (cM)) to the genomic physical distance between the markers (in Mb).
3. Level of OGL sequence uniqueness
    a. For each OGL, the nucleotide sequence of the OGL was scanned against the *Zea mays* c.v. B73 genome using a BLAST based homology search. As these OGL sequences are identified from the *Zea mays* c.v. B73 genome, the first BLAST hit identified through this search represents the OGL sequence itself. The second BLAST hit for each OGL was identified and the alignment coverage of the hit was used as a measure of uniqueness of the OGL sequence within the *Zea mays* genome.
4. Distance from the OGL to the closest gene in its neighborhood
    a. Gene annotation information and the location of known genes in the *Zea mays* c.v. B73 genome were extracted from Maize Genome DB (www.maizegdb.org). For each OGL, the closest annotated gene in its upstream or downstream neighborhood was identified and the distance between the OGL sequence and the gene was measured (in bp).
5. GC % in the OGL neighborhood
    a. For each OGL, the nucleotide sequence was analyzed to estimate the number of
    Guanine and Cytosine bases present. This count was represented as a percentage of the sequence length of each OGL and provides a measure for GC %.
6. Number of genes in a 40 Kb neighborhood around the OGL
    a. Gene annotation information and the location of known genes in the *Zea mays* c.v. B73 genome were extracted from Maize Genome DB (www.maizegdb.org). For each OGL, a 40 Kb window around the OGL was defined and the number of annotated genes with locations overlapping this window was counted.
7. Average gene expression in a 40 Kb neighborhood around the OGL.
    a. Transcript level expression of Maize genes was measured by analyzing transcriptome profiling data generated from *Zea mays* c.v. B73 root and shoot tissues using RNAseq technology. For each OGL, annotated genes within the *Zea mays* c.v. B73 genome that were present in a 40 Kb neighborhood around the OGL were identified. Expression levels for each of the genes in the window were extracted from the transcriptome profiles and an average gene expression level was calculated.
8. Level of Nucleosome occupancy around the OGL
    a. Discerning the level of nucleosome occupancy for a particular nucleotide sequence provides information about chromosomal functions and the genomic context of the sequence. The NuPoP™ statistical package provides a user-friendly software tool for predicting the nucleosome occupancy and the most probable nucleosome positioning map for genomic sequences of any size (Xi, L., Fondufe-Mittendor, Y., Xia, L., Flatow, J., Widom, J. and Wang, J.-P., Predicting nucleosome positioning using a duration Hidden Markov Model, BMC Bioinformatics, 2010, doi:10.1186/1471-2105-11-346). For each OGL, the nucleotide sequence was submitted to the NuPoP™ software and a nucleosome occupancy score was calculated.

9. Relative location within the chromosome (proximity to centromere)
   a. Information on position of the centromere in each of the Maize chromosomes and the lengths of the chromosome arms was extracted from Maize genome DB (www.maizegdb.org). For each OGL, the genomic distance from the OGLsequence to the centromere of the chromosome that it is located on, is measured (in bp). The relative location of a OGL within the chromosome is represented as the ratio of its genomic distance to the centromere relative to the length of the specific chromosomal arm that it lies on.

10. Number of OGLs in a 1 Mb region around the OGL
    a. For each OGL, a 1 Mb genomic window around the OGL location is defined and the number of OGLs, in the Maize 1 Kb OGL dataset, whose genomic locations overlap with this window is tallied.

The results or values for the score of the features and attributes of each optimal nongenicmaize genomic loci are further described in Table 3 of Example 2. The resulting dataset was used in the PCA statistical method to cluster the 5,286 identified optimal nongenic maize genomic loci into clusters. During the clustering process, after estimating the "p" principle components of the optimal genomic loci, the assignment of the optimal genomic loci to one of the 32 clusters proceeded in the "p" dimensional Euclidean space. Each of the "p" axes was divided into "k" intervals. Optimal genomic loci assigned to the same interval were grouped together to form clusters. Using this analysis, each PCA axis was divided into two intervals, which was chosen based on a priori information regarding the number of clusters required for experimental validation. All analysis and the visualization of the resulting clusters were carried out with the Molecular Operating Environment™ (MOE) software from Chemical Computing Group Inc. (Montreal, Quebec, Canada). The PCA approach was used to cluster the set of 5,286 optimal maize genomic loci into 32 distinct clusters based on their feature values, described above.

Figure 3:
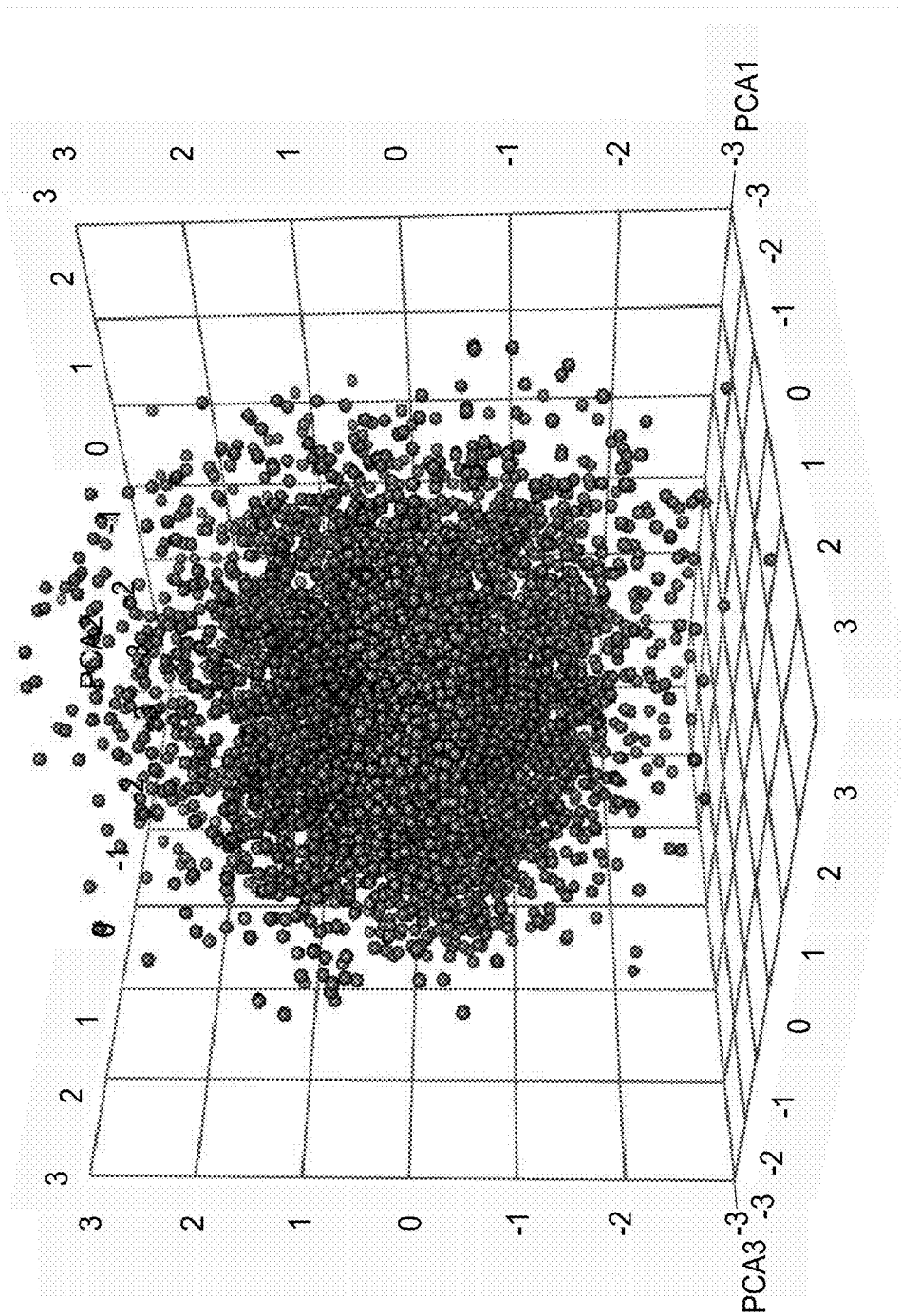
FIG. 3. Represents a three dimensional graph of the 5,286 optimal maize loci. The Principal Component Analysis (PCA) statistical approach was used to cluster the set of 5,286 identified optimal genomic loci into 32 distinct clusters based on their feature values (see Example 1). During the PCA process, five principal components (PC) were generated, with the top three PCs containing about 90% of the total variation in the dataset. These top three PCAs were used to graphically represent the 32 clusters in a three dimensional plot as shown in FIG. 3.
Figure 4:
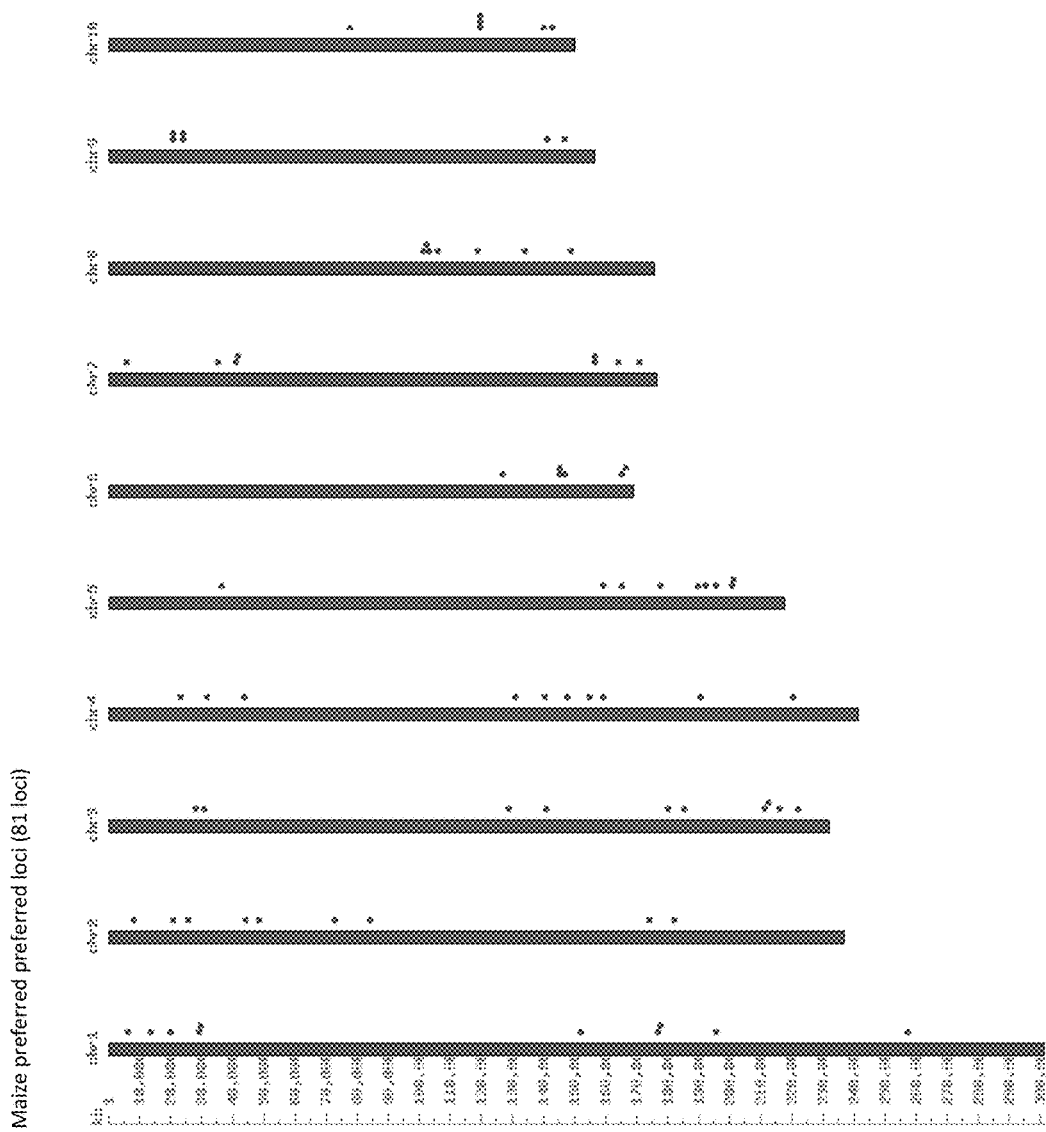
FIG. 4. Provides a schematic drawing indicating the chromosomal distribution of the 81 optimal genomic loci, and their relative positions on the maize chromosomes.

During the PCA process, five principal components (PC) were generated, with the top three PCs containing about 90% of the total variation in the dataset (Table 4). These three PCs were used to graphically represent the 32 clusters in a three dimensional plot (see FIG. 3). After the clustering process, was completed, one representative optimal genomic loci was chosen from each cluster. This was performed by choosing a select optimal genomic locus, within each cluster, that was closest to the centroid of that cluster by computational methods (Table 4). The chromosomal locations of the 32 representative optimal genomic loci are uniformly distributed among the maize chromosomes as shown in FIG. 4.

In accordance with one embodiment a purified optimal nongenic sequence is provided wherein the purified sequence is at least 1 Kb in length and has at least 90, 95%, or 99% sequence identity with a nongenic sequence selected from any sequence described in Table 15 of Example 8. In one embodiment the optimal nongenic maize genomic loci to be modified is a genomic sequence selected from loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), and loci_232228_G1 (SEQ ID NO: 4529). In one embodiment the purified sequence is at least 1 Kb in length and has at least 90%, 95%, or 99% sequence identity with a sequence present in a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), and loci_232228_G1 (SEQ ID NO: 4529). In one embodiment a purified sequence is provided that is at least 1 Kb in length and has at least 90%, 95%, or 99% sequence identity with a sequence present in a nongenic sequence selected from the group consisting of optimal_loci_204637 (SEQ ID NO:2731), optimal_loci_136086 (SEQ ID NO:4425), optimal_loci_232484 (SEQ ID NO:2053), optimal_loci_203075 (SEQ ID NO:2030), optimal_loci_3733 (SEQ ID NO:1268), optimal_loci_168286 (SEQ ID NO:573), optimal_loci_128078 (SEQ ID NO:560), optimal_loci_265551 (SEQ ID NO:463), optimal_loci_127268 (SEQ ID NO:2709), optimal_loci_204726 (SEQ ID NO:424), and optimal_loci_232222 (SEQ ID NO:3357). In one embodiment a purified sequence is provided that is at least 1 Kb in length and has at least 90%, 95%, or 99% sequence identity with a sequence present in a nongenic sequence selected from the group consisting of optimal loci_204637 (SEQ ID NO:2731), optimal_loci_136086 (SEQ ID NO:4425), optimal_loci_232484 (SEQ ID NO:2053), optimal_loci_203075 (SEQ ID NO:2030), optimal_loci_3733 (SEQ ID NO:1268), optimal_loci_168286 (SEQ ID NO:573), optimal_loci_128078 (SEQ ID NO:560) and optimal_loci_265551 (SEQ ID NO:463). In one embodiment a purified sequence is provided that is at least 1 Kb in length and has at least 90%, 95%, or 99% sequence identity with a sequence present in a nongenic sequence selected from the group consisting of optimal loci_204637 (SEQ ID NO:2731), optimal_loci_203075 (SEQ ID NO:2030) and optimal_loci_128078 (SEQ ID NO:560).

In one embodiment a purified sequence is provided comprising a 1 Kb sequence identical to a sequence present in a nongenic sequence selected from the group consisting of optimal loci_ 204637 (SEQ ID NO:2731), optimal_loci_136086 (SEQ ID NO:4425), optimal_loci_232484 (SEQ ID NO:2053), optimal_loci_203075 (SEQ ID NO:2030), optimal_loci_3733 (SEQ ID NO:1268), optimal_loci_168286 (SEQ ID NO:573), optimal_loci_128078 (SEQ ID NO:560) and optimal_loci_265551 (SEQ ID NO:463). In one embodiment a purified sequence is provided comprising a 1 Kb sequence identical to a sequence present in a nongenic sequence selected from the group consisting of optimal loci_204637 (SEQ ID NO:2731), optimal_loci_203075 (SEQ ID NO:2030) and optimal_loci_128078 (SEQ ID NO:560).

In an embodiment, the subject disclosure relates to a recombinant sequence, comprising: a nucleic acid sequence of at least 1 Kb and having at least 90%, 95%, or 99% sequence identity with a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), and loci_204637_G1 (SEQ ID NO:2731), with a DNA of interest inserted into the nongenic sequence.

In accordance with one embodiment a modified optimal nongenic maize genomic loci is provided wherein the optimal nongenic maize genomic loci has been modified to comprise one or more nucleotide substitutions, deletions or insertions. In one embodiment the optimal nongenic maize genomic loci is modified by the insertion of a DNA of interest optionally accompanied with further nucleotide duplications, deletions or inversions of genomic loci sequence.

In an embodiment the optimal nongenic maize genomic loci to be modified is a genomic sequence selected from any sequence described in Table 15 of Example 8. In one embodiment the optimal nongenic maize genomic loci to be modified is a genomic sequence selected from loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), and loci_232228_G1 (SEQ ID NO: 4529). In one embodiment the optimal nongenic maize genomic loci to be modified is a genomic sequence from loci_137693_G1 (SEQ ID NO:387). In one embodiment the optimal nongenic maize genomic loci to be modified is a genomic sequence from loci_265551_G1 (SEQ ID NO:463). In one embodiment the optimal nongenic maize genomic loci to be modified is a genomic sequence from loci_128078_G1 (SEQ ID NO:560). In one embodiment the optimal nongenic maize genomic loci to be modified is a genomic sequence from loci_168286_G1 (SEQ ID NO:573). In one embodiment the optimal nongenic maize genomic loci to be modified is a genomic sequence from loci_3733_G1 (SEQ ID NO:1268). In one embodiment the optimal nongenic maize genomic loci to be modified is a genomic sequence from loci_203075_G1 (SEQ ID NO:2030). In one embodiment the optimal nongenic maize genomic loci to be modified is a genomic sequence from loci_232484_G1 (SEQ ID NO:2053). In one embodiment the optimal nongenic maize genomic loci to be modified is a genomic sequence from loci_136086_G1 (SEQ ID NO:4425). In one embodiment the optimal nongenic maize genomic loci to be modified is a genomic sequence from loci_203704_G1 (SEQ ID NO:2033). In one embodiment the optimal nongenic maize genomic loci to be modified is a genomic sequence from loci_127268_G1 (SEQ ID NO:2709). In one embodiment the optimal nongenic maize genomic loci to be modified is a genomic sequence s from loci_204637_G1 (SEQ ID NO:2731). In one embodiment the optimal nongenic maize genomic loci to be modified is a genomic sequence from loci_291068_G1 (SEQ ID NO:3230). In one embodiment the optimal nongenic maize genomic loci to be modified is a genomic sequence from loci_232222_G1 (SEQ ID NO:3357). In one embodiment the optimal nongenic maize genomic loci to be modified is a genomic sequence from loci_43577_G1 (SEQ ID NO:3428). In one embodiment the optimal nongenic maize genomic loci to be modified is a genomic sequence from loci_204726_G1 (SEQ ID NO:424). In one embodiment the optimal nongenic maize genomic loci to be modified is a genomic sequence from loci_232228_G1 (SEQ ID NO: 4529).

In a further embodiment the optimal nongenic maize genomic loci to be modified is a genomic sequence selected from loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), and loci_203704_G1 (SEQ ID NO:2033). In a further embodiment the optimal nongenic maize genomic loci to be modified is a genomic sequence selected from loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), and loci_136086_G1 (SEQ ID NO:4425). In a further embodiment the optimal nongenic maize genomic loci to be modified is a genomic sequence selected from loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), and loci_232484_G1 (SEQ ID NO:2053). In a further embodiment the optimal nongenic maize genomic loci to be modified is a genomic sequence selected from loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), and loci_203075_G1 (SEQ ID NO:2030). In a further embodiment the optimal nongenic maize genomic loci to be modified is a genomic sequence selected from loci_137693_G1 (SEQ ID NO:387), loci_265551_G1 (SEQ ID NO:463), loci_128078_G1 (SEQ ID NO:560), loci_168286_G1 (SEQ ID NO:573), and loci_3733_G1 (SEQ ID NO:1268). In a further embodiment the optimal nongenic maize genomic loci to be modified is a genomic sequence selected from loci_137693_G1 (SEQ ID NO:387), loci_265551_G1 (SEQ ID NO:463), loci_128078_G1 (SEQ ID NO:560), and loci_168286_G1 (SEQ ID NO:573). In a further embodiment the optimal nongenic maize genomic loci to be modified is a genomic sequence selected from loci_137693_G1 (SEQ ID NO:387), loci_265551_G1 (SEQ ID NO:463), and loci_128078_G1 (SEQ ID NO:560). In a further embodiment the optimal nongenic maize genomic loci to be modified is a genomic sequence selected from loci_137693_G1 (SEQ ID NO:387), and loci_265551_G1 (SEQ ID NO:463).

In a further embodiment the optimal nongenic maize genomic loci to be modified is a genomic sequence selected from loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), and loci_232228_G1 (SEQ ID NO: 4529). In a further embodiment the optimal nongenic maize genomic loci to be modified is a genomic sequence selected from loci_127268_G1

(SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), and loci_204726_G1 (SEQ ID NO:424). In a further embodiment the optimal nongenic maize genomic loci to be modified is a genomic sequence selected from loci_127268_G1 (SEQ ID NO:2709), loci_204637_G1 (SEQ ID NO:2731), loci_291068_G1 (SEQ ID NO:3230), loci_232222_G1 (SEQ ID NO:3357), and loci_43577_G1 (SEQ ID NO:3428). In a further embodiment the optimal nongenic maize genomic loci to be modified is a genomic sequence selected from loci_127268_G1 (SEQ ID NO:2709), loci_204637_G1 (SEQ ID NO:2731), loci_291068_G1 (SEQ ID NO:3230), and loci_232222_G1 (SEQ ID NO:3357). In a further embodiment the optimal nongenic maize genomic loci to be modified is a genomic sequence selected from loci_127268_G1 (SEQ ID NO:2709), loci_204637_G1 (SEQ ID NO:2731), and loci_291068_G1 (SEQ ID NO:3230). In a further embodiment the optimal nongenic maize genomic loci to be modified is a genomic sequence selected from loci_127268_G1 (SEQ ID NO:2709), and loci_204637_G1 (SEQ ID NO:2731).

In one embodiment the optimal nongenic maize genomic loci is selected from the genomic sequences of loci_59517_G1 (SEQ ID NO: 1), loci_159525_G1 (SEQ ID NO: 199), loci_9811_G1 (SEQ ID NO: 365), loci_7507_G1 (SEQ ID NO: 543), loci_178978_G1 (SEQ ID NO: 687), loci_285621_G1 (SEQ ID NO: 875), loci_221721_G1 (SEQ ID NO: 1089), loci_83937_G1 (SEQ ID NO: 1233), loci_37146_G1 (SEQ ID NO: 1369), loci_156393_G1 (SEQ ID NO: 1571), loci_343678_G1 (SEQ ID NO: 1795), loci_60209_G1 (SEQ ID NO: 1980), loci_282323_G1 (SEQ ID NO: 2171), loci_64542_G1 (SEQ ID NO: 2349), loci_162531_G1 (SEQ ID NO: 2557), loci_337001_G1 (SEQ ID NO: 2693), loci_66202_G1 (SEQ ID NO: 2855), loci_185454_G1 (SEQ ID NO: 3004), loci_239863_G1 (SEQ ID NO: 3151), loci_257541_G1 (SEQ ID NO: 3289), loci_217939_G1 (SEQ ID NO: 3455), loci_326869_G1 (SEQ ID NO: 3586), loci_31710_G1 (SEQ ID NO: 3731), loci_81941_G1 (SEQ ID NO: 3849), loci_198387_G1 (SEQ ID NO: 3981), loci_197372_G1 (SEQ ID NO: 4192), loci_106202_G1 (SEQ ID NO: 4401), loci_232228_G1 (SEQ ID NO: 4529), loci_244324_G1 (SEQ ID NO: 4646), loci_157315_G1 (SEQ ID NO: 4836), loci_137489_G1 (SEQ ID NO: 5046), and loci_31764_G1 (SEQ ID NO: 5162).

In one embodiment the optimal nongenic maize genomic loci is selected from the genomic sequences of loci_59517_G1 (SEQ ID NO: 1), loci_25001_G1 (SEQ ID NO: 100), loci_112632_G1 (SEQ ID NO: 203), loci_28905_G1 (SEQ ID NO: 295), loci_129164_G1 (SEQ ID NO: 384), loci_204726_G1 (SEQ ID NO: 424), loci_2425_G1 (SEQ ID NO: 451), loci_122036_G1 (SEQ ID NO: 547), loci_5735_G1 (SEQ ID NO: 671), loci_178978_G1 (SEQ ID NO: 687), loci_288388_G1 (SEQ ID NO: 781), loci_60310_G1 (SEQ ID NO: 843), loci_285621_G1 (SEQ ID NO: 875), loci_243330_G1 (SEQ ID NO: 967), loci_127038_G1 (SEQ ID NO: 1107), loci_262784_G1 (SEQ ID NO: 1147), loci_344662_G1 (SEQ ID NO: 1190), loci_153894_G1 (SEQ ID NO: 1252), loci_28771_G1 (SEQ ID NO: 1300), loci_1098_G1 (SEQ ID NO: 1371), loci_97772_G1 (SEQ ID NO: 1569), loci_156393_G1 (SEQ ID NO: 1571), loci_236662_G1 (SEQ ID NO: 1663), loci_139485_G1 (SEQ ID NO: 1822), loci_301175_G1 (SEQ ID NO: 1906), loci_152337_G1 (SEQ ID NO: 2003), loci_202616_G1 (SEQ ID NO: 2027), loci_203704_G1 (SEQ ID NO: 2033), loci_282323_G1 (SEQ ID NO: 2171), loci_262782_G1 (SEQ ID NO: 2256), loci_64542_G1 (SEQ ID NO: 2349), loci_236455_G1 (SEQ ID NO: 2428), loci_162531_G1 (SEQ ID NO: 2557), loci_301774_G1 (SEQ ID NO: 2632), loci_344663_G1 (SEQ ID NO: 2649), loci_337001_G1 (SEQ ID NO: 2693), loci_204637_G1 (SEQ ID NO: 2731), loci_238100_G1 (SEQ ID NO: 2753), loci_66202_G1 (SEQ ID NO: 2855), loci_264359_G1 (SEQ ID NO: 2934), loci_282653_G1 (SEQ ID NO: 3086), loci_80282_G1 (SEQ ID NO: 3139), loci_291068_G1 (SEQ ID NO: 3230), loci_56395_G1 (SEQ ID NO: 3270), loci_200497_G1 (SEQ ID NO: 3334), loci_232222_G1 (SEQ ID NO: 3357), loci_43577_G1 (SEQ ID NO: 3428), loci_5607_G1 (SEQ ID NO: 3435), loci_114664_G1 (SEQ ID NO: 3457), loci_228254_G1 (SEQ ID NO: 3497), loci_120993_G1 (SEQ ID NO: 3593), loci_53137_G1 (SEQ ID NO: 3702), loci_31710_G1 (SEQ ID NO: 3731), loci_344664_G1 (SEQ ID NO: 3815), loci_81941_G1 (SEQ ID NO: 3849), loci_321514_G1 (SEQ ID NO: 3939), loci_198387_G1 (SEQ ID NO: 3981), loci_301180_G1 (SEQ ID NO: 4113), loci_197372_G1 (SEQ ID NO: 4192), loci_348776_G1 (SEQ ID NO: 4350), loci_244439_G1 (SEQ ID NO: 4458), loci_348258_G1 (SEQ ID NO: 4487), loci_232228_G1 (SEQ ID NO: 4529), loci_322501_G1 (SEQ ID NO: 4610), loci_244324_G1 (SEQ ID NO: 4646), loci_97232_G1 (SEQ ID NO: 4832), loci_157315_G1 (SEQ ID NO: 4836), loci_282499_G1 (SEQ ID NO: 4953), loci_155031_G1 (SEQ ID NO: 5060), loci_301773_G1 (SEQ ID NO: 5110), loci_283161_G1 (SEQ ID NO:5213), loci_55524_G1 (SEQ ID NO: 5264), loci_127268_G1 (SEQ ID NO: 2709), loci_136086_G1 (SEQ ID NO: 4425), loci_232484_G1 (SEQ ID NO: 2053), loci_3733_G1 (SEQ ID NO: 1923), loci_168286_G1 (SEQ ID NO: 573), loci_128078_G1 (SEQ ID NO: 560), loci_265551_G1 (SEQ ID NO: 463), and loci_137693_G1 (SEQ ID NO:387).

In one embodiment the optimal nongenic maize genomic loci is targeted with a DNA of interest, wherein the DNA of interest integrates within or proximal to the zinc finger nuclease target sites. In accordance with an embodiment, exemplary zinc finger target sites of optimal maize select genomic loci are provided in Table 8. In accordance with an embodiment, integration of a DNA of interest occurs within or proximal to the exemplary target sites of: 111879ZFN5 and 111879ZFN7; 111885ZFN1 and 111885ZFN2; SIG115737_31v1 and SIG115737_32v1; SIG120523_11v1 and SIG120523_12v1; SIG115246_5 and SIG115246_6; SIG115636_1v1 and SIG115636_2v1; SIG120417_11v1 and SIG120417_12v1; SIG120621_15v1 and SIG120621_16v1; SIG12078_11v1 and SIG12078_12v1; and, SIG157315_1v1 and SIG157315_2v1, ZFN_binding_1 and ZFN_binding_2, ZFN_binding_3 and ZFN_binding_4, ZFN_binding_5 and ZFN_binding_6, ZFN_binding_7 and ZFN_binding_8, ZFN_binding_9 and ZFN_binding_10, ZFN_binding_11 and ZFN_binding_12, ZFN_binding_13 and ZFN_binding_14, ZFN_binding_15 and ZFN_binding_16, ZFN_binding_17 and ZFN_binding_18, ZFN_binding_19 and ZFN_binding_20, ZFN_binding_21 and ZFN_binding_22, ZFN_binding_23 and ZFN_binding_24, ZFN_binding_25 and ZFN_binding_26, ZFN_binding_27 and ZFN_binding_28, ZFN_binding_29 and ZFN_binding_30, ZFN_binding_31 and ZFN_binding_32, ZFN_binding_33 and ZFN_binding_34, ZFN_binding_35 and ZFN_binding_36, ZFN_binding_37 and ZFN_binding_38, ZFN_binding_39 and ZFN_binding_40, ZFN_binding_41 and ZFN_binding_42, ZFN_binding_43 and ZFN_binding_44, ZFN_binding_45 and ZFN_binding_46, ZFN_binding_47 and ZFN_binding_48, ZFN_binding_49 and ZFN_binding_50, ZFN_binding_51 and ZFN_binding_52, ZFN_binding_53 and ZFN_binding_54, ZFN_binding_55 and ZFN_binding_56, ZFN_binding_57 and ZFN_binding_58, ZFN_binding_59 and ZFN_binding_60, ZFN_binding_61 and ZFN_binding_62, ZFN_binding_63 and ZFN_binding_64, ZFN_binding_65 and ZFN_binding_66, ZFN_binding_67 and ZFN_binding_68, ZFN_binding_69 and ZFN_binding_70, ZFN_binding_71 and ZFN_binding_72, ZFN_binding_73 and ZFN_binding_74, ZFN_binding_75 and ZFN_binding_76, ZFN_binding_77 and ZFN_binding_78, ZFN_binding_79 and ZFN_binding_80, ZFN_binding_81 and ZFN_binding_82, ZFN_binding_83 and ZFN_binding_84, ZFN_binding_85 and ZFN_binding_86, ZFN_binding_87 and ZFN_binding_88, ZFN_binding_89 and ZFN_binding_90, ZFN_binding_91 and ZFN_binding_92, ZFN_binding_93 and ZFN_binding_94, ZFN_binding_95 and ZFN_binding_96, ZFN_binding_97 and ZFN_binding_98, ZFN_binding_99 and ZFN_binding_100, ZFN_binding_101 and ZFN_binding_102, ZFN_binding_103 and ZFN_binding_104, ZFN_binding_105 and ZFN_binding_106, ZFN_binding_107 and ZFN_binding_108, ZFN_binding_109 and ZFN_binding_110, ZFN_binding_111 and ZFN_binding_112, ZFN_binding_113 and ZFN_binding_114, ZFN_binding_115 and ZFN_binding_116, ZFN_binding_117 and ZFN_binding_118, ZFN_binding_119 and ZFN_binding_120, ZFN_binding_121 and ZFN_binding_122, ZFN_binding_123 and ZFN_binding_124, ZFN_binding_125 and ZFN_binding_126, ZFN_binding_127 and ZFN_binding_128, ZFN_binding_129 and ZFN_binding_130, ZFN_binding_131 and ZFN_binding_132.

In accordance with an embodiment, the zinc finger nuclease binds to the zinc finger target site and cleaves the unique maize genomic polynucleotide target sites, whereupon the DNA of interest integrates within or proximal to the maize genomic polynucleotide target sites. In an embodiment, integration of the DNA of interest occurs within the zinc finger target site may result with rearrangements. In accordance with one embodiment, the rearrangements may comprise deletions, insertions, inversions, and repeats. In an embodiment, integration of the DNA of interest occurs proximal to the zinc finger target site. According to an aspect of the embodiment, the integration of the DNA is proximal to the zinc finger target site, and may integrate within 1.5 Kb, 1.25 Kb, 1.0 Kb, 0.75 Kb, 0.5 Kb, or 0.25 Kb to the zinc finger target site. Insertion within a genomic region proximal to the zinc finger target site is known in the art, see US Patent Pub No. 2010/0257638 A1 (herein incorporated by reference in its entirety).

In accordance with one embodiment the selected nongenic sequence comprises the following characteristics:

a) the nongenic sequence does not contain greater than 1% DNA methylation within the sequence;

b) the nongenic sequence has a relative location value from 0.0984 to 0.973 ratio of genomic distance from a maize chromosomal centromere;

c) the nongenic sequence has a guanine/cytosine percent content range of 34.38 to 61.2%; and, d) the nongenic sequence is from about 1 Kb to about 4.9 Kb in length.

II. Recombinant Derivatives of Identified Optimal Nongenic Maize Genomic Loci

In accordance with one embodiment, after having identified a genomic loci of *Zea mays* as a highly desirable location for inserting polynucleotide donor sequences, one or more nucleic acids of interest can be inserted into the identified genomic locus. In one embodiment the nucleic acid of interest comprises exogenous gene sequences or other desirable polynucleotide donor sequences. In another embodiment, after having identified a genomic loci of *Zea mays* as a highly desirable location for inserting polynucleotide donor sequences, one or more nucleic acids of interest of the optimal nongenic maize genomic loci can optionally be deleted, excised or removed with the subsequent integration of the DNA of interest into the identified genomic locus. In one embodiment the insertion of a nucleic acid of interest into the optimal nongenic maize genomic loci comprises removal, deletion, or excision of the exogenous gene sequences or other desirable polynucleotide donor sequences.

The present disclosure further relates to methods and compositions for targeted integration into the select *Zea mays* genomic locus using ZFNs and a polynucleotide donor construct. The methods for inserting a nucleic acid sequence of interest into the optimal nongenic maize genomic loci, unless otherwise indicated, use conventional techniques in molecular biology, biochemistry, chromatin structure and analysis, cell culture, recombinant DNA and related fields as are within the skill of the art. These techniques are fully explained in the literature. See, for example, Sambrook et al. MOLECULAR CLONING: A LABORATORY MANUAL, Second edition, Cold Spring Harbor Laboratory Press, 1989 and Third edition, 2001; Ausubel et al., CURRENT PROTOCOLS IN MOLECULAR BIOLOGY, John Wiley & Sons, New York, 1987 and periodic updates; the series METHODS IN ENZYMOLOGY, Academic Press, San Diego; Wolfe, CHROMATIN STRUCTURE AND FUNCTION, Third edition, Academic Press, San Diego, 1998; METHODS IN ENZYMOLOGY, Vol. 304, "Chromatin" (P. M. Wassarman and A. P. Wolffe, eds.), Academic Press, San Diego, 1999; and METHODS IN MOLECULAR BIOLOGY, Vol. 119, "Chromatin Protocols" (P. B. Becker, ed.) Humana Press, Totowa, 1999.

Methods for Nucleic Acid Insertion into the Maize Genome

Any of the well known procedures for introducing polynucleotide donor sequences and nuclease sequences as a DNA construct into host cells may be used in accordance with the present disclosure. These include the use of calcium phosphate transfection, polybrene, protoplast fusion, PEG, electroporation, ultrasonic methods (e.g., sonoporation), liposomes, microinjection, naked DNA, plasmid vectors, viral vectors, both episomal and integrative, and any of the other well known methods for introducing cloned genomic DNA, cDNA, synthetic DNA or other foreign genetic material into a host cell (see, e.g., Sambrook et al., supra). It is only necessary that the particular nucleic acid insertion procedure used be capable, of successfully introducing at least one gene into the host cell capable of expressing the protein of choice.

As noted above, DNA constructs may be introduced into the genome of a desired plant species by a variety of conventional techniques. For reviews of such techniques see, for example, Weissbach & Weissbach Methods for Plant Molecular Biology (1988, Academic Press, N.Y.) Section VIII, pp. 421-463; and Grierson & Corey, Plant Molecular Biology (1988, 2d Ed.), Blackie, London, Ch. 7-9. A DNA construct may be introduced directly into the genomic DNA of the plant cell using techniques such as electroporation and microinjection of plant cell protoplasts, by agitation with silicon carbide fibers (See, e.g., U.S. Pat. Nos. 5,302,523 and 5,464,765), or the DNA constructs can be introduced directly to plant tissue using biolistic methods, such as DNA particle bombardment (see, e.g., Klein et al. (1987) Nature 327:70-73). Alternatively, the DNA construct can be introduced into the plant cell via nanoparticle transformation (see, e.g., US Patent Publication No. 20090104700, which is incorporated herein by reference in its entirety). Alternatively, the DNA constructs may be combined with suitable T-DNA border/flanking regions and introduced into a conventional *Agrobacterium tumefaciens* host vector. *Agrobacterium tumefaciens*-mediated transformation techniques, including disarming and use of binary vectors, are well described in the scientific literature. See, for example Horsch et al. (1984) Science 233:496-498, and Fraley et al. (1983) Proc. Nat'l. Acad. Sci. USA 80:4803.

In addition, gene transfer may be achieved using non-*Agrobacterium* bacteria or viruses such as *Rhizobium* sp. NGR234, *Sinorhizoboium meliloti, Mesorhizobium loti*, potato virus X, cauliflower mosaic virus and cassava vein mosaic virus and/or tobacco mosaic virus, See, e.g., Chung et al. (2006) Trends Plant Sci. 11(1):1-4. The virulence functions of the *Agrobacterium tumefaciens* host will direct the insertion of a T-strand containing the construct and adjacent marker into the plant cell DNA when the cell is infected by the bacteria using binary T DNA vector (Bevan (1984) Nuc. Acid Res. 12:8711-8721) or the co-cultivation procedure (Horsch et al. (1985) Science 227:1229-1231). Generally, the *Agrobacterium* transformation system is used to engineer dicotyledonous plants (Bevan et al. (1982) Ann. Rev. Genet. 16:357-384; Rogers et al. (1986) Methods Enzymol. 118:627-641). The *Agrobacterium* transformation system may also be used to transform, as well as transfer, DNA to monocotyledonous plants and plant cells. See U.S. Pat. No. 5,591,616; Hernalsteen et al. (1984) EMBO J. 3:3039-3041; Hooykass-Van Slogteren et al. (1984) Nature 311:763-764; Grimsley et al. (1987) Nature 325:1677-179; Boulton et al. (1989) Plant Mol. Biol. 12:31-40; and Gould et al. (1991) Plant Physiol. 95:426-434.

Alternative gene transfer and transformation methods include, but are not limited to, protoplast transformation through calcium-, polyethylene glycol (PEG)- or electroporation-mediated uptake of naked DNA (see Paszkowski et al. (1984) EMBO J. 3:2717-2722, Potrykus et al. (1985) Molec. Gen. Genet. 199:169-177; Fromm et al. (1985) Proc. Nat. Acad. Sci. USA 82:5824-5828; and Shimamoto (1989) Nature 338:274-276) and electroporation of plant tissues (D'Halluin et al. (1992) Plant Cell 4:1495-1505). Additional methods for plant cell transformation include microinjection, silicon carbide mediated DNA uptake (Kaeppler et al. (1990) Plant Cell Reporter 9:415-418), and microprojectile bombardment (see Klein et al. (1988) Proc. Nat. Acad. Sci. USA 85:4305-4309; and Gordon-Kamm et al. (1990) Plant Cell 2:603-618).

In one embodiment a nucleic acid of interest introduced into a host cell for targeted insertion into the genome comprises homologous flanking sequences on one or both ends of the targeted nucleic acid of interest. In such an embodiment, the homologous flanking sequences contain sufficient levels of sequence identity to a maize genomic sequence to support homologous recombination between it and the genomic sequence to which it bears homology. Approximately 25, 50, 100, 200, 500, 750, 1000, 1500, or 2000 nucleotides, or more of sequence identity, ranging from 70% to 100%, between a donor and a genomic sequence (or any integral value between 10 and 200 nucleotides, or more) will support homologous recombination therebetween.

In another embodiment the targeted nucleic acid of interest lacks homologous flanking sequences, and the targeted nucleic acid of interest shares low to very low levels of sequence identity with a genomic sequence.

In other embodiments of targeted recombination and/or replacement and/or alteration of a sequence in a region of interest in cellular chromatin, a chromosomal sequence is altered by homologous recombination with an exogenous "donor" nucleotide sequence. Such homologous recombination is stimulated by the presence of a double-stranded break in cellular chromatin, if sequences homologous to the region of the break are present. Double-strand breaks in cellular chromatin can also stimulate cellular mechanisms of non-homologous end joining. In any of the methods described herein, the first nucleotide sequence (the "donor sequence") can contain sequences that are homologous, but not identical, to genomic sequences in the region of interest, thereby stimulating homologous recombination to insert a non-identical sequence in the region of interest. Thus, in certain embodiments, portions of the donor sequence that are homologous to sequences in the region of interest exhibit between about 80, 85, 90, 95, 97.5, to 99% (or any integer therebetween) sequence identity to the genomic sequence that is replaced. In other embodiments, the homology between the donor and genomic sequence is higher than 99%, for example if only 1 nucleotide differs as between donor and genomic sequences of over 100 contiguous base pairs.

In certain cases, a non-homologous portion of the donor sequence can contain sequences not present in the region of interest, such that new sequences are introduced into the region of interest. In these instances, the non-homologous sequence is generally flanked by sequences of 50 to 2,000 base pairs (or any integral value therebetween) or any number of base pairs greater than 2,000, that are homologous or identical to sequences in the region of interest. In other embodiments, the donor sequence is non-homologous to the region of interest, and is inserted into the genome by non-homologous recombination mechanisms.

In accordance with one embodiment a zinc finger nuclease (ZFN) is used to introduce a double strand break in a targeted genomic locus to facilitate the insertion of a nucleic acid of interest. Selection of a target site within the selected genomic locus for binding by a zinc finger domain can be accomplished, for example, according to the methods disclosed in U.S. Pat. No. 6,453,242, the disclosure of which is incorporated herein, that also discloses methods for designing zinc finger proteins (ZFPs) to bind to a selected sequence. It will be clear to those skilled in the art that simple visual inspection of a nucleotide sequence can also be used for selection of a target site. Accordingly, any means for target site selection can be used in the methods described herein.

For ZFP DNA-binding domains, target sites are generally composed of a plurality of adjacent target subsites. A target subsite refers to the sequence, usually either a nucleotide triplet or a nucleotide quadruplet which may overlap by one nucleotide with an adjacent quadruplet that is bound by an individual zinc finger. See, for example, WO 02/077227, the disclosure of which is incorporated herein. A target site generally has a length of at least 9 nucleotides and, accordingly, is bound by a zinc finger binding domain comprising at least three zinc fingers. However binding of, for example, a 4-finger binding domain to a 12-nucleotide target site, a 5-finger binding domain to a 15-nucleotide target site or a 6-finger binding domain to an 18-nucleotide target site, is also possible. As will be apparent, binding of larger binding domains (e.g., 7-, 8-, 9-finger and more) to longer target sites is also consistent with the subject disclosure.

In accordance with one embodiment, it is not necessary for a target site to be a multiple of three nucleotides. In cases in which cross-strand interactions occur (see, e.g., U.S. Pat. No. 6,453,242 and WO 02/077227), one or more of the individual zinc fingers of a multi-finger binding domain can bind to overlapping quadruplet subsites. As a result, a three-finger protein can bind a 10-nucleotide sequence, wherein the tenth nucleotide is part of a quadruplet bound by a terminal finger, a four-finger protein can bind a 13-nucleotide sequence, wherein the thirteenth nucleotide is part of a quadruplet bound by a terminal finger, etc.

The length and nature of amino acid linker sequences between individual zinc fingers in a multi-finger binding domain also affects binding to a target sequence. For example, the presence of a so-called "non-canonical linker," "long linker" or "structured linker" between adjacent zinc fingers in a multi-finger binding domain can allow those fingers to bind subsites which are not immediately adjacent. Non-limiting examples of such linkers are described, for example, in U.S. Pat. No. 6,479,626 and WO 01/53480. Accordingly, one or more subsites, in a target site for a zinc finger binding domain, can be separated from each other by 1, 2, 3, 4, 5 or more nucleotides. One nonlimiting example would be a four-finger binding domain that binds to a 13-nucleotide target site comprising, in sequence, two contiguous 3-nucleotide subsites, an intervening nucleotide, and two contiguous triplet subsites.

While DNA-binding polypeptides identified from proteins that exist in nature typically bind to a discrete nucleotide sequence or motif (e.g., a consensus recognition sequence), methods exist and are known in the art for modifying many such DNA-binding polypeptides to recognize a different nucleotide sequence or motif. DNA-binding polypeptides include, for example and without limitation: zinc finger DNA-binding domains; leucine zippers; UPA DNA-binding domains; GAL4; TAL; LexA; a Tet repressor; LacR; and a steroid hormone receptor.

In some examples, a DNA-binding polypeptide is a zinc finger. Individual zinc finger motifs can be designed to target and bind specifically to any of a large range of DNA sites. Canonical $Cys_2His_2$ (as well as non-canonical $Cys_3His$) zinc finger polypeptides bind DNA by inserting an α-helix into the major groove of the target DNA double helix. Recognition of DNA by a zinc finger is modular; each finger contacts primarily three consecutive base pairs in the target, and a few key residues in the polypeptide mediate recognition. By including multiple zinc finger DNA-binding domains in a targeting endonuclease, the DNA-binding specificity of the targeting endonuclease may be further increased (and hence the specificity of any gene regulatory effects conferred thereby may also be increased). See, e.g., Urnov et al. (2005) Nature 435:646-51. Thus, one or more zinc finger DNA-binding polypeptides may be engineered and utilized such that a targeting endonuclease introduced into a host cell interacts with a DNA sequence that is unique within the genome of the host cell. Preferably, the zinc finger protein is non-naturally occurring in that it is engineered to bind to a target site of choice. See, for example, Beerli et al. (2002) Nature Biotechnol. 20:135-141; Pabo et al. (2001) Ann. Rev. Biochem. 70:313-340; Isalan et al. (2001) Nature Biotechnol. 19:656-660; Segal et al. (2001) Curr. Opin. Biotechnol. 12:632-637; Choo et al. (2000) Curr. Opin. Struct. Biol. 10:411-416; U.S. Pat. Nos. 6,453,242; 6,534,261; 6,599,692; 6,503,717; 6,689,558; 7,030,215; 6,794,136; 7,067,317; 7,262,054; 7,070,934; 7,361,635; 7,253,273; and U.S. Patent Publication Nos. 2005/0064474; 2007/0218528; 2005/0267061, all incorporated herein by reference in their entireties.

An engineered zinc finger binding domain can have a novel binding specificity, compared to a naturally-occurring zinc finger protein. Engineering methods include, but are not limited to, rational design and various types of selection. Rational design includes, for example, using databases comprising triplet (or quadruplet) nucleotide sequences and individual zinc finger amino acid sequences, in which each triplet or quadruplet nucleotide sequence is associated with one or more amino acid sequences of zinc fingers which bind the particular triplet or quadruplet sequence. See, for example, co-owned U.S. Pat. Nos. 6,453,242 and 6,534,261, incorporated by reference herein in their entireties.

Alternatively, the DNA-binding domain may be derived from a nuclease. For example, the recognition sequences of homing endonucleases and meganucleases such as I-SceI, I-CeuI, PI-PspI, PI-Sce, I-SceIV, I-CsmI, I-PanI, I-SceII, I-PpoI, I-SceIII, I-CreI, I-TevI, I-TevII and I-TevIII are known. See also U.S. Pat. No. 5,420,032; U.S. Pat. No. 6,833,252; Belfort et al. (1997) Nucleic Acids Res. 25:3379-3388; Dujon et al. (1989) Gene 82:115-118; Perler et al. (1994) Nucleic Acids Res. 22, 1125-1127; Jasin (1996) Trends Genet. 12:224-228; Gimble et al. (1996) J. Mol. Biol. 263:163-180; Argast et al. (1998) J. Mol. Biol. 280:345-353 and the New England Biolabs catalogue. In addition, the DNA-binding specificity of homing endonucleases and meganucleases can be engineered to bind non-natural target sites. See, for example, Chevalier et al. (2002) Molec. Cell 10:895-905; Epinat et al. (2003) Nucleic Acids Res. 31:2952-2962; Ashworth et al. (2006) Nature 441:656-659; Paques et al. (2007) Current Gene Therapy 7:49-66; U.S. Patent Publication No. 20070117128.

As another alternative, the DNA-binding domain may be derived from a leucine zipper protein. Leucine zippers are a class of proteins that are involved in protein-protein interactions in many eukaryotic regulatory proteins that are important transcription factors associated with gene expression. The leucine zipper refers to a common structural motif shared in these transcriptional factors across several kingdoms including animals, plants, yeasts, etc. The leucine zipper is formed by two polypeptides (homodimer or heterodimer) that bind to specific DNA sequences in a manner where the leucine residues are evenly spaced through an α-helix, such that the leucine residues of the two polypeptides end up on the same face of the helix. The DNA binding specificity of leucine zippers can be utilized in the DNA-binding domains disclosed herein.

In some embodiments, the DNA-binding domain is an engineered domain from a TAL effector derived from the plant pathogen *Xanthomonas* (see, Miller et al. (2011) Nature Biotechnology 29(2):143-8; Boch et al, (2009) Science 29 Oct. 2009 (10.1126/science.117881) and Moscou and Bogdanove, (2009) Science 29 Oct. 2009 (10.1126/science.1178817; and U.S. Patent Publication Nos. 20110239315, 20110145940 and 20110301073).

The CRISPR (Clustered Regularly Interspaced Short Palindromic Repeats)/Cas (CRISPR Associated) nuclease system is a recently engineered nuclease system based on a bacterial system that can be used for genome engineering. It is based on part of the adaptive immune response of many bacteria and Archea. When a virus or plasmid invades a bacterium, segments of the invader's DNA are converted into CRISPR RNAs (crRNA) by the 'immune' response. This crRNA then associates, through a region of partial complementarity, with another type of RNA called tracr- RNA to guide the Cas9 nuclease to a region homologous to the crRNA in the target DNA called a "protospacer". Cas9 cleaves the DNA to generate blunt ends at the DSB at sites specified by a 20-nucleotide guide sequence contained within the crRNA transcript. Cas9 requires both the crRNA and the tracrRNA for site specific DNA recognition and cleavage. This system has now been engineered such that the crRNA and tracrRNA can be combined into one molecule (the "single guide RNA"), and the crRNA equivalent portion of the single guide RNA can be engineered to guide the Cas9 nuclease to target any desired sequence (see Jinek et al (2012) Science 337, p. 816-821, Jinek et al, (2013), eLife 2:e00471, and David Segal, (2013) eLife 2:e00563). Thus, the CRISPR/Cas system can be engineered to create a double-stranded break (DSB) at a desired target in a genome, and repair of the DSB can be influenced by the use of repair inhibitors to cause an increase in error prone repair.

In certain embodiments, Cas protein may be a "functional derivative" of a naturally occurring Cas protein. A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some case, the cell does not naturally produce Cas protein and is genetically engineered to produce a Cas protein. The Cas protein is deployed in mammalian cells (and putatively within plant cells) by co-expressing the Cas nuclease with guide RNA. Two forms of guide RNAs can be used to facilitate Cas-mediated genome cleavage as disclosed in Le Cong, F., et al., (2013) Science 339(6121):819-823.

In other embodiments, the DNA-binding domain may be associated with a cleavage (nuclease) domain. For example, homing endonucleases may be modified in their DNA-binding specificity while retaining nuclease function. In addition, zinc finger proteins may also be fused to a cleavage domain to form a zinc finger nuclease (ZFN). The cleavage domain portion of the fusion proteins disclosed herein can be obtained from any endonuclease or exonuclease. Exemplary endonucleases from which a cleavage domain can be derived include, but are not limited to, restriction endonucleases and homing endonucleases. See, for example, 2002-2003 Catalogue, New England Biolabs, Beverly, Mass.; and Belfort et al. (1997) Nucleic Acids Res. 25:3379-3388. Additional enzymes which cleave DNA are known (e.g., S1 Nuclease; mung bean nuclease; pancreatic DNase I; micrococcal nuclease; yeast HO endonuclease; see also Linn et al. (eds.) Nucleases, Cold Spring Harbor Laboratory Press, 1993). Non limiting examples of homing endonucleases and meganucleases include I-SceI, I-CeuI, PI-PspI, PI-Sce, I-SceIV, I-CsmI, I-PanI, I-SceII, I-PpoI, I-SceIII, I-CreI, I-TevI, I-TevII and I-TevIII are known. See also U.S. Pat. No. 5,420,032; U.S. Pat. No. 6,833,252; Belfort et al. (1997) Nucleic Acids Res. 25:3379-3388; Dujon et al. (1989) Gene 82:115-118; Perler et al. (1994) Nucleic Acids Res. 22, 1125-1127; Jasin (1996) Trends Genet. 12:224-228; Gimble et al. (1996) J. Mol. Biol. 263:163-180; Argast et al. (1998) J. Mol. Biol. 280:345-353 and the New England Biolabs catalogue. One or more of these enzymes (or functional fragments thereof) can be used as a source of cleavage domains and cleavage half-domains.

Restriction endonucleases (restriction enzymes) are present in many species and are capable of sequence-specific binding to DNA (at a recognition site), and cleaving DNA at or near the site of binding. Certain restriction enzymes (e.g., Type IIS) cleave DNA at sites removed from the recognition site and have separable binding and cleavage domains. For example, the Type IIS enzyme FokI catalyzes double-stranded cleavage of DNA, at 9 nucleotides from its recognition site on one strand and 13 nucleotides from its recognition site on the other. See, for example, U.S. Pat. Nos. 5,356,802; 5,436,150 and 5,487,994; as well as Li et al. (1992) Proc. Natl. Acad. Sci. USA 89:4275-4279; Li et al. (1993) Proc. Natl. Acad. Sci. USA 90:2764-2768; Kim et al. (1994a) Proc. Natl. Acad. Sci. USA 91:883-887; Kim et al. (1994b) J. Biol. Chem. 269:31,978-31,982. Thus, in one embodiment, fusion proteins comprise the cleavage domain (or cleavage half-domain) from at least one Type IIS restriction enzyme and one or more zinc finger binding domains, which may or may not be engineered.

An exemplary Type IIS restriction enzyme, whose cleavage domain is separable from the binding domain, is FokI. This particular enzyme is active as a dimer. Bitinaite et al. (1998) Proc. Natl. Acad. Sci. USA 95: 10,570-10,575. Accordingly, for the purposes of the present disclosure, the portion of the FokI enzyme used in the disclosed fusion proteins is considered a cleavage half-domain. Thus, for targeted double-stranded cleavage and/or targeted replacement of cellular sequences using zinc finger-FokI fusions, two fusion proteins, each comprising a FokI cleavage half-domain, can be used to reconstitute a catalytically active cleavage domain. Alternatively, a single polypeptide molecule containing a zinc finger binding domain and two FokI cleavage half-domains can also be used. Parameters for targeted cleavage and targeted sequence alteration using zinc finger-FokI fusions are provided elsewhere in this disclosure.

A cleavage domain or cleavage half-domain can be any portion of a protein that retains cleavage activity, or that retains the ability to multimerize (e.g., dimerize) to form a functional cleavage domain. Exemplary Type IIS restriction enzymes are described in International Publication WO 2007/014275, incorporated by reference herein in its entirety.

To enhance cleavage specificity, cleavage domains may also be modified. In certain embodiments, variants of the cleavage half-domain are employed these variants minimize or prevent homodimerization of the cleavage half-domains. Non-limiting examples of such modified cleavage half-domains are described in detail in WO 2007/014275, incorporated by reference in its entirety herein. In certain embodiments, the cleavage domain comprises an engineered cleavage half-domain (also referred to as dimerization domain mutants) that minimize or prevent homodimerization. Such embodiments are known to those of skill the art and described for example in U.S. Patent Publication Nos. 20050064474; 20060188987; 20070305346 and 20080131962, the disclosures of all of which are incorporated by reference in their entireties herein. Amino acid residues at positions 446, 447, 479, 483, 484, 486, 487, 490, 491, 496, 498, 499, 500, 531, 534, 537, and 538 of FokI are all targets for influencing dimerization of the FokI cleavage half-domains.

Additional engineered cleavage half-domains of FokI that form obligate heterodimers can also be used in the ZFNs described herein. Exemplary engineered cleavage half-domains of Fok I that form obligate heterodimers include a pair in which a first cleavage half-domain includes mutations at amino acid residues at positions 490 and 538 of Fok I and a second cleavage half-domain includes mutations at amino acid residues 486 and 499. In one embodiment, a mutation at 490 replaces Glu (E) with Lys (K); the mutation at 538 replaces Iso (I) with Lys (K); the mutation at 486 replaced Gln (Q) with Glu (E); and the mutation at position 499 replaces Iso (I) with Lys (K). Specifically, the engineered cleavage half-domains described herein were prepared by mutating positions 490 (E→K) and 538 (I→K) in one cleavage half-domain to produce an engineered cleavage half-domain designated "E490K:I538K" and by mutating positions 486 (Q→E) and 499 (I→L) in another cleavage half-domain to produce an engineered cleavage half-domain designated "Q486E:I499L". The engineered cleavage half-domains described herein are obligate heterodimer mutants in which aberrant cleavage is minimized or abolished. See, e.g., U.S. Patent Publication No. 2008/0131962, the disclosure of which is incorporated by reference in its entirety for all purposes. In certain embodiments, the engineered cleavage half-domain comprises mutations at positions 486, 499 and 496 (numbered relative to wild-type FokI), for instance mutations that replace the wild type Gln (Q) residue at position 486 with a Glu (E) residue, the wild type Iso (I) residue at position 499 with a Leu (L) residue and the wild-type Asn (N) residue at position 496 with an Asp (D) or Glu (E) residue (also referred to as a "ELD" and "ELE" domains, respectively). In other embodiments, the engineered cleavage half-domain comprises mutations at positions 490, 538 and 537 (numbered relative to wild-type FokI), for instance mutations that replace the wild type Glu (E) residue at position 490 with a Lys (K) residue, the wild type Iso (I) residue at position 538 with a Lys (K) residue, and the wild-type His (H) residue at position 537 with a Lys (K) residue or a Arg (R) residue (also referred to as "KKK" and "KKR" domains, respectively). In other embodiments, the engineered cleavage half-domain comprises mutations at positions 490 and 537 (numbered relative to wild-type FokI), for instance mutations that replace the wild type Glu (E) residue at position 490 with a Lys (K) residue and the wild-type His (H) residue at position 537 with a Lys (K) residue or a Arg (R) residue (also referred to as "KIK" and "KIR" domains, respectively). (See US Patent Publication No. 20110201055). In other embodiments, the engineered cleavage half domain comprises the "Sharkey" and/or "Sharkey'" mutations (see Guo et al, (2010) J. Mol. Biol. 400(1):96-107).

Engineered cleavage half-domains described herein can be prepared using any suitable method, for example, by site-directed mutagenesis of wild-type cleavage half-domains (Fok I) as described in U.S. Patent Publication Nos. 20050064474; 20080131962; and 20110201055. Alternatively, nucleases may be assembled in vivo at the nucleic acid target site using so-called "split-enzyme" technology (see e.g. U.S. Patent Publication No. 20090068164). Components of such split enzymes may be expressed either on separate expression constructs, or can be linked in one open reading frame where the individual components are separated, for example, by a self-cleaving 2A peptide or IRES sequence. Components may be individual zinc finger binding domains or domains of a meganuclease nucleic acid binding domain.

Nucleases can be screened for activity prior to use, for example in a yeast-based chromosomal system as described in WO 2009/042163 and 20090068164. Nuclease expression constructs can be readily designed using methods known in the art. See, e.g., United States Patent Publications 20030232410; 20050208489; 20050026157; 20050064474; 20060188987; 20060063231; and International Publication WO 07/014275. Expression of the nuclease may be under the control of a constitutive promoter or an inducible promoter, for example the galactokinase promoter which is activated (de-repressed) in the presence of raffinose and/or galactose and repressed in presence of glucose.

Distance between target sites refers to the number of nucleotides or nucleotide pairs intervening between two target sites as measured from the edges of the sequences nearest each other. In certain embodiments in which cleavage depends on the binding of two zinc finger domain/cleavage half-domain fusion molecules to separate target sites, the two target sites can be on opposite DNA strands. In other embodiments, both target sites are on the same DNA strand. For targeted integration into the optimal genomic locus, one or more ZFPs are engineered to bind a target site at or near the predetermined cleavage site, and a fusion protein comprising the engineered DNA-binding domain and a cleavage domain is expressed in the cell. Upon binding of the zinc finger portion of the fusion protein to the target site, the DNA is cleaved, preferably via a double-stranded break, near the target site by the cleavage domain.

The presence of a double-stranded break in the optimal genomic locus facilitates integration of exogenous sequences via homologous recombination. Thus, in one embodiment the polynucleotide comprising the nucleic acid sequence of interest to be inserted into the targeted genomic locus will include one or more regions of homology with the targeted genomic locus to facilitate homologous recombination.

In addition to the fusion molecules described herein, targeted replacement of a selected genomic sequence also involves the introduction of a donor sequence. The polynucleotide donor sequence can be introduced into the cell prior to, concurrently with, or subsequent to, expression of the fusion protein(s). In one embodiment the donor polynucleotide contains sufficient homology to the optimal genomic locus to support homologous recombination between it and the optimal genomic locus genomic sequence to which it bears homology. Approximately 25, 50, 100, 200, 500, 750, 1,000, 1,500, 2,000 nucleotides or more of sequence homology between a donor and a genomic sequence, or any integral value between 10 and 2,000 nucleotides or more, will support homologous recombination. In certain embodiments, the homology arms are less than 1,000 basepairs in length. In other embodiments, the homology arms are less than 750 base pairs in length. In one embodiment, donor polynucleotide sequences can comprise a vector molecule containing sequences that are not homologous to the region of interest in cellular chromatin. A donor polynucleotide molecule can contain several, discontinuous regions of homology to cellular chromatin. For example, for targeted insertion of sequences not normally present in a region of interest, said sequences can be present in a donor nucleic acid molecule and flanked by regions of homology to sequence in the region of interest. The donor polynucleotide can be DNA or RNA, single-stranded or double-stranded and can be introduced into a cell in linear or circular form. See, e.g., U.S. Patent Publication Nos. 20100047805, 20110281361, 20110207221 and U.S. application Ser. No. 13/889,162. If introduced in linear form, the ends of the donor sequence can be protected (e.g., from exonucleolytic degradation) by methods known to those of skill in the art. For example, one or more dideoxynucleotide residues are added to the 3' terminus of a linear molecule and/or self-complementary oligonucleotides are ligated to one or both ends. See, for example, Chang et al. (1987) *Proc. Natl. Acad. Sci. USA* 84:4959-4963; Nehls et al. (1996) *Science* 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues.

In accordance with one embodiment a method of preparing a transgenic maize plant is provided wherein a DNA of interest has been inserted into an optimal nongenic maize genomic locus. The method comprises the steps of:

a. selecting an optimal nongenic maize locus as a target for insertion of the nucleic acid of interest;

b. introducing a site specific nuclease into a maize plant cell, wherein the site specific nuclease cleaves the nongenic sequence;

c. introducing the DNA of interest into the plant cell; and d. selecting transgenic plant cells comprising the DNA of interest targeted to said nongenic sequence.

In accordance with one embodiment a method of preparing a transgenic maize protoplast cell is provided wherein a DNA of interest has been inserted into an optimal nongenic maize genomic locus. The method comprises the steps of:

a. selecting an optimal nongenic maize locus as a target for insertion of the nucleic acid of interest;

b. introducing a site specific nuclease into a maize protoplast cell, wherein the site specific nuclease cleaves the nongenic sequence;

c. introducing the DNA of interest into the maize protoplast cell; and d. selecting the transgenic maize protoplast cell comprising the DNA of interest targeted to said nongenic sequence.

In one embodiment the site specific nuclease is selected from the group consisting of a Zinc Finger nuclease, a CRISPR nuclease, a TALEN nuclease, or a meganuclease, and more particularly in one embodiment the site specific nuclease is a Zinc Finger nuclease. In accordance with one embodiment the DNA of interest is integrated within said nongenic sequence via a homology directed repair integration method. Alternatively, in some embodiments the DNA of interest is integrated within said nongenic sequence via a non-homologous end joining integration method. In additional embodiments, the DNA of interest is integrated within said nongenic sequence via a previously undescribed integration method. In one embodiment the method comprises selecting a optimal nongenic maize genomic locus for targeted insertion of a DNA of interest that has 2, 3, 4, 5, 6, 7, or 8 of the following characteristics:

a. the nongenic sequence is at least 1 Kb in length and does not contain greater than 1% DNA methylation within the sequence;

b. the nongenic sequence exhibits a 0.00041 to 62.42 cM/Mb rate of recombination within the maize genome;

c. the nongenic sequence exhibits a 0 to 0.962 level of nucleosome occupancy of the maize genome;

d. the nongenic sequence shares less than 40% sequence identity with any other sequence contained in the maize genome;

e. the nongenic sequence has a relative location value from 0.00373 to 0.99908 ratio of genomic distance from a maize chromosomal centromere;

f. the nongenic sequence has a guanine/cytosine percent content range of 25.17 to 68.3%;

g. the nongenic sequence is located proximally to a genic sequence; and, h. a 1 Mb region of maize genomic sequence comprising said nongenic sequence comprises one or more additional nongenic sequences. In one embodiment the optimal nongenic maize locus is selected from a loci of cluster 1, 2, 3, 4, 5, 6, 7, 8, 9, 10, 11, 2, 3, 4, 5, 6, 7, 8, 9, 20, 21, 22, 23, 24, 25, 26, 27, 28, 29, 30, 31 or 32.

Delivery

The donor molecules disclosed herein are integrated into a genome of a cell via targeted, homology-independent and/or homology-dependent methods. For such targeted integration, the genome is cleaved at a desired location (or locations) using a nuclease, for example, a fusion between a DNA-binding domain (e.g., zinc finger binding domain, CRISPR or TAL effector domain is engineered to bind a target site at or near the predetermined cleavage site) and nuclease domain (e.g., cleavage domain or cleavage half-domain). In certain embodiments, two fusion proteins, each comprising a DNA-binding domain and a cleavage half-domain, are expressed in a cell, and bind to target sites which are juxtaposed in such a way that a functional cleavage domain is reconstituted and DNA is cleaved in the vicinity of the target sites. In one embodiment, cleavage occurs between the target sites of the two DNA-binding domains. One or both of the DNA-binding domains can be engineered. See, also, U.S. Pat. No. 7,888,121; U.S. Patent Publication 20050064474 and International Patent Publications WO05/084190, WO05/014791 and WO 03/080809.

The nucleases as described herein can be introduced as polypeptides and/or polynucleotides. For example, two polynucleotides, each comprising sequences encoding one of the aforementioned polypeptides, can be introduced into a cell, and when the polypeptides are expressed and each binds to its target sequence, cleavage occurs at or near the target sequence. Alternatively, a single polynucleotide comprising sequences encoding both fusion polypeptides is introduced into a cell. Polynucleotides can be DNA, RNA or any modified forms or analogues or DNA and/or RNA.

Following the introduction of a double-stranded break in the region of interest, the transgene is integrated into the region of interest in a targeted manner via non-homology dependent methods (e.g., non-homologous end joining (NHEJ)) following linearization of a double-stranded donor molecule as described herein. The double-stranded donor is preferably linearized in vivo with a nuclease, for example one or more of the same or different nucleases that are used to introduce the double-stranded break in the genome. Synchronized cleavage of the chromosome and the donor in the cell may limit donor DNA degradation (as compared to linearization of the donor molecule prior to introduction into the cell). The nuclease target sites used for linearization of the donor preferably do not disrupt the transgene(s) sequence(s).

The transgene may be integrated into the genome in the direction expected by simple ligation of the nuclease overhangs (designated "forward" or "AB" orientation) or in the alternate direction (designated "reverse" or "BA" orientation). In certain embodiments, the transgene is integrated following accurate ligation of the donor and chromosome overhangs. In other embodiments, integration of the transgene in either the BA or AB orientation results in deletion of several nucleotides.

Through the application of techniques such as these, the cells of virtually any species may be stably transformed. In some embodiments, transforming DNA is integrated into the genome of the host cell. In the case of multicellular species, transgenic cells may be regenerated into a transgenic organism. Any of these techniques may be used to produce a transgenic plant, for example, comprising one or more donor polynucleotide acid sequences in the genome of the transgenic plant.

The delivery of nucleic acids may be introduced into a plant cell in embodiments of the invention by any method known to those of skill in the art, including, for example and without limitation: by transformation of protoplasts (See, e.g., U.S. Pat. No. 5,508,184); by desiccation/inhibition-mediated DNA uptake (See, e.g., Potrykus et al. (1985) Mol. Gen. Genet. 199:183-8); by electroporation (See, e.g., U.S. Pat. No. 5,384,253); by agitation with silicon carbide fibers (See, e.g., U.S. Pat. Nos. 5,302,523 and 5,464,765); by Agrobacterium-mediated transformation (See, e.g., U.S. Pat. Nos. 5,563,055, 5,591,616, 5,693,512, 5,824,877, 5,981, 840, and 6,384,301); by acceleration of DNA-coated particles (See, e.g., U.S. Pat. Nos. 5,015,580, 5,550,318, 5,538, 880, 6,160,208, 6,399,861, and 6,403,865) and by Nanoparticles, nanocarriers and cell penetrating peptides (WO201126644A2; WO2009046384A1; WO2008148223A1) in the methods to deliver DNA, RNA, Peptides and/or proteins or combinations of nucleic acids and peptides into plant cells.

The most widely-utilized method for introducing an expression vector into plants is based on the natural transformation system of Agrobacterium. A. tumefaciens and A. rhizogenes are plant pathogenic soil bacteria that genetically transform plant cells. The $T_i$ and $R_i$ plasmids of A. tumefaciens and A. rhizogenes, respectively, carry genes responsible for genetic transformation of the plant. The $T_i$ (tumor-inducing)-plasmids contain a large segment, known as T-DNA, which is transferred to transformed plants. Another segment of the $T_i$ plasmid, the vir region, is responsible for T-DNA transfer. The T-DNA region is bordered by left-hand and right-hand borders that are each composed of terminal repeated nucleotide sequences. In some modified binary vectors, the tumor-inducing genes have been deleted, and the functions of the vir region are utilized to transfer foreign DNA bordered by the T-DNA border sequences. The T-region may also contain, for example, a selectable marker for efficient recovery of transgenic plants and cells, and a multiple cloning site for inserting sequences for transfer such as a nucleic acid encoding a fusion protein of the invention.

Thus, in some embodiments, a plant transformation vector is derived from a $T_i$ plasmid of A. tumefaciens (See, e.g., U.S. Pat. Nos. 4,536,475, 4,693,977, 4,886,937, and 5,501, 967; and European Patent EP 0 122 791) or a $R_i$ plasmid of A. rhizogenes. Additional plant transformation vectors include, for example and without limitation, those described by Herrera-Estrella et al. (1983) Nature 303:209-13; Bevan et al. (1983), supra; Klee et al. (1985) Bio/Technol. 3:637-42; and in European Patent EP 0 120 516, and those derived from any of the foregoing. Other bacteria, such as Sinorhizobium, Rhizobium, and Mesorhizobium, that naturally interact with plants can be modified to mediate gene transfer to a number of diverse plants. These plant-associated symbiotic bacteria can be made competent for gene transfer by acquisition of both a disarmed $T_i$ plasmid and a suitable binary vector.

The Nucleic Acid of Interest

The polynucleotide donor sequences for targeted insertion into a maize genomic locus typically range in length from about 10 to about 5,000 nucleotides. However, nucleotides substantially longer, up to 20,000 nucleotides can be used, including sequences of about 5, 6, 7, 8, 9, 10, 11 and 12 Kb in length. Additionally, donor sequences can comprise a vector molecule containing sequences that are not homologous to the replaced region. In one embodiment the nucleic acid of interest will include one or more regions that share homology with the targeted genomic loci. Generally, the homologous region(s) of the nucleic acid sequence of interest will have at least 50% sequence identity to a genomic sequence with which recombination is desired. In certain embodiments, the homologous region(s) of the nucleic acid of interest shares 60%, 70%, 80%, 90%, 95%, 98%, 99%, or 99.9% sequence identity with sequences located in the targeted genomic locus. However, any value between 1% and 100% sequence identity can be present, depending upon the length of the nucleic acid of interest.

A nucleic acid of interest can contain several, discontinuous regions of sequence sharing relatively high sequence identity to cellular chromatin. For example, for targeted insertion of sequences not normally present in a targeted genomic locus, the unique sequences can be present in a donor nucleic acid molecule and flanked by regions of sequences that share a relatively high sequence identity to a sequence present in the targeted genomic locus.

A nucleic acid of interest can also be inserted into a targeted genomic locus to serve as a reservoir for later use. For example, a first nucleic acid sequence comprising sequences homologous to a nongenic region of the maize genome, but containing a nucleic acid of interest (optionally encoding a ZFN under the control of an inducible promoter), may be inserted in a targeted genomic locus. Next, a second nucleic acid sequence is introduced into the cell to induce the insertion of a DNA of interest into an optimal nongenic maize genomic locus. Either the first nucleic acid sequence comprises a ZFNs specific to the optimal nongenic maize genomic locus and the second nucleic acid sequence comprises the DNA sequence of interest, or vice versa. In one embodiment the ZFN will cleave both the optimal nongenic maize genomic locus and the nucleic acid of interest. The resulting double stranded break in the genome can then become the integration site for the nucleic acid of interest released from the optimal genomic locus. Alternatively, expression of a ZFN already located in the genome can be induced after introduction of the DNA of interest to induce a double stranded break in the genome that can then become the integration site for the introduced nucleic acid of interest. In this way, the efficiency of targeted integration of a DNA of interest at any region of interest may be improved since the method does not rely on simultaneous uptake of both the nucleic acids encoding the ZFNs and the DNA of interest.

A nucleic acid of interest can also be inserted into an optimal nongenic maize genomic locus to serve as a target site for subsequent insertions. For example, a nucleic acid of interest comprised of DNA sequences that contain recognition sites for additional ZFN designs may be inserted into the locus. Subsequently, additional ZFN designs may be generated and expressed in cells such that the original nucleic acid of interest is cleaved and modified by repair or homologous recombination. In this way, reiterative integrations of nucleic acid of interests may occur at the optimal nongenic maize genomic locus.

Exemplary exogenous sequences that can be inserted into an optimal nongenic maize genomic locus include, but are not limited to, any polypeptide coding sequence (e.g., cDNAs), promoter, enhancer and other regulatory sequences (e.g., interfering RNA sequences, shRNA expression cassettes, epitope tags, marker genes, cleavage enzyme recognition sites and various types of expression constructs. Such sequences can be readily obtained using standard molecular biological techniques (cloning, synthesis, etc.) and/or are commercially available.

To express ZFNs, sequences encoding the fusion proteins are typically subcloned into an expression vector that contains a promoter to direct transcription. Suitable prokaryotic and eukaryotic promoters are well known in the art and described, e.g., in Sambrook et al., Molecular Cloning, A Laboratory Manual (2nd ed. 1989; 3.sup.rd ed., 2001); Kriegler, Gene Transfer and Expression: A Laboratory Manual (1990); and Current Protocols in Molecular Biology (Ausubel et al., supra. Bacterial expression systems for expressing the ZFNs are available in, e.g., *E. coli, Bacillus* sp., and *Salmonella* (Palva et al., Gene 22:229-235 (1983)). Kits for such expression systems are commercially available. Eukaryotic expression systems for mammalian cells, yeast, and insect cells are well known by those of skill in the art and are also commercially available.

The particular expression vector used to transport the genetic material into the cell is selected with regard to the intended use of the fusion proteins, e.g., expression in plants, animals, bacteria, fungus, protozoa, etc. (see expression vectors described below). Standard bacterial and animal expression vectors are known in the art and are described in detail, for example, U.S. Patent Publication 20050064474A1 and International Patent Publications WO05/084190, WO05/014791 and WO03/080809.

Standard transfection methods can be used to produce bacterial, mammalian, yeast or insect cell lines that express large quantities of protein, which can then be purified using standard techniques (see, e.g., Colley et al., J. Biol. Chem. 264:17619-17622 (1989); Guide to Protein Purification, in Methods in Enzymology, vol. 182 (Deutscher, ed., 1990)). Transformation of eukaryotic and prokaryotic cells are performed according to standard techniques (see, e.g., Morrison, J. Bact. 132:349-351 (1977); Clark-Curtiss & Curtiss, Methods in Enzymology 101:347-362 (Wu et al., eds., 1983).

The disclosed methods and compositions can be used to insert polynucleotide donor sequences into a predetermined location such as one of the optimal nongenic maize genomic loci. This is useful inasmuch as expression of an introduced transgene into the maize genome depends critically on its integration site. Accordingly, genes encoding herbicide tolerance, insect resistance, nutrients, antibiotics or therapeutic molecules can be inserted, by targeted recombination.

In one embodiment the nucleic acid of interest is combined or "stacked" with gene encoding sequences that provide additional resistance or tolerance to glyphosate or another herbicide, and/or provides resistance to select insects or diseases and/or nutritional enhancements, and/or improved agronomic characteristics, and/or proteins or other products useful in feed, food, industrial, pharmaceutical or other uses. The "stacking" of two or more nucleic acid sequences of interest within a plant genome can be accomplished, for example, via conventional plant breeding using two or more events, transformation of a plant with a construct which contains the sequences of interest, re-transformation of a transgenic plant, or addition of new traits through targeted integration via homologous recombination.

Such polynucleotide donor nucleotide sequences of interest include, but are not limited to, those examples provided below:

1. Genes or Coding Sequence (e.g. iRNA) that Confer Resistance to Pests or Disease (A) Plant Disease Resistance Genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. Examples of such genes include, the tomato Cf-9 gene for resistance to *Cladosporium fulvum* (Jones et al., 1994 Science 266:789), tomato Pto gene, which encodes a protein kinase, for resistance to *Pseudomonas syringae* pv. tomato (Martin et al., 1993 Science 262:1432), and *Arabidopsis* RSSP2 gene for resistance to *Pseudomonas syringae* (Mindrinos et al., 1994 Cell 78:1089).

(B) A *Bacillus thuringiensis* protein, a derivative thereof or a synthetic polypeptide modeled thereon, such as, a nucleotide sequence of a Bt δ-endotoxin gene (Geiser et al., 1986 Gene 48:109), and a vegetative insecticidal (VIP) gene (see, e.g., Estruch et al. (1996) Proc. Natl. Acad. Sci. 93:5389-94). Moreover, DNA molecules encoding δ-endotoxin genes can be purchased from American Type Culture Collection (Rockville, Md.), under ATCC accession numbers 40098, 67136, 31995 and 31998.

(C) A lectin, such as, nucleotide sequences of several *Clivia miniata* mannose-binding lectin genes (Van Damme et al., 1994 Plant Molec. Biol. 24:825).

(D) A vitamin binding protein, such as avidin and avidin homologs which are useful as larvicides against insect pests. See U.S. Pat. No. 5,659,026.

(E) An enzyme inhibitor, e.g., a protease inhibitor or an amylase inhibitor. Examples of such genes include a rice cysteine proteinase inhibitor (Abe et al., 1987 J. Biol. Chem. 262:16793), a tobacco proteinase inhibitor I (Huub et al., 1993 Plant Molec. Biol. 21:985), and an α-amylase inhibitor (Sumitani et al., 1993 Biosci. Biotech. Biochem. 57:1243).

(F) An insect-specific hormone or pheromone such as an ecdysteroid and juvenile hormone a variant thereof, a mimetic based thereon, or an antagonist or agonist thereof, such as baculovirus expression of cloned juvenile hormone esterase, an inactivator of juvenile hormone (Hammock et al., 1990 Nature 344:458).

(G) An insect-specific peptide or neuropeptide which, upon expression, disrupts the physiology of the affected pest (J. Biol. Chem. 269:9). Examples of such genes include an insect diuretic hormone receptor (Regan, 1994), an allostatin identified in *Diploptera punctata* (Pratt, 1989), and insect-specific, paralytic neurotoxins (U.S. Pat. No. 5,266,361).

(H) An insect-specific venom produced in nature by a snake, a wasp, etc., such as a scorpion insectotoxic peptide (Pang, 1992 Gene 116:165).

(I) An enzyme responsible for a hyperaccumulation of monoterpene, a sesquiterpene, a steroid, hydroxamic acid, a phenylpropanoid derivative or another non-protein molecule with insecticidal activity.

(J) An enzyme involved in the modification, including the post-translational modification, of a biologically active molecule; for example, glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. Examples of such genes include, a callas gene (PCT published application WO93/02197), chitinase-encoding sequences (which can be obtained, for example, from the ATCC under accession numbers 3999637 and 67152), tobacco hookworm chitinase (Kramer et al., 1993 Insect Molec. Biol. 23:691), and parsley ubi4-2 polyubiquitin gene (Kawalleck et al., 1993 Plant Molec. Biol. 21:673).

(K) A molecule that stimulates signal transduction. Examples of such molecules include nucleotide sequences for mung bean calmodulin cDNA clones (Botella et al., 1994 Plant Molec. Biol. 24:757) and a nucleotide sequence of a maize calmodulin cDNA clone (Griess et al., 1994 Plant Physiol. 104:1467).

(L) A hydrophobic moment peptide. See U.S. Pat. Nos. 5,659,026 and 5,607,914; the latter teaches synthetic antimicrobial peptides that confer disease resistance.

(M) A membrane permease, a channel former or a channel blocker, such as a cecropin-β lytic peptide analog (Jaynes et al., 1993 Plant Sci. 89:43) which renders transgenic tobacco plants resistant to *Pseudomonas solanacearum*.

(N) A viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. See, for example, Beachy et al. (1990) Ann. Rev. Phytopathol. 28:451.

(O) An insect-specific antibody or an immunotoxin derived therefrom. Thus, an antibody targeted to a critical metabolic function in the insect gut would inactivate an affected enzyme, killing the insect. For example, Taylor et al. (1994) Abstract #497, Seventh Int'l. Symposium on Molecular Plant-Microbe Interactions shows enzymatic inactivation in transgenic tobacco via production of single-chain antibody fragments.

(P) A virus-specific antibody. See, for example, Tavladoraki et al. (1993) Nature 266:469, which shows that transgenic plants expressing recombinant antibody genes are protected from virus attack.

(Q) A developmental-arrestive protein produced in nature by a pathogen or a parasite. Thus, fungal endo α-1,4-D polygalacturonases facilitate fungal colonization and plant nutrient release by solubilizing plant cell wall homo-α-1,4-D-galacturonase (Lamb et al., 1992) Bio/Technology 10:1436. The cloning and characterization of a gene which encodes a bean endopolygalacturonase-inhibiting protein is described by Toubart et al. (1992 Plant J. 2:367).

(R) A developmental-arrestive protein produced in nature by a plant, such as the barley ribosome-inactivating gene that provides an increased resistance to fungal disease (Longemann et al., 1992). Bio/Technology 10:3305.

(S) RNA interference, in which an RNA molecule is used to inhibit expression of a target gene. An RNA molecule in one example is partially or fully double stranded, which triggers a silencing response, resulting in cleavage of dsRNA into small interfering RNAs, which are then incorporated into a targeting complex that destroys homologous mRNAs. See, e.g., Fire et al., U.S. Pat. No. 6,506,559; Graham et al. U.S. Pat. No. 6,573,099.

2. Genes that Confer Resistance to a Herbicide (A) Genes encoding resistance or tolerance to a herbicide that inhibits the growing point or meristem, such as an imidazalinone, sulfonanilide or sulfonylurea herbicide. Exemplary genes in this category code for mutant acetolactate synthase (ALS) (Lee et al., 1988 EMBO J. 7:1241) also known as acetohydroxyacid synthase (AHAS) enzyme (Miki et al., 1990 Theor. Appl. Genet. 80:449).

(B) One or more additional genes encoding resistance or tolerance to glyphosate imparted by mutant EPSP synthase and aroA genes, or through metabolic inactivation by genes such as DGT-28, 2mEPSPS, GAT (glyphosate acetyltransferase) or GOX (glyphosate oxidase) and other phosphono compounds such as glufosinate (pat,bar, and dsm-2 genes), and aryloxyphenoxypropionic acids and cyclohexanediones (ACCase inhibitor encoding genes). See, for example, U.S. Pat. No. 4,940,835, which discloses the nucleotide sequence of a form of EPSP which can confer glyphosate resistance. A DNA molecule encoding a mutant aroA gene can be obtained under ATCC Accession Number 39256, and the nucleotide sequence of the mutant gene is disclosed in U.S. Pat. No. 4,769,061. European patent application No. 0 333 033 and U.S. Pat. No. 4,975,374 disclose nucleotide sequences of glutamine synthetase genes which confer resistance to herbicides such as L-phosphinothricin. The nucleotide sequence of a phosphinothricinacetyl-transferase gene is provided in European application No. 0 242 246. De Greef et al. (1989) Bio/Technology 7:61 describes the production of transgenic plants that express chimeric bar genes coding for phosphinothricin acetyl transferase activity. Exemplary of genes conferring resistance to aryloxyphenoxypropionic acids and cyclohexanediones, such as sethoxydim and haloxyfop, are the Accl-S1, Accl-S2 and Accl-S3 genes described by Marshall et al. (1992) Theor. Appl. Genet. 83:435.

(C) Genes encoding resistance or tolerance to a herbicide that inhibits photosynthesis, such as a triazine (psbA and gs+ genes) and a benzonitrile (nitrilase gene). Przibilla et al. (1991) Plant Cell 3:169 describe the use of plasmids encoding mutant psbA genes to transform *Chlamydomonas*. Nucleotide sequences for nitrilase genes are disclosed in U.S. Pat. No. 4,810,648, and DNA molecules containing these genes are available under ATCC accession numbers 53435, 67441 and 67442. Cloning and expression of DNA coding for a glutathione S-transferase is described by Hayes et al. (1992) Biochem. J. 285:173.

(D) Genes encoding resistance or tolerance to a herbicide that bind to hydroxyphenylpyruvate dioxygenases (HPPD), enzymes which catalyze the reaction in which para-hydroxyphenylpyruvate (HPP) is transformed into homogentisate. This includes herbicides such as isoxazoles (EP418175, EP470856, EP487352, EP527036, EP560482, EP682659, U.S. Pat. No. 5,424,276), in particular isoxaflutole, which is a selective herbicide for maize, diketonitriles (EP496630, EP496631), in particular 2-cyano-3-cyclopropyl-1-(2-SO2CH3-4-CF3 phenyl)propane-1,3-dione and 2-cyano-3-cyclopropyl-1-(2-SO2CH3-4-2,3Cl2phenyl)propane-1,3-dione, triketones (EP625505, EP625508, U.S. Pat. No. 5,506,195), in particular sulcotrione, and pyrazolinates. A gene that produces an overabundance of HPPD in plants can provide tolerance or resistance to such herbicides, including, for example, genes described in U.S. Pat. Nos. 6,268,549 and 6,245,968 and U.S. Patent Application, Publication No. 20030066102.

(E) Genes encoding resistance or tolerance to phenoxy auxin herbicides, such as 2,4-dichlorophenoxyacetic acid (2,4-D) and which may also confer resistance or tolerance to aryloxyphenoxypropionate (AOPP) herbicides. Examples of such genes include the α-ketoglutarate-dependent dioxygenase enzyme (aad-1) gene, described in U.S. Pat. No. 7,838,733.

(F) Genes encoding resistance or tolerance to phenoxy auxin herbicides, such as 2,4-dichlorophenoxyacetic acid (2,4-D) and which may also confer resistance or tolerance to pyridyloxy auxin herbicides, such as fluroxypyr or triclopyr. Examples of such genes include the α-ketoglutarate-dependent dioxygenase enzyme gene (aad-12), described in WO 2007/053482 A2.

(G) Genes encoding resistance or tolerance to dicamba (see, e.g., U.S. Patent Publication No. 20030135879).

(H) Genes providing resistance or tolerance to herbicides that inhibit protoporphyrinogen oxidase (PPO) (see U.S. Pat. No. 5,767,373).

(I) Genes providing resistance or tolerance to triazine herbicides (such as atrazine) and urea derivatives (such as diuron) herbicides which bind to core proteins of photosystem II reaction centers (PS II) (See Brussian et al., (1989) EMBO J. 1989, 8(4): 1237-1245.

3. Genes that Confer or Contribute to a Value-Added Trait (A) Modified fatty acid metabolism, for example, by transforming maize or *Brassica* with an antisense gene or stearoyl-ACP desaturase to increase stearic acid content of the plant (Knultzon et al., 1992) Proc. Nat. Acad. Sci. USA 89:2624.

(B) Decreased phytate content (1) Introduction of a phytase-encoding gene, such as the *Aspergillus niger* phytase gene (Van Hartingsveldt et al., 1993 Gene 127:87), enhances breakdown of phytate, adding more free phosphate to the transformed plant.

(2) A gene could be introduced that reduces phytate content. In maize, this, for example, could be accomplished by cloning and then reintroducing DNA associated with the single allele which is responsible for maize mutants characterized by low levels of phytic acid (Raboy et al., 1990 Maydica 35:383).

(C) Modified carbohydrate composition effected, for example, by transforming plants with a gene coding for an enzyme that alters the branching pattern of starch. Examples of such enzymes include, *Streptococcus* mucus fructosyltransferase gene (Shiroza et al., 1988) J. Bacteriol. 170:810, *Bacillus subtilis* levansucrase gene (Steinmetz et al., 1985 Mol. Gen. Genel. 200:220), *Bacillus licheniformis* α-amylase (Pen et al., 1992 Bio/Technology 10:292), tomato invertase genes (Elliot et al., 1993), barley amylase gene (Sogaard et al., 1993 J. Biol. Chem. 268:22480), and maize endosperm starch branching enzyme II (Fisher et al., 1993 Plant Physiol. 102:10450).

III. Recombinant Constructs

As disclosed herein the present disclosure provides recombinant genomic sequences comprising an optimal nongenic maize genomic sequence of at least 1 Kb and a DNA of interest, wherein the inserted DNA of interest is inserted into said nongenic sequence. In one embodiment the DNA of interest is an analytical domain, a gene or coding sequence (e.g. iRNA) that confers resistance to pests or disease, genes that confer resistance to a herbicide or genes that confer or contribute to a value-added trait, and the optimal nongenic maize genomic sequence comprises 1, 2, 3, 4, 5, 6, 7, or 8 of the following characteristics:

a. the nongenic sequence is about 1 Kb to about 8.3 Kb in length and does not contain a methylated polynucleotide;

b. the nongenic sequence exhibits a 0.00041 to 62.42 cM/Mb rate of recombination within the maize genome;

c. the nongenic sequence exhibits a 0 to 0.962 level of nucleosome occupancy of the maize genome;

d. the nongenic sequence shares less than 40% sequence identity with any other sequence contained in the maize genome;

e. the nongenic sequence has a relative location value from 0.00373 to 0.99908 ratio of genomic distance from a maize chromosomal centromere;

f. the nongenic sequence has a guanine/cytosine percent content range of 25.17 to 68.3%;

g. the nongenic sequence is located proximally to an genic sequence, comprising a known or predicted maize coding sequence within 40 Kb of contiguous genomic DNA comprising the native nongenic sequence; and, h. the nongenic sequence is located in a 1 Mb region of maize genomic sequence that comprises at least a second nongenic sequence. In one embodiment the optimal nongenic maize genomic sequence is further characterized as having a genic region comprisings 1 to 9 known or predicted maize coding sequence within 40 Kb of contiguous genomic DNA comprising the native nongenic sequence. In one embodiment the optimal nongenic maize locus is selected from a loci of cluster 1, 2, 3, 4, 5, 6, 7, 8, 9, 10, 11, 2, 3, 4, 5, 6, 7, 8, 9, 20, 21, 22, 23, 24, 25, 26, 27, 28, 29, 30, 31 or 32.

IV. Transgenic Plants

Transgenic plants comprising the recombinant optimal nongenic maize loci are also provided in accordance with one embodiment of the present disclosure. Such transgenic plants can be prepared using techniques known to those skilled in the art.

A transformed maize cell, callus, tissue or plant may be identified and isolated by selecting or screening the engineered plant material for traits encoded by the marker genes present on the transforming DNA. For instance, selection can be performed by growing the engineered plant material on media containing an inhibitory amount of the antibiotic or herbicide to which the transforming gene construct confers resistance. Further, transformed cells can also be identified by screening for the activities of any visible marker genes (e.g., the yellow fluorescence protein, green fluorescence protein, red fluorescence protein, beta-glucuronidase, luciferase, B or C1 genes) that may be present on the recombinant nucleic acid constructs. Such selection and screening methodologies are well known to those skilled in the art.

Physical and biochemical methods also may be used to identify plant or plant cell transformants containing inserted gene constructs. These methods include but are not limited to: 1) Southern analysis or PCR amplification for detecting and determining the structure of the recombinant DNA insert; 2) Northern blot, S1 RNase protection, primer-extension or reverse transcriptase-PCR amplification for detecting and examining RNA transcripts of the gene constructs; 3) enzymatic assays for detecting enzyme or ribozyme activity, where such gene products are encoded by the gene construct; 4) protein gel electrophoresis, Western blot techniques, immunoprecipitation, or enzyme-linked immunoassays (ELISA), where the gene construct products are proteins. Additional techniques, such as in situ hybridization, enzyme staining, and immunostaining, also may be used to detect the presence or expression of the recombinant construct in specific plant organs and tissues. The methods for doing all these assays are well known to those skilled in the art.

Effects of gene manipulation using the methods disclosed herein can be observed by, for example, Northern blots of the RNA (e.g., mRNA) isolated from the tissues of interest. Typically, if the mRNA is present or the amount of mRNA has increased, it can be assumed that the corresponding transgene is being expressed. Other methods of measuring gene and/or encoded polypeptide activity can be used. Different types of enzymatic assays can be used, depending on the substrate used and the method of detecting the increase or decrease of a reaction product or by-product. In addition, the levels of polypeptide expressed can be measured immunochemically, i.e., ELISA, RIA, EIA and other antibody based assays well known to those of skill in the art, such as by electrophoretic detection assays (either with staining or western blotting). As one non-limiting example, the detection of the AAD-1 (aryloxyalkanoate dioxygenase; see WO 2005/107437) and PAT (phosphinothricin-N-acetyl-transferase (PAT)) proteins using an ELISA assay is described in U.S. Patent Publication No. 20090093366 which is herein incorporated by reference in its entirety. The transgene may be selectively expressed in some tissues of the plant or at some developmental stages, or the transgene may be expressed in substantially all plant tissues, substantially along its entire life cycle. However, any combinatorial expression mode is also applicable.

One of skill in the art will recognize that after the exogenous polynucleotide donor sequence is stably incorporated in transgenic plants and confirmed to be operable, it can be introduced into other plants by sexual crossing. Any of a number of standard breeding techniques can be used, depending upon the species to be crossed.

The present disclosure also encompasses seeds of the transgenic plants described above wherein the seed has the transgene or gene construct. The present disclosure further encompasses the progeny, clones, cell lines or cells of the transgenic plants described above wherein the progeny, clone, cell line or cell has the transgene or gene construct inserted into an optimal genomic loci.

Transformed plant cells which are produced by any of the above transformation techniques can be cultured to regenerate a whole plant which possesses the transformed genotype and thus the desired phenotype. Such regeneration techniques rely on manipulation of certain phytohormones in a tissue culture growth medium, typically relying on a biocide and/or herbicide marker which has been introduced together with the desired nucleotide sequences. Plant regeneration from cultured protoplasts is described in Evans, et al., "Protoplasts Isolation and Culture" in Handbook of Plant Cell Culture, pp. 124-176, Macmillian Publishing Company, New York, 1983; and Binding, Regeneration of Plants, Plant Protoplasts, pp. 21-73, CRC Press, Boca Raton, 1985. Regeneration can also be obtained from plant callus, explants, organs, pollens, embryos or parts thereof. Such regeneration techniques are described generally in Klee et al. (1987) Ann. Rev. of Plant Phys. 38:467-486.

A transgenic plant or plant material comprising a nucleotide sequence encoding a polypeptide may in some embodiments exhibit one or more of the following characteristics: expression of the polypeptide in a cell of the plant; expression of a portion of the polypeptide in a plastid of a cell of the plant; import of the polypeptide from the cytosol of a cell of the plant into a plastid of the cell; plastid-specific expression of the polypeptide in a cell of the plant; and/or localization of the polypeptide in a cell of the plant. Such a plant may additionally have one or more desirable traits other than expression of the encoded polypeptide. Such traits may include, for example: resistance to insects, other pests, and disease-causing agents; tolerances to herbicides; enhanced stability, yield, or shelf-life; environmental tolerances; pharmaceutical production; industrial product production; and nutritional enhancements.

In accordance with one embodiment a transgenic maize protoplast cell is provided comprising a recombinant optimal nongenic maize locus. More particularly, a maize protoplast plant cell is provided comprising a DNA of interest inserted into an optimal nongenic maize genomic loci of the maize protoplast cell, wherein said nongenic maize genomic loci is about 1 Kb to about 8.3 Kb in length and lacks any methylated nucleotides. In one embodiment the transgenic maize protoplast cell comprises a DNA of interest inserted into the optimal nongenic maize genomic locus wherein the DNA of interest comprises an analytical domain, and/or an open reading frame. In one embodiment the inserted DNA of interest encodes a peptide and in a further embodiment the DNA of interest comprises at least one gene expression cassette comprising a transgene.

In accordance with one embodiment a transgenic maize plant, maize plant part, or maize plant cell is provided comprising a recombinant optimal nongenic maize locus. More particularly, a maize plant, maize plant part, or maize plant cell is provided comprising a DNA of interest inserted into an optimal nongenic maize genomic loci of the maize plant, maize plant part, or maize plant cell, wherein said nongenic maize genomic loci is about 1 Kb to about 8.5 Kb in length and lacks any methylated nucleotides. In one embodiment the transgenic maize plant, maize plant part, or maize plant cell comprises a DNA of interest inserted into the optimal nongenic maize genomic locus wherein the DNA of interest comprises an analytical domain, and/or an open reading frame. In one embodiment the inserted DNA of interest encodes a peptide and in a further embodiment the DNA of interest comprises at least one gene expression cassette comprising a transgene.

In accordance with embodiment 1 a recombinant sequence is provided wherein, said recombinant sequence comprises a nucleic acid sequence of at least 1 Kb and having at least 90%, 95% or 99% sequence identity with a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), loci_232228_G1 (SEQ ID NO: 4529) and a DNA of interest, wherein the DNA of interest is inserted into said nongenic sequence to produce said recombinant sequence. In accordance with embodiment 2 a recombinant sequence of embodiment 1 is provided wherein said DNA of interest is inserted proximal to a zinc finger target site specific to the nongenic sequence, and more particularly a zinc finger target site of Table 8. In accordance with embodiment 3 a recombinant sequence of embodiment 1 is provided, wherein said DNA of interest is inserted between a pair of zinc finger target sites specific to the nongenic sequence, and more particularly a pair of zinc finger target sites selected from Table 8. In accordance with one embodiment a recombinant sequence is provided wherein, said recombinant sequence consists of a nucleic acid sequence of at least 1 Kb and having 100% sequence identity with a sequence present in a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), loci_232228_G1 (SEQ ID NO: 4529) and a DNA of interest, wherein the DNA of interest is inserted into said nongenic sequence to produce said recombinant sequence.

In accordance with embodiment 4 a recombinant sequence of any one of embodiments 1, 2 or 3 is provided wherein said DNA of interest comprises an analytical domain. In accordance with embodiment 5 a recombinant sequence of any one of embodiments 1, 2 or 3 is provided wherein said DNA of interest does not encode a peptide. In accordance with embodiment 6 a recombinant sequence of any one of embodiments 1, 2 or 3 is provided wherein said DNA of interest encodes a peptide. In accordance with embodiment 7 a recombinant sequence of a embodiment 6 is provided wherein said DNA of interest comprises a gene expression cassette comprising an insecticidal resistance gene, herbicide tolerance gene, nitrogen use efficiency gene, water use efficiency gene, nutritional quality gene, DNA binding gene, and selectable marker gene. In accordance with embodiment 8 a recombinant sequence of any one of embodiments 1-7 is provided wherein said DNA of interest comprises two or more gene expression cassettes. In accordance with embodiment 9 a recombinant sequence of embodiment 8 is provided wherein two or more of said nongenic sequences each comprise an inserted DNA of interest to produce two or more recombinant sequences wherein the two or more recombinant sequences are located on a same chromosome. In accordance with embodiment 10 a recombinant sequence of any one of embodiments 1-9 is provided wherein said DNA of interest and/or said nongenic sequence are modified during insertion of said DNA of interest into said nongenic sequence. In accordance with embodiment 11 a maize plant, maize plant part, or maize plant cell is provided comprising a recombinant sequence of any one of embodiments 1-10. In accordance with embodiment 12 a method of making a transgenic plant cell comprising a DNA of interest is provided wherein the method comprises selecting a target nongenic maize genomic locus having at least 90%, 95% or 99% sequence identity from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), loci_232228_G1 (SEQ ID NO: 4529), selecting a site specific nuclease that specifically binds and cleaves said target nongenic maize genomic locus, optionally one selected from Table 8, introducing said site specific nuclease into a maize plant cell, introducing the DNA of interest into the plant cell, inserting the DNA of interest into said target nongenic maize genomic loci, and selecting transgenic plant cells comprising the DNA of interest targeted to said nongenic locus. In accordance with embodiment 18 a method of making a transgenic plant cell of embodiment 12 wherein said site specific nuclease is selected from the group consisting of a zinc finger nuclease, a CRISPR nuclease, a TALEN, a homing endonuclease or a meganuclease. In accordance with embodiment 19 a method of making a transgenic plant cell of embodiment 12 or 18 wherein said DNA of interest is integrated within said nongenic locus via a homology directed repair integration method. In accordance with embodiment 20 a method of making a transgenic plant cell of embodiment 12 or 18 wherein said DNA of interest is integrated within said nongenic locus via a non-homologous end joining integration method. In accordance with embodiment 21 a method of making a transgenic plant cell of embodiment 12, 18, 19 or 20 wherein two or more of said DNA of interest are inserted into two or more of said target nongenic maize genomic loci, optionally wherein the two or more of said target nongenic maize genomic loci are located on a same chromosome.

In accordance with embodiment 1 a purified nongenic maize sequence of at least 1 Kb and having at least 90%, 95% or 99% sequence identity with a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), loci_232228_G1 (SEQ ID NO: 4529) is provided. In accordance with one embodiment a purified nongenic maize sequence is provided wherein, said sequence consists of a nucleic acid sequence of at least 1 Kb and having 100% sequence identity with a sequence present in a nongenic sequence selected from the group consisting of loci_137693_G1 (SEQ ID NO:387), loci_265551_G1 (SEQ ID NO:463), loci_128078_G1 (SEQ ID NO:560), loci_168286_G1 (SEQ ID NO:573), loci_3733_G1 (SEQ ID NO:1268), loci_203075_G1 (SEQ ID NO:2030), loci_232484_G1 (SEQ ID NO:2053), loci_136086_G1 (SEQ ID NO:4425), loci_203704_G1 (SEQ ID NO:2033), loci_127268_G1 (SEQ ID NO:2709), loci_204637_G1 (SEQ ID NO:2731), loci_291068_G1 (SEQ ID NO:3230), loci_232222_G1 (SEQ ID NO:3357), loci_43577_G1 (SEQ ID NO:3428), loci_204726_G1 (SEQ ID NO:424), loci_232228_G1 (SEQ ID NO: 4529)

EXAMPLES

Example 1: Identification of Targetable Genomic Loci in *Zea mays*

The *Zea mays* genome was screened with a bioinformatics approach using specific criteria to select optimal genomic loci for targeting of a polynucleotide donor. The specific criteria used for selecting the genomic loci were developed using considerations for optimal expression of a transgene within the plant genome, considerations for optimal binding of genomic DNA by a site specific DNA-binding protein, and transgenic plant product development requirements. In order to identify and select the genomic loci, genomic and epigenomic datasets of the *Zea mays* genome were scanned using a bioinformatics approach. Screening genomic and epigenomic datasets resulted in select loci which met the following criteria: 1) hypomethylated and greater than 1 Kb in length; 2) targetable via site specific nuclease-mediated integration of a polynucleotide donor; 3) agronomically neutral or non-genic; 4) regions from which an integrated transgene can be expressed; and 5) regions with recombination within/around the locus. Accordingly, a total of 5,286 genomic loci (SEQ ID NO:1-SEQ ID NO:5286) were identified using these specific criteria. The specific criteria are further described in detail below.

Hypomethylation

The *Zea mays* genome was scanned to select optimal genomic loci larger than 1 Kb that were DNA hypomethylated. Genome-wide DNA methylation levels of shoot and root tissue isolated from *Zea mays* c.v. B73 were surveyed via a bioinformatics method using Illumina™/Solexa™ 1G parallel sequencing data. The data were generated from genomic DNA isolated from the above described *Zea mays* plant tissues according to the protocol specified in Wang et al., (2009) Genome-Wide and Organ-Specific Landscapes of Epigenetic Modifications and Their Relationships to mRNA and Small RNA Transcriptomes in Maize. *Plant Cell* 21(4): 1053-1069). These data are available at the NCBI Genbank, Accession No; GEO:GSE15286. The raw sequencing reads were collected and mapped to the *Zea mays* c.v. B73 reference genome using the Bismark™ mapping software as described in Krueger F, Andrews S R (2011) Bismark: a flexible aligner and methylation caller for Bisulfite-Seq applications. *Bioinformatics* 27: 1571-1572).

The methylation level for each cytosine base in the genome was calculated as a percentage of the number of methylated reads mapping a particular cytosine base location to the total number of reads mapping to that location. The following hypothetical explains how methylation levels were calculated for each base within the *Zea mays* genome. For example, consider that there is a cytosine base at position 100 in chromosome 1 of the *Zea mays* c.v. B73 reference sequence. If there are a total of 20 reads mapped to cytosine base at position 100, and 10 of these reads are methylated, then the methylation level for the cytosine base at position 100 in chromosome 1 is estimated to be 50%. Accordingly, a profile of the methylation level for all of the genomic DNA base pairs obtained from the root and shoot tissue of *Zea mays* was calculated. The reads that could not be correctly mapped to unique locations in the *Zea mays* genome matched repetitive sequences that are widespread in the *Zea mays* genome, and are known in the art to be predominantly methylated.

Using the above described protocol, the methylation levels for the *Zea mays* c.v. B73 genome were measured. As such, regions of the *Zea mays* genome containing methylated reads indicated that these regions of the *Zea mays* genome were methylated. Conversely, the regions of the *Zea mays* genome that were absent of methylated reads indicated these regions of the *Zea mays* genome were non-methylated. The regions of the *Zea mays* genome from the shoot and root tissues that were non-methylated and did not contain any methylated reads are considered as "hypomethylated" regions. To make the root and shoot methylation profiles available for visualization, wiggle plots (http://useast.ensembl.org/info/website/upload/wig.html) were generated for each of the *Zea mays* c.v. B73 chromosomes. A screen-shot sample of a wiggle plot for the DNA methylation profile of root and shoot tissues obtained from *Zea mays* c.v. B73 chromosome number 1 is shown in FIG. 1.

Figure 2:
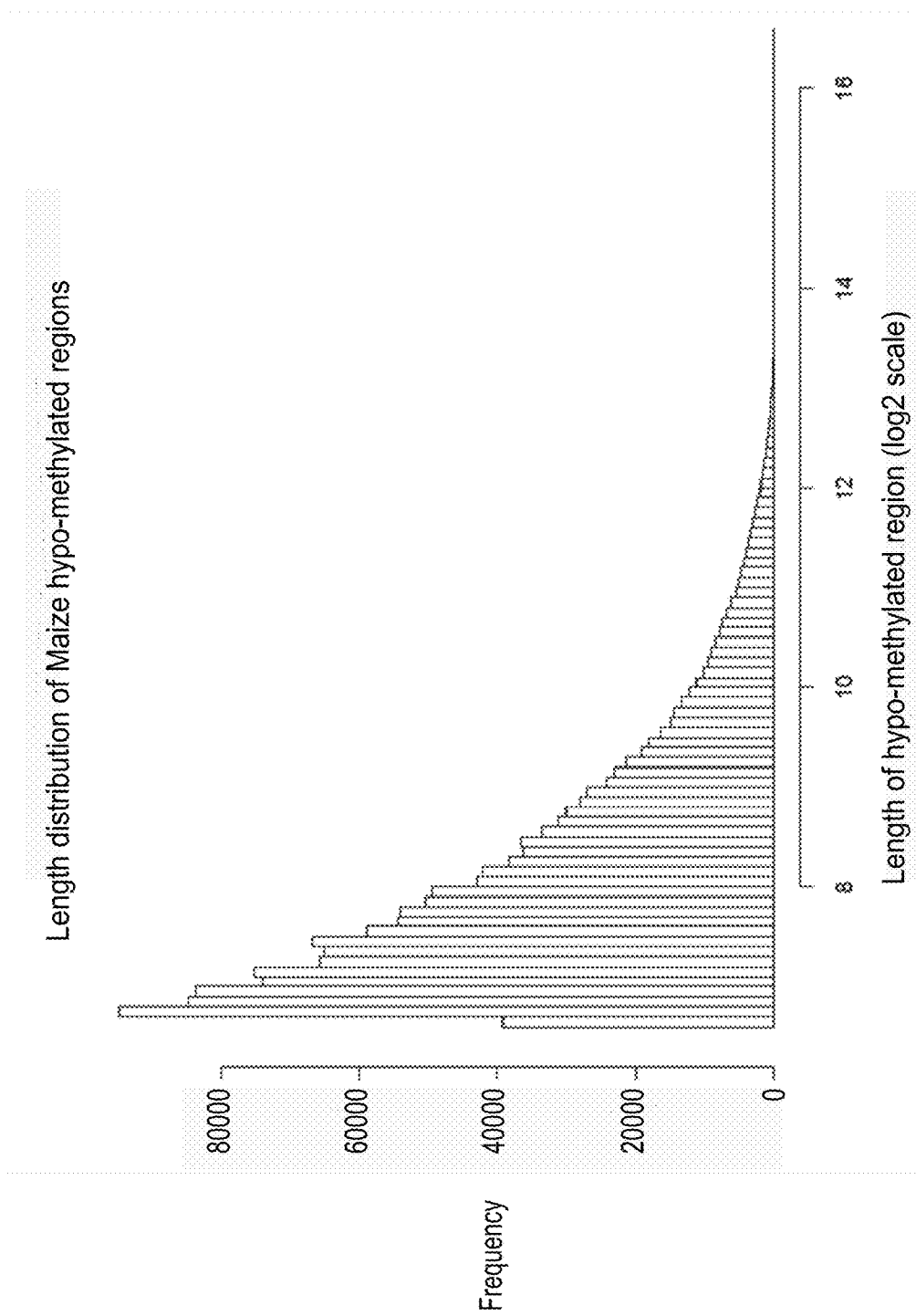
FIG. 2. Illustrates a distribution of the polynucleotide sequence lengths of the resulting hypomethylated genomic locations of the Zea mays c.v. B73 genome.

The methylation profiles established for the *Zea mays* B73 root and shoot tissues, as described above, were combined into a consensus methylation profile and used to identify hypomethylated regions in the *Zea mays* c.v. B73 genome. The resulting *Zea mays* genomic consensus methylation profile was scanned to identify genomic locations without evidence of methylation, i.e. does not contain mapped methylated reads. Stretches of genomic DNA longer than 100 bp that were hypomethylated were identified. The specific length of each of these hypomethylated regions was calculated by determining the total number of base pairs between two genomic regions that showed evidence of methylation. Table 1 summarizes the identified hypomethylated regions. In addition, a distribution of the lengths of the hypomethylated regions of the *Zea mays* c.v. B73 genome is shown in FIG. 2.

TABLE 1

| Hypomethylation profile of *Zea mays* c.v. B73 genome. | |
|---|---|
| Total *Zea mays* c.v. B73 genome size | ~2.1 Gb |
| Total combined length of hypomethylated region | ~663 Mb (31.5% of the *Zea mays* c.v. B73 genome) |
| Number of hypomethylated regions above 100 Bp | 1,564,310 |
| Number of hypomethylated regions above 1 Kb | 130,917 |
| Number of hypomethylated regions above 2 Kb | 47,045 |
| Number of hypomethylated regions above 10 Kb | 206 |
| Minimum length of hypomethylated region | 100 Bp |
| Maximum length of hypomethylated region | 90,202 Bp |

These hypomethylated regions of the *Zea mays* c.v. B73 genome were further characterized to identify and select specific genomic loci as the methylation free context of these regions indicated the presence of open chromatin. As such, all subsequent analyses were conducted on the identified hypomethylated regions.

Targetability

The hypomethylated sites identified in the *Zea mays* c.v. B73 were further analyzed to determine which sites were targetable via site specific nuclease-mediated integration of a polynucleotide donor. The *Zea mays* genome is known in the art to contain long stretches of highly repetitive DNA that are methylated and have high levels of sequence duplication. Annotation information of known repetitive regions in the *Zea mays* genome was collected from the Maize Genome Database (available at http://www.maizegdb.org/, and Lawrence, C J et al (2008) MaizeGDB: The Maize Model Organism Database for Basic, Translational, and Applied Research. Int J Plant Genomics. 2008:496957).

Accordingly, the hypomethylated sites identified above were screened to remove any sites that aligned with known repetitive regions annotated on the maize genome. The remaining hypomethylated sites that passed this first screen were subsequently scanned using a BLAST™ based homology search of a maize genomic database via the NCBI BLAST™ software (version 2.2.23) run using default parameter settings (Stephen F. Altschul et al (1997) Gapped BLAST and PSI-BLAST: a new generation of protein database search programs. *Nucleic Acids Res.* 25:3389-3402). As a result of the BLAST™ screen, any hypomethylated sites that had significant matches elsewhere in the genome, with sequence alignment coverage of over 40%, were removed from further analyses.

Agronomically Neutral or Nongenic

The hypomethylated sites identified in the *Zea mays* c.v. B73 were further analyzed to determine which sites were agronomically neutral or nongenic. As such, the hypomethylated sites described above were screened to remove any sites that overlapped or contained any known or predicted endogenous *Zea mays* c.v. B73 coding sequences. For this purpose, annotation data of known genes and mapping information of expressed sequence tag (EST) data were collected from Maize Genomic Database (available at www- .maizegdb.org and Monaco, M., et al., Maize Metabolic Network Construction and Transcriptome Analysis. doi: 10.3835/plantgenome2012.09.0025; Posted online 23 Jan. 2013). Any genomic region immediately 2 Kb upstream and 1 Kb downstream to an open reading frame were also considered. These upstream and downstream regions may contain known or unknown conserved regulatory elements that are essential for gene function. The hypomethylated sites previously described above were analyzed for the presence of the known genes (including the 2 Kb upstream and 1 Kb downstream regions) and ESTs. Any hypomethylated sites that aligned with or overlapped with known genes (including the 2 Kb upstream and 1 Kb downstream regions) or ESTs were removed from downstream analysis.

Expression

The hypomethylated sites identified in the Zea mays c.v. B73 were further analyzed to determine which sites were within proximity to an expressed maize gene. The transcript level expression of Zea mays genes was measured by analyzing transcriptome profiling data generated from Zea mays c.v. B73 root and shoot tissues using RNAseg™ technology as described in Wang et al., (2009) Genome-Wide and Organ-Specific Landscapes of Epigenetic Modifications and Their Relationships to mRNA and Small RNA Transcriptomes in Maize. Plant Cell. 21(4): 1053-1069. For each hypomethylated site, an analysis was completed to identify any annotated genes present within a 40 Kb region in proximity of the hypomethylated site, and an average expression level of the annotated gene(s) located in proximity to the hypomethylated site. Hypomethylated sites located greater than 40 Kb from an annotated gene with a non-zero average expression level were determined to not be proximal to an expressed Zea mays gene and were removed from further analyses.

Recombination

The hypomethylated sites identified in the Zea mays c.v. B73 were further analyzed to determine which sites had evidence of recombination and could facilitate introgression of the optimal genomic loci into other lines of Zea mays via conventional breeding. Diverse Zea mays genotypes are routinely crossed during conventional breeding to develop new and improved Zea mays lines containing traits of agronomic interest. As such, agronomic traits that are introgressed into optimal genomic loci within a Zea mays line via plant-mediated transformation of a transgene should be capable of further being introgressed into other Zea mays lines, especially elite lines, via meiotic recombination during conventional plant breeding. The hypomethylated sites described above were screened to identify and select sites that possessed some level of meiotic recombination. Any hypomethylated sites that were present within chromosomal regions characterized as recombination "cold-spots" were identified and removed. In Zea mays, these cold spots were defined using a high resolution marker dataset generated from multiple mapping populations. (Jafar Mammadov, Wei Chen, Anastasia Chueva, Karthik Muthuraman, Ruihua Ren, David Meyer, and Siva Kumpatla. 2011. Distribution of Recombinant Frequencies across the Maize Genome. 52$^{nd}$ Annual Maize Genetics Conference).

The meiotic recombination frequencies between any pair of Zea mays genomic markers across a chromosome were calculated based on the ratio of the genetic distance between markers (in centimorgan (cM)) to the physical distance between the markers (in megabases (Mb)). For example, if the genetic distance between a pair of markers was 1 cM and the physical distance between the same pair of markers was 2 Mb, then the calculated recombination frequency was determined to be 0.5 cM/Mb. For each hypomethylated site identified above, a pair of markers at least 1 Mb apart was chosen and the recombination frequency was calculated. Deployment of this method was used to calculate the recombination frequency of the hypomethylated sites. Any hypomethylated sites with a recombination frequency of 0.00041 cM/Mb were identified and removed from further analysis. The remaining hypomethylated regions comprising a recombination frequency greater than 0.00041 cM/Mb were selected for further analysis.

Identification of Optimal Genomic Loci

Application of the selection criteria described above resulted in the identification of a total of 52,885 optimal genomic loci from the Zea mays genome. Table 2 summarizes the lengths of the identified optimal genomic loci. These optimal genomic loci possess the following characteristics: 1) hypomethylated genomic loci greater than 1 Kb in length; 2) genomic loci that are targetable via site specific nuclease-mediated integration of a polynucleotide donor; 3) genomic loci that are agronomically neutral or nongenic; 4) genomic loci from which a transgene can be expressed; and 5) evidence of recombination within the genomic loci. Of all of the optimal genomic loci described in Table 2, only the optimal genomic loci that were greater than 1 Kb were further analyzed and utilized for targeting of a donor polynucleotide sequence. The sequences of these optimal genomic loci are disclosed as SEQ ID NO:1-SEQ ID NO:5,286. Collectively, these optimal genomic loci are locations within the Zea mays genome that can be targeted with a donor polynucleotide sequence, as further demonstrated herein below.

TABLE 2

Lists the size range of optimal genomic loci identified in the Zea mays genome that are hypomethylated, show evidence of recombination, targetable, agronomically neutral or nongenic, and are in proximity to an expressed endogenous gene.

| | |
|---|---|
| Number of optimal genomic loci larger than 100 Bp | 52,885 |
| Number of optimal genomic loci larger than 1 Kb | 5,286 |
| Number of optimal genomic loci larger than 2 Kb | 770 |
| Number of optimal genomic loci larger than 4 Kb | 16 |

Example 2: F-Distribution and Principal Component Analysis to Cluster Optimal Genomic Loci from Zea mays The 5,286 identified optimal genomic loci (SEQ ID NO: 1-SEQ ID NO: 5,286) were further analyzed using the F-distribution and Principal Component Analysis statistical methods to define a representative population and clusters for grouping of the optimal genomic loci.

F-Distribution Analysis

The identified 5,286 optimal genomic loci were statistically analyzed using a continuous probability distribution statistical analysis. As an embodiment of the continuous probability distribution statistical analysis, an F-distribution test was completed to determine a representative number of optimal genomic loci. The F-distribution test analysis was completed using equations and methods known by those with skill in the art. For more guidance, the F-distribution test analysis as described in K. M Remund, D. Dixon, D L. Wright and L R. Holden. Statistical considerations in seed purity testing for transgenic traits. Seed Science Research (2001) 11, 101-119, herein incorporated by reference, is a non-limiting example of an F-distribution test. The F-distribution test assumes random sampling of the optimal genomic loci, so that any non-valid loci are evenly distributed across the 5,286 optimal genomic loci, and that the number of optimal genomic loci sampled is 10% or less of the total population of 5,286 optimal genomic loci.

The F-distribution analysis indicated that 72 of the 5,286 optimal genomic loci provided a representative number of the 5,286 optimal genomic loci, at a 95% confidence level. Accordingly, the F-distribution analysis showed that if 72 optimal genomic loci were tested and all were targetable with a donor polynucleotide sequence, then these results would indicate that 96% or more of the 5,286 optimal genomic loci are positive at the 95% confidence level. The best estimate of validating the total percentage of the 5,286 optimal genomic loci would be if 100% of the 72 tested optimal genomic loci were targetable. Accordingly, 96% is actually the lower bound of the true percent validated at the 95% confidence level. This lower bound is based on the 0.95 quantile of the F-distribution, for the 95% confidence level. (Remund K, Dixon D, Wright D, and Holden L. Statistical considerations in seed purity testing for transgenic traits. *Seed Science Research* (2001) 11, 101-119).

Principal Component Analysis

Next, a Principal Component Analysis (PCA) statistical method was completed to further assess and visualize similarities and differences of the data set comprising the 5,286 identified optimal genomic loci to enable sampling of diverse loci for targeting validation. The PCA involves a mathematical algorithm that transforms a larger number of correlated variables into a smaller number of uncorrelated variables called principal components.

The PCA was completed on the 5,286 identified optimal genomic loci by generating a set of calculable features or attributes that could be used to describe the 5,286 identified optimal genomic loci. Each feature is numerically calculable and is defined specifically to capture the genomic and epigenomic context of the 5,286 identified optimal genomic loci. A set of 10 features for each *Zea mays* optimal genomic loci was identified and are described in greater detail below.

1. Length of the optimal genomic loci
  a. The length of the optimal genomic loci in this data set ranged from a minimum of 1,000 Bp to a maximum of 8,267 Bp.
2. Recombination frequency in a 1 MB region around the optimal genomic loci
  a. In maize, recombination frequency for a chromosomal location was defined using an internal high resolution marker dataset generated from multiple mapping populations (Jafar Mammadov, Wei Chen, Anastasia Chueva, Karthik Muthuraman, Ruihua Ren, David Meyer, and Siva Kumpatla. 2011. Distribution of Recombinant Frequencies across the Maize Genome. 52$^{nd}$ Annual Maize Genetics Conference).
  b. Recombination frequencies between any pairs of markers across the chromosome were calculated based on the ratio of the genetic distance between markers (in centimorgan (cM)) to the physical distance between the markers (in Mb). For example, if the genetic distance between a pair of markers is 1 cM and the physical distance between the same pairs of markers is 2 Mb, the calculated recombination frequency is 0.5 cM/Mb. For each optimal genomic loci, a pair of markers at least 1 Mb apart was chosen and the recombination frequency was calculated in this manner. These recombination values ranged from a minimum of 0.00041 cM/Mb to a maximum of 62.42 cM/Mb.
3. Level of optimal genomic loci sequence uniqueness
  a. For each optimal genomic loci, the nucleotide sequence of the optimal genomic loci was scanned against the *Zea mays* c.v. B73 genome using a BLAST™ based homology search using the NCBI BLAST™ software (version 2.2.23) run using the default parameter settings (Stephen F. Altschul et al (1997), "Gapped BLAST and PSI-BLAST: a new generation of protein database search programs", Nucleic Acids Res. 25:3389-3402). As these optimal genomic loci sequences are identified from the *Zea mays* c.v. B73 genome, the first BLAST™ hit identified through this search represents the *Zea mays* c.v. B73 sequence itself. The second BLAST™ hit for each optimal genomic loci sequence was identified and the alignment coverage (represented as the percent of the optimal genomic loci covered by the BLAST™ hit) of the hit was used as a measure of uniqueness of the optimal genomic loci sequence within the *Zea mays* genome. These alignment coverage values for the second BLAST™ hit ranged from a minimum of 0% to a maximum of 39.98% sequence identity. Any sequences that aligned at higher levels of sequence identity were not considered.
4. Distance from the optimal genomic loci to the closest gene in its neighborhood
  a. Gene annotation information and the location of known genes in the *Zea mays* genome were extracted from Maize Genome Database (available at, www.maizegdb.org and Monaco, M., et al., Maize Metabolic Network Construction and Transcriptome Analysis. doi: 10.3835/plantgenome2012.09.0025; Posted online 23 Jan. 2013). For each optimal genomic loci, the closest annotated gene, considering both upstream and downstream locations, was identified and the distance between the optimal genomic loci sequence and the gene was measured (in Bp). For example, if a optimal genomic locus is located in chromosome 1 from position 500 to position 1500, and the closest gene to this optimal genomic locus is located in chromosome 1 from position 2000 to position 3000, the distance from the optimal genomic loci to this closest gene is calculated to be 500 Bp. These values for all 5,286 of the optimal genomic loci dataset ranged from a minimum of 1001 Bp to a maximum of 34,809 Bp.
5. GC % in the optimal genomic loci sequence
  a. For each optimal genomic locus, the nucleotide sequence was analyzed to estimate the number of Guanine and Cytosine bases present. This count was represented as a percentage of the sequence length of each optimal genomic locus and provides a measure for GC %. These GC % values for the maize optimal genomic loci dataset range from 25.17% to 68.3%.
6. Number of genes in a 40 Kb neighborhood around the optimal genomic loci sequence
  a. Gene annotation information and the location of known genes in the *Zea mays* c.v. B73 genome were extracted from Maize Genome Database. For each of the 5,286 optimal genomic loci sequence, a 40 Kb window around the optimal genomic loci sequence was defined and the number of annotated genes with locations overlapping this window was counted. These values ranged from a minimum of 1 gene to a maximum of 9 genes within the 40 Kb neighborhood.
7. Average gene expression in a 40 Kb neighborhood around the optimal genomic loci
  a. Transcript level expression of maize genes was measured by analyzing available transcriptome profiling data generated from *Zea mays* c.v. B73 root and shoot tissues using RNAseq™ technology (Mortazavi, A. et al., Mapping and quantifying mammalian transcriptomes by RNA-Seq. *Nat. Methods.* 5, 621-628 (2008); Wang et al., Genome-Wide and Organ-Specific Landscapes of Epigenetic Modifications and Their Relationships to mRNA and Small RNA Transcriptomes in Maize. *Plant Cell.* 2009 April; 21(4): 1053-1069). Gene annotation information and the location of known genes in the *Zea mays* c.v. B73 genome were extracted from Maize Genome Database For each optimal genomic locus, annotated genes within the *Zea mays* c.v. B73 genome that were present in a 40 Kb neighborhood around the optimal genomic loci were identified. Expression levels for each of the genes were extracted from the transcriptome profiles described in the above referenced citations and an average gene expression level was calculated. Expression values of all genes within the genome of *Zea mays* vary greatly. The minimum expression value is 0 and the maximum expression value is 2511.397, with a mean expression value of 18.489 and a median expression value of 3.604. The average expression values for all of the 5,286 optimal genomic loci dataset ranged from a minimum of 0.00369 to a maximum of 2233.06.

8. Level of nucleosome occupancy around the optimal genomic loci
  a. Understanding the level of nucleosome occupancy for a particular nucleotide sequence provides information about chromosomal functions and the genomic context of the sequence. The NuPoP™ statistical package was used to predict the nucleosome occupancy and the most probable nucleosome positioning map for any size of genomic sequences (Xi, L., Fondufe-Mittendor, Y., Xia, L., Flatow, J., Widom, J. and Wang, J.-P., Predicting nucleosome positioning using a duration Hidden Markov Model, BMC *Bioinformatics*, 2010, doi: 10.1186/1471-2105-11-346.). For each of the 5,286 optimal genomic loci, the nucleotide sequence was submitted for analysis with the NuPoP™ software and a nucleosome occupancy score was calculated. These nucleosome occupancy scores for the maize optimal genomic loci dataset ranged from a minimum of 0 to a maximum of 0.962.

9. Relative location within the chromosome (proximity to centromere)
  a. A centromere is a region on a chromosome that joins two sister chromatids. The portions of a chromosome on either side of the centromere are known as chromosomal arms. Genomic locations of centromeres on all 10 Maize chromosomes were identified in the published *Zea mays* c.v. B73 reference sequence (Schnable, P., et al., (2009) The B73 maize genome: complexity, diversity and dynamics. *Science*, 326 (5956): 1112-1115). Information on the position of the centromere in each of the *Zea mays* chromosomes and the lengths of the chromosome arms was extracted from Maize Genome Database. For each optimal genomic locus, the genomic distance from the optimal genomic locus sequence to the centromere of the chromosome that it is located on, is measured (in Bp). The relative location of optimal genomic loci within the chromosome is represented as the ratio of its genomic distance to the centromere relative to the length of the specific chromosomal arm that it lies on. These relative location values for the maize optimal genomic loci dataset ranged from a minimum of 0.00373 to a maximum of 0.99908 ratio of genomic distance.

10. Number of optimal genomic loci in a 1 Mb region
  a. For each optimal genomic loci, a 1 Mb genomic window around the optimal genomic loci location was defined and the number of other, additional optimal genomic loci present within or overlapping this region were calculated, including the optimal genomic loci under consideration. The number of optimal genomic loci in a 1 Mb ranged from a minimum of 1 to a maximum of 22.

All of the 5,286 optimal genomic loci were analyzed using the features and attributes described above. The results or values for the score of the features and attributes of each optimal genomic locus are further described in Table 3 (herein incorporated by reference as a separate electronic filing). The resulting dataset was used in the PCA statistical method to cluster the 5,286 identified optimal genomic loci into clusters. During the clustering process, after estimating the "p" principle components of the optimal genomic loci, the assignment of the optimal genomic loci to one of the 32 clusters proceeded in the "p" dimensional Euclidean space. Each of the "p" axes was divided into "k" intervals. Optimal genomic loci assigned to the same interval were grouped together to form clusters. Using this analysis, each PCA axis was divided into two intervals, which was chosen based on a priori information regarding the number of clusters required for experimental validation. All analysis and the visualization of the resulting clusters were carried out with the Molecular Operating Environment™ (MOE) software from Chemical Computing Group Inc. (Montreal, Quebec, Canada).

The PCA approach was used to cluster the set of 5,286 identified optimal genomic loci into 32 distinct clusters based on their feature values, described above. During the PCA process, five principal components (PC) were generated, with the top three PCs containing about 90% of the total variation in the dataset (Table 4). These three PCAs were used to graphically represent the 32 clusters in a three dimensional plot (FIG. 3). After the clustering process, was completed, one representative optimal genomic locus was chosen from each cluster. This was performed by choosing a select optimal genomic locus, within each cluster, that was closest to the centroid of that cluster (Table 4). The chromosomal locations of the 32 representative optimal genomic loci are uniformly distributed among the 10 maize chromosomes and are not biased toward any particular genomic location, as shown in FIG. 4.

TABLE 4

Description of the 32 maize representative optimal genomic loci identified from the PCA

| Optimal Genomic Loci Name | Genomic Location | Length (Bp) | Cluster Number | SEQ ID NO: |
| --- | --- | --- | --- | --- |
| optimal_loci_59517_G1 | chr2: 43352132 . . . 43353146 | 1015 | 1 | 1 |
| optimal_loci_159525_G1 | chr4: 172518643 . . . 172519712 | 1070 | 2 | 199 |

TABLE 4-continued

Description of the 32 maize representative optimal genomic loci identified from the PCA

| Optimal Genomic Loci Name | Genomic Location | Length (Bp) | Cluster Number | SEQ ID NO: |
|---|---|---|---|---|
| optimal_loci_9811_G1 | chr1: 52159463 . . . 52161841 | 2379 | 3 | 365 |
| optimal_loci_7507_G1 | chr1: 39334848 . . . 39337271 | 2424 | 4 | 543 |
| optimal_loci_178978_G1 | chr5: 35776311 . . . 35777560 | 1250 | 5 | 687 |
| optimal_loci_285621_G1 | chr8: 118321357 . . . 118322528 | 1172 | 6 | 875 |
| optimal_loci_221721_G1 | chr6: 91309097 . . . 91311722 | 2626 | 7 | 1089 |
| optimal_loci_83937_G1 | chr2: 192746622 . . . 192748862 | 2241 | 8 | 1233 |
| optimal_loci_37146_G1 | chr1: 223833176 . . . 223834563 | 1388 | 9 | 1369 |
| optimal_loci_156393_G1 | chr4: 154313884 . . . 154315253 | 1370 | 10 | 1571 |
| optimal_loci_343678_G1 | chr10: 113837795 . . . 113839503 | 1709 | 11 | 1795 |
| optimal_loci_60209_G1 | chr2: 47513705 . . . 47515145 | 1441 | 12 | 1980 |
| optimal_loci_282323_G1 | chr8: 100763204 . . . 100764398 | 1195 | 13 | 2171 |
| optimal_loci_64542_G1 | chr2: 72203716 . . . 72205045 | 1330 | 14 | 2349 |
| optimal_loci_162531_G1 | chr4: 189896984 . . . 189899332 | 2349 | 15 | 2557 |
| optimal_loci_337001_G1 | chr10: 77188319 . . . 77190007 | 1689 | 16 | 2693 |
| optimal_loci_66202_G1 | chr2: 83483805 . . . 83484909 | 1105 | 17 | 2855 |
| optimal_loci_185454_G1 | chr5: 80270170 . . . 80271254 | 1085 | 18 | 3004 |
| optimal_loci_239863_G1 | chr7: 14997553 . . . 14999296 | 1744 | 19 | 3151 |
| optimal_loci_257541_G1 | chr7: 125978470 . . . 125980969 | 2500 | 20 | 3289 |
| optimal_loci_217939_G1 | chr6: 67227678 . . . 67228708 | 1031 | 21 | 3455 |
| optimal_loci_326869_G1 | chr10: 12348441 . . . 12349499 | 1059 | 22 | 3586 |
| optimal_loci_31710_G1 | chr1: 194939396 . . . 194943360 | 3965 | 23 | 3731 |
| optimal_loci_81941_G1 | chr2: 181418576 . . . 181421181 | 2606 | 24 | 3849 |
| optimal_loci_198387_G1 | chr5: 164712378 . . . 164713567 | 1190 | 25 | 3981 |
| optimal_loci_197372_G1 | chr5: 158680601 . . . 158681681 | 1081 | 26 | 4192 |
| optimal_loci_106202_G1 | chr3: 85647138 . . . 85648635 | 1498 | 27 | 4401 |
| optimal_loci_232228_G1 | chr6: 144719567 . . . 144723469 | 3903 | 28 | 4529 |
| optimal_loci_244324_G1 | chr7: 40299412 . . . 40300584 | 1173 | 29 | 4646 |
| optimal_loci_157315_G1 | chr4: 158710709 . . . 158711983 | 1275 | 30 | 4836 |
| optimal_loci_137489_G1 | chr4: 29898267 . . . 29899725 | 1459 | 31 | 5046 |
| optimal_loci_31764_G1 | chr1: 195178584 . . . 195182163 | 3580 | 32 | 5162 |

Figure 5:
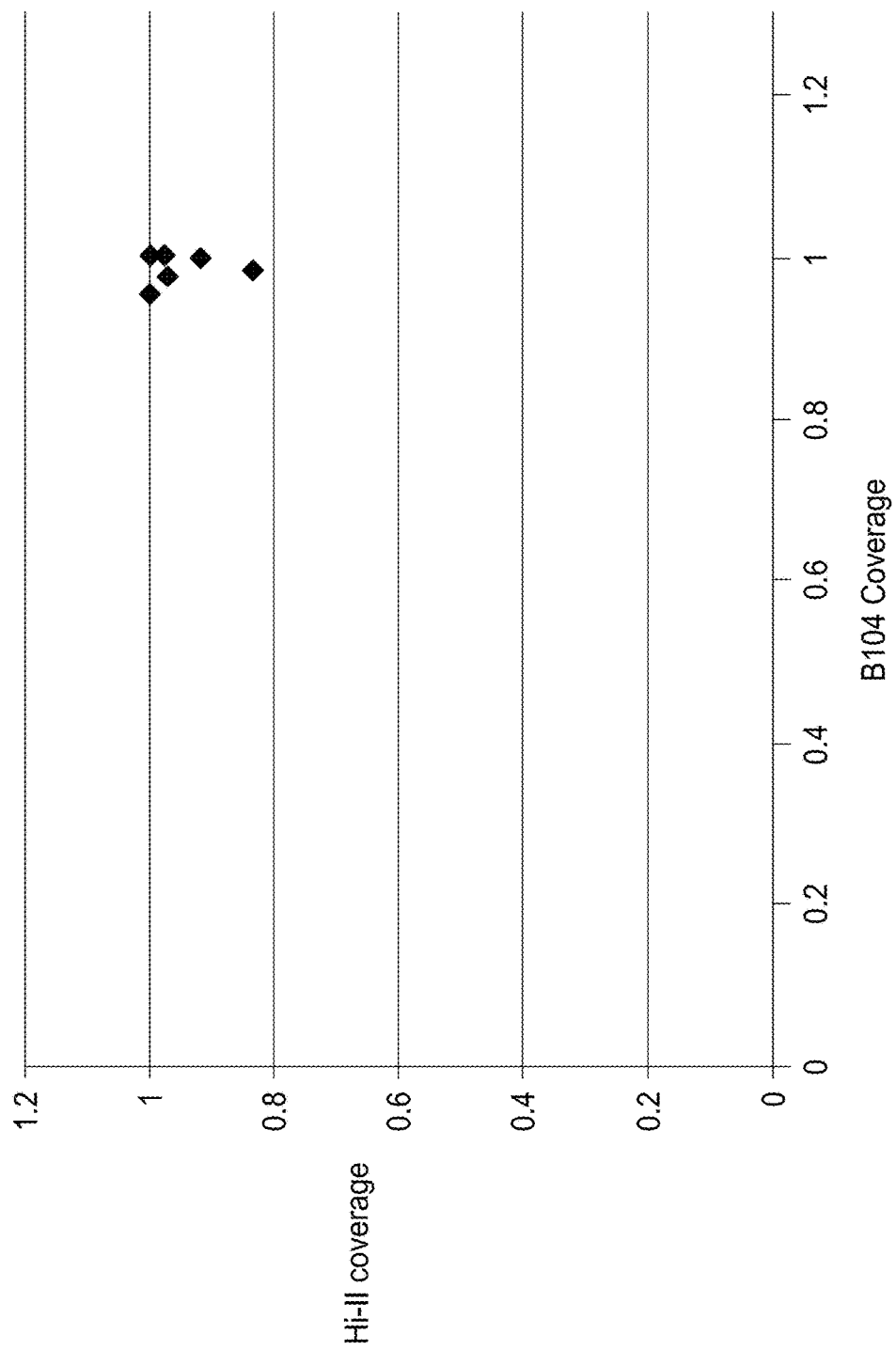
FIG. 5. Provides a graph showing the coverage of the 72 optimal genomic loci within Zea mays c.v. B104 and c.v.Hi-II genomic databases that were selected for targeting validation.
Figure 6:
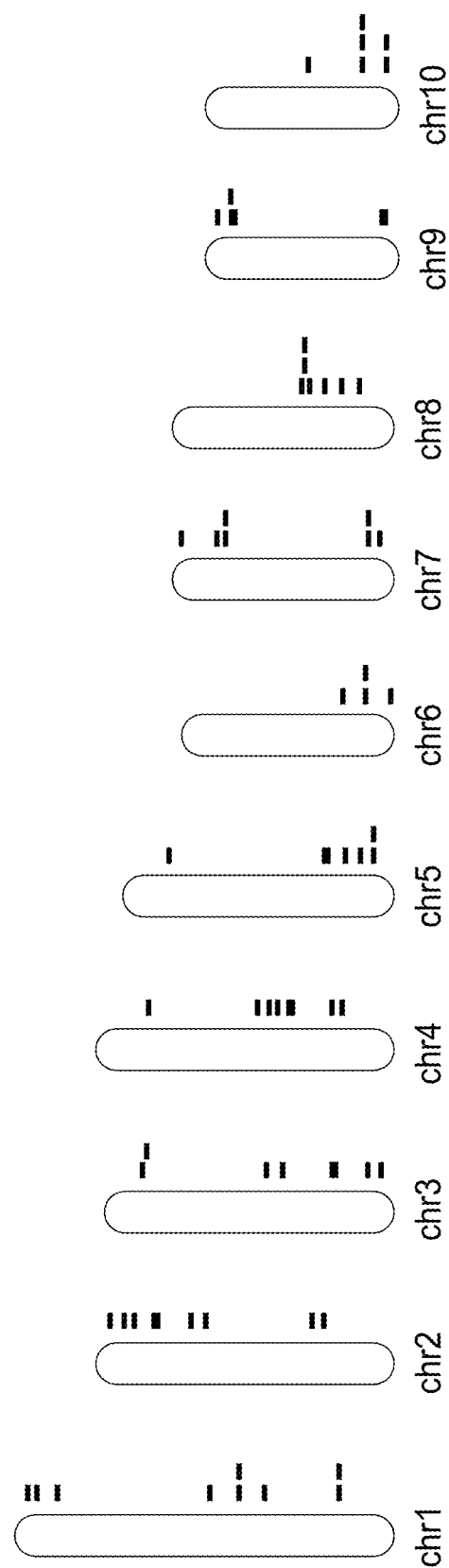
FIG. 6. Provides a schematic drawing indicating the Zea mays chromosomal location of 72 optimal genomic loci selected for targeting validation.

Final Selection of 72 Genomic Loci for Targeting of a Polynucleotide Donor Polynucleotide Sequence A total of 72 genomic loci were identified and selected for targeting with a donor polynucleotide sequence from the 5,286 genomic loci that were clustered within 32 distinct clusters. For each of the 32 clusters, a representative genomic locus (32 representative genomic loci that were closest to the centroid of that cluster as described above in Table 4) and an additional genomic locus within each cluster were chosen. The additional optimal genomic loci were selected by first screening all of the 5,286 selected optimal genomic sequences against a whole genome database consisting of genomic DNA sequence data for both *Zea mays* c.v. Hi-II (targeting screening line) and *Zea mays* c.v. B104 (transformation line) to determine the coverage (how many optimal genomic loci were present in both genomes) and percentage of sequence identity in the genome from both lines. The additional optimal genomic loci with 100% coverage (the entire sequence length of the optimal loci aligned between both genomes) and 100% identity in both the Hi-II and B104 genomic databases were selected for targeting validation (FIG. 5). Comparatively, a small number of the representative genomic loci had sequence identity that was less than 100% coverage and identity in both the Hi-II and B104 genomic database (FIG. 5). Other criteria such as genomic loci size, extent of uniqueness, GC % content and chromosomal distribution of the optimal genomic loci were also taken into consideration in selecting the additional optimal genomic loci. The chromosomal location of the 72 selected optimal genomic loci and the specific genomic configuration of each *Zea mays* optimal genomic loci are shown in FIG. 6 and Table 5, respectively.

TABLE 5

Description of the maize selected optimal genomic loci chosen for targeting validation. From these optimal genomic loci listed in this table, 72 maize optimal genomic loci are representative of the identified total of 5,286 maize selected optimal genomic loci.

| Optimal Genomic Loci Name | Genomic Location | Length (bp) | Cluster Number | SEQ ID NO: |
|---|---|---|---|---|
| optimal_loci_59517_G1 | chr2: 43352132 . . . 43353146 | 1015 | 1 | 1 |
| optimal_loci_25001_G1 | chr1: 151371224 . . . 151372260 | 1037 | 1 | 100 |
| optimal_loci_112632_G1 | chr3: 128098856 . . . 128100257 | 1402 | 2 | 203 |
| optimal_loci_28905_G1 | chr1: 177037718 . . . 177038919 | 1202 | 2 | 295 |
| optimal_loci_129164_G1 | chr3: 221246027 . . . 221247542 | 1516 | 3 | 384 |
| optimal_loci_204726_G1 | chr5: 200665730 . . . 200670667 | 4938 | 3 | 424 |
| optimal_loci_2425_G1 | chr1: 12810845 . . . 12814490 | 3646 | 3 | 451 |
| optimal_loci_122036_G1 | chr3: 184608166 . . . 184609697 | 1532 | 4 | 547 |
| optimal_loci_5735_G1 | chr1: 29190279 . . . 29192844 | 2566 | 4 | 671 |
| optimal_loci_178978_G1 | chr5: 35776311 . . . 35777560 | 1250 | 5 | 687 |
| optimal_loci_288388_G1 | chr8: 133290442 . . . 133291481 | 1040 | 5 | 781 |
| optimal_loci_60310_G1 | chr2: 47967092 . . . 47968271 | 1180 | 5 | 843 |
| optimal_loci_285621_G1 | chr8: 118321357 . . . 118322528 | 1172 | 6 | 875 |

TABLE 5-continued

Description of the maize selected optimal genomic loci chosen for targeting validation. From these optimal genomic loci listed in this table, 72 maize optimal genomic loci are representative of the identified total of 5,286 maize selected optimal genomic loci.

| Optimal Genomic Loci Name | Genomic Location | Length (bp) | Cluster Number | SEQ ID NO: |
|---|---|---|---|---|
| optimal_loci_243330_G1 | chr7: 34630402 . . . 34631577 | 1176 | 6 | 967 |
| optimal_loci_127038_G1 | chr3: 210603611 . . . 210605198 | 1588 | 7 | 1107 |
| optimal_loci_262784_G1 | chr7: 155767046 . . . 155769049 | 2004 | 7 | 1147 |
| optimal_loci_344662_G1 | chr10: 119131667 . . . 119133955 | 2289 | 7 | 1190 |
| optimal_loci_153894_G1 | chr4: 139979597 . . . 139981225 | 1629 | 8 | 1252 |
| optimal_loci_28771_G1 | chr1: 176062139 . . . 176063611 | 1473 | 8 | 1300 |
| optimal_loci_1098_G1 | chr1: 5582601 . . . 5583834 | 1234 | 9 | 1371 |
| optimal_loci_97772_G1 | chr3: 30209253 . . . 30210607 | 1355 | 9 | 1569 |
| optimal_loci_156393_G1 | chr4: 154313884 . . . 154315253 | 1370 | 10 | 1571 |
| optimal_loci_236662_G1 | chr6: 165975716 . . . 165977010 | 1295 | 10 | 1663 |
| optimal_loci_139485_G1 | chr4: 42804231 . . . 42805751 | 1521 | 11 | 1822 |
| optimal_loci_301175_G1 | chr9: 20325171 . . . 20326621 | 1451 | 11 | 1906 |
| optimal_loci_152337_G1 | chr4: 130033092 . . . 130035481 | 2390 | 12 | 2003 |
| optimal_loci_202616_G1 | chr5: 188822901 . . . 188824814 | 1914 | 12 | 2027 |
| optimal_loci_203704_G1 | chr5: 194836270 . . . 194840217 | 3948 | 12 | 2033 |
| optimal_loci_282323_G1 | chr8: 100763204 . . . 100764398 | 1195 | 13 | 2171 |
| optimal_loci_262782_G1 | chr7: 155759080 . . . 155760097 | 1018 | 13 | 2256 |
| optimal_loci_64542_G1 | chr2: 72203716 . . . 72205045 | 1330 | 14 | 2349 |
| optimal_loci_236455_G1 | chr6: 164795991 . . . 164797027 | 1037 | 14 | 2428 |
| optimal_loci_162531_G1 | chr4: 189896984 . . . 189899332 | 2349 | 15 | 2557 |
| optimal_loci_301774_G1 | chr9: 23468085 . . . 23470278 | 2194 | 15 | 2632 |
| optimal_loci_344663_G1 | chr10: 119143167 . . . 119144795 | 1629 | 15 | 2649 |
| optimal_loci_337001_G1 | chr10: 77188319 . . . 77190007 | 1689 | 16 | 2693 |
| optimal_loci_204637_G1 | chr5: 200298202 . . . 200301414 | 3213 | 16 | 2731 |
| optimal_loci_238100_G1 | chr7: 4899227 . . . 4900708 | 1482 | 16 | 2753 |
| optimal_loci_66202_G1 | chr2: 83483805 . . . 83484909 | 1105 | 17 | 2855 |
| optimal_loci_264359_G1 | chr7: 163504241 . . . 163505487 | 1247 | 17 | 2934 |
| optimal_loci_282653_G1 | chr8: 102704765 . . . 102705924 | 1160 | 18 | 3086 |
| optimal_loci_80282_G1 | chr2: 173420834 . . . 173421870 | 1037 | 18 | 3139 |
| optimal_loci_291068_G1 | chr8: 148277606 . . . 148279985 | 2380 | 19 | 3230 |
| optimal_loci_56395_G1 | chr2: 24801482 . . . 24803132 | 1651 | 19 | 3270 |
| optimal_loci_200497_G1 | chr5: 176879526 . . . 176881345 | 1820 | 20 | 3334 |
| optimal_loci_232222_G1 | chr6: 144700575 . . . 144702126 | 1552 | 20 | 3357 |
| optimal_loci_43577_G1 | chr1: 256469704 . . . 256472666 | 2963 | 20 | 3428 |
| optimal_loci_5607_G1 | chr1: 28613065 . . . 28615113 | 2049 | 20 | 3435 |
| optimal_loci_114664_G1 | chr3: 140106950 . . . 140108061 | 1112 | 21 | 3457 |
| optimal_loci_228254_G1 | chr6: 126085629 . . . 126086823 | 1195 | 21 | 3497 |
| optimal_loci_120993_G1 | chr3: 179419306 . . . 179420357 | 1052 | 22 | 3593 |
| optimal_loci_53137_G1 | chr2: 7304197 . . . 7305496 | 1300 | 22 | 3702 |
| optimal_loci_31710_G1 | chr1 : 194939396 . . . 194943360 | 3965 | 23 | 3731 |
| optimal_loci_344664_G1 | chr10: 119144946 . . . 119146850 | 1905 | 23 | 3815 |
| optimal_loci_81941_G1 | chr2: 181418576 . . . 181421181 | 2606 | 24 | 3849 |
| optimal_loci_321514_G1 | chr9: 140776147 . . . 140777584 | 1438 | 24 | 3939 |
| optimal_loci_198387_G1 | chr5: 164712378 . . . 164713567 | 1190 | 25 | 3981 |
| optimal_loci_301180_G1 | chr9: 20328932 . . . 20330129 | 1198 | 25 | 4113 |
| optimal_loci_197372_G1 | chr5: 158680601 . . . 158681681 | 1081 | 26 | 4192 |
| optimal_loci_348776_G1 | chr10: 142097590 . . . 142098803 | 1214 | 26 | 4350 |
| optimal_loci_244439_G1 | chr7: 41068791 . . . 41070248 | 1458 | 27 | 4458 |
| optimal_loci_348258_G1 | chr10: 139297032 . . . 139298517 | 1486 | 27 | 4487 |
| optimal_loci_232228_G1 | chr6: 144719567 . . . 144723469 | 3903 | 28 | 4529 |
| optimal_loci_322501_G1 | chr9: 146078534 . . . 146080201 | 1668 | 28 | 4610 |
| optimal_loci_244324_G1 | chr7: 40299412 . . . 40300584 | 1173 | 29 | 4646 |
| optimal_loci_97232_G1 | chr3: 27463016 . . . 27464143 | 1128 | 29 | 4832 |
| optimal_loci_157315_G1 | chr4: 158710709 . . . 158711983 | 1275 | 30 | 4836 |
| optimal_loci_282499_G1 | chr8: 101771408 . . . 101772767 | 1360 | 30 | 4953 |
| optimal_loci_155031_G1 | chr4: 146991391 . . . 146993137 | 1747 | 31 | 5060 |
| optimal_loci_301773_G1 | chr9: 23465509 . . . 23467762 | 2254 | 31 | 5110 |
| optimal_loci_283161_G1 | chr8: 105321958 . . . 105323571 | 1614 | 32 | 5213 |
| optimal_loci_55524_G1 | chr2: 20099003 . . . 20100485 | 1483 | 32 | 5264 |
| optimal_loci_127268_G1 | chr3: 211767898 . . . 211770046 | 2149 | 16 | 2709 |
| optimal_loci_136086_G1 | chr4: 22531506 . . . 22534989 | 3484 | 27 | 4425 |
| optimal_loci_232484_G1 | chr6: 146122164 . . . 146125580 | 3417 | 12 | 2053 |
| optimal_loci_203075_G1 | chr5: 191370802 . . . 191374627 | 3826 | 12 | 2030 |
| optimal_loci_3733_G1 | chr1: 19232372 . . . 19235997 | 3626 | 11 | 1923 |
| optimal_loci_168286_G1 | chr4: 219987223 . . . 219990695 | 3473 | 4 | 573 |
| optimal_loci_128078_G1 | chr3: 215482594 . . . 215485640 | 3047 | 4 | 560 |
| optimal_loci_265551_G1 | chr7: 170127188 . . . 170130734 | 3547 | 3 | 463 |
| optimal_ loci_137693_G1 | chr4: 31118968 . . . 31122359 | 3392 | 3 | 387 |

A large suite of 5,286 genomic locations have been identified in the *Zea mays* genome as optimal genomic loci for targeting with a donor polynucleotide sequence using precision genome engineering technologies. A statistical analysis approach was deployed to group the 5,286 selected genomic loci into 32 clusters with similar genomic contexts, and to identify a subset of 72 selected genomic loci representative of the set of 5,286 selected genomic loci. The 72 representative loci were validated as optimal genomic loci via targeting with a donor polynucleotide sequence. By performing the PCA statistical analysis for the numerical values generated for the ten sets of features or attributes that are described above, the ten features or attributes were computed into PCA components of fewer dimensions. As such, PCA components were reduced into five dimensions that are representative of the ten features or attributes described above (Table 6). Each PCA component is equivalent to a combination of the ten features or attributes described above. From these PCA components comprising five dimensions, as computed using the PCA statistical analysis, the 32 clusters were determined.

TABLE 6

The five PCA components (PCA1, PCA2, PCA3, PCA4, and PCA5) that define each of the 32 clusters and the sequences (SEQ ID NO: 1-SEQ ID NO: 5286) which make up each cluster. These five dimensions are representative of the ten features or attributes described above that were used to identify the optimal genomic loci. The minimum (Min), mean, median and maximum (Max) values for each PCA component are provided.

| | | Cluster1 (SEQ ID NO: 1 -- SEQ ID NO: 198) | Cluster2 (SEQ ID NO: 199 -- SEQ ID NO: 364) | Cluster3 (SEQ ID NO: 365 -- SEQ ID NO: 542) | Cluster4 (SEQ ID NO: 543 -- SEQ ID NO: 686) | Cluster5 (SEQ ID NO: 687 -- SEQ ID NO: 874) | Cluster6 (SEQ ID NO: 875 -- SEQ ID NO: 1088) | Cluster7 (SEQ ID NO: 1089 -- SEQ ID NO: 1232) | Cluster8 (SEQ ID NO: 1233 -- SEQ ID NO: 1368) | Cluster9 (SEQ ID NO: 1369 -- SEQ ID NO: 1570) | Cluster10 (SEQ ID NO: 1571 -- SEQ ID NO: 1794) | Cluster11 (SEQ ID NO: 1795 -- SEQ ID NO: 1979) | Cluster12 (SEQ ID NO: 1980 -- SEQ ID NO: 2170) | Cluster13 (SEQ ID NO: 2171 -- SEQ ID NO: 2348) |
|---|---|---|---|---|---|---|---|---|---|---|---|---|---|---|
| PCA1 | Min | -0.38899 | -0.93177 | -0.39537 | -0.93241 | -0.39582 | -0.93174 | -0.38719 | -0.93217 | -0.38101 | -0.93175 | -0.39194 | -0.93253 | -0.38415 |
| | Mean | 0.73994 | -0.70291 | 0.797903 | -0.72366 | 0.696907 | -0.70419 | 0.759996 | -0.69832 | 0.799943 | -0.71434 | 0.770295 | -0.73093 | 0.655148 |
| | Median | 0.444732 | -0.72051 | 0.581978 | -0.72065 | 0.41229 | -0.72032 | 0.468691 | -0.71729 | 0.546926 | -0.72051 | 0.347427 | -0.72075 | 0.31035 |
| | Max | 3.016652 | -0.40085 | 3.06313 | -0.40153 | 3.823763 | -0.40276 | 3.007282 | -0.40162 | 4.260435 | -0.41456 | 3.072388 | -0.402 | 3.054517 |
| PCA2 | Min | 0.200459 | 0.211002 | -9.82023 | -5.15632 | 0.200591 | 0.233367 | -4.04364 | -4.90205 | 0.204949 | 0.205064 | -5.36888 | -6.75555 | 0.206839 |
| | Mean | 0.607958 | 0.651683 | -0.77754 | -0.94886 | 0.62733 | 0.640492 | -0.7257 | -0.69802 | 0.613344 | 0.639532 | -1.0031 | -1.01406 | 0.618082 |
| | Median | 0.616048 | 0.69582 | -0.4007 | -0.60703 | 0.654722 | 0.662685 | -0.5115 | -0.48357 | 0.642703 | 0.673247 | -0.52447 | -0.66079 | 0.639485 |
| | Max | 0.941211 | 0.950602 | 0.188311 | 0.193638 | 0.933845 | 0.95102 | 0.194718 | 0.193615 | 0.950028 | 0.956661 | 0.197865 | 0.193687 | 0.950172 |
| PCA3 | Min | -0.19912 | -0.19998 | -0.19915 | -0.19817 | -0.3145 | -0.32531 | -0.30392 | -0.31372 | -0.19958 | -0.19843 | -0.19868 | -0.19755 | -0.31583 |
| | Mean | 0.251544 | 0.348751 | 0.153077 | 0.230562 | -0.26578 | -0.28236 | -0.25128 | -0.26153 | 0.244656 | 0.257424 | 0.121116 | 0.22983 | -0.2653 |
| | Median | -0.02809 | -0.04129 | -0.02763 | -0.01853 | -0.26978 | -0.28873 | -0.2537 | -0.26577 | -0.02402 | -0.02638 | -0.05745 | -0.02841 | -0.26895 |
| | Max | 6.481119 | 34.90501 | 11.24551 | 10.67521 | -0.20057 | -0.20094 | -0.20105 | -0.20248 | 5.739189 | 11.2077 | 3.384549 | 16.92247 | -0.20086 |
| PCA4 | Min | -0.39542 | -0.39731 | -0.39369 | -0.39886 | -0.37619 | -0.37126 | -0.39716 | -0.39684 | -1.25027 | -1.22084 | -1.21449 | -1.13853 | -1.24332 |
| | Mean | 1.030652 | 0.94334 | 0.839835 | 0.728573 | 1.088658 | 1.125488 | 0.837988 | 0.867379 | -0.881 | -0.83045 | -0.8525 | -0.80304 | -0.87789 |
| | Median | 0.956571 | 0.843296 | 0.664549 | 0.334136 | 1.025711 | 1.062969 | 0.491677 | 0.598316 | -0.87578 | -0.82491 | -0.84403 | -0.81514 | -0.89279 |
| | Max | 2.82969 | 2.82634 | 2.890302 | 2.848484 | 2.875967 | 2.891137 | 2.869785 | 2.792003 | -0.41074 | -0.40079 | -0.43247 | -0.41111 | -0.4172 |
| PCA5 | Min | -0.19722 | -0.19899 | -0.18939 | -0.1958 | -0.1959 | -0.1976 | -0.19078 | -0.19095 | -0.19058 | -0.18616 | -0.19615 | -0.18815 | -0.196 |
| | Mean | 0.692886 | 0.757261 | 0.642033 | 0.698495 | 0.682658 | 0.693974 | 0.661659 | 0.618725 | 0.84803 | 0.77689 | 0.822063 | 0.791532 | 0.824284 |
| | Median | 0.537914 | 0.609134 | 0.438727 | 0.587864 | 0.500322 | 0.514611 | 0.457563 | 0.432322 | 0.775864 | 0.59967 | 0.802156 | 0.730284 | 0.795933 |
| | Max | 2.938322 | 4.205435 | 2.765824 | 2.808973 | 4.140417 | 2.995524 | 3.446518 | 2.711293 | 2.760305 | 2.593518 | 2.351784 | 2.947057 | 2.67123 |

| | | Cluster14 (SEQ ID NO: 2349 -- SEQ ID NO: 2556) | Cluster15 (SEQ ID NO: 2557 -- SEQ ID NO: 2692) | Cluster16 (SEQ ID NO: 2693 -- SEQ ID NO: 2854) | Cluster17 (SEQ ID NO: 2854 -- SEQ ID NO: 3003) | Cluster18 (SEQ ID NO: 3004 -- SEQ ID NO: 3150) | Cluster19 (SEQ ID NO: 3151 -- SEQ ID NO: 3288) | Cluster20 (SEQ ID NO: 3289 -- SEQ ID NO: 3455) | Cluster21 (SEQ ID NO: 3456 -- SEQ ID NO: 3585) | Cluster22 (SEQ ID NO: 3586 -- SEQ ID NO: 3730) |
|---|---|---|---|---|---|---|---|---|---|---|
| PCA1 | Min | -1.03449 | -0.3984 | -0.93226 | -0.4 | -0.93176 | -0.3845 | -0.93215 | -0.39456 | -0.93174 |
| | Mean | -0.70636 | 0.519692 | -0.72131 | 0.788093 | -0.72141 | 0.822434 | -0.7062 | 0.648476 | -0.71986 |
| | Median | -0.72054 | 0.149839 | -0.72068 | 0.474147 | -0.72052 | 0.469551 | -0.72007 | 0.373243 | -0.72054 |
| | Max | -0.40125 | 2.973061 | -0.4106 | 3.076914 | -0.4042 | 3.022389 | -0.40471 | 2.902287 | -0.41693 |
| PCA2 | Min | 0.206354 | -4.6237 | -4.17636 | 0.201471 | 0.200304 | -12.4583 | -5.15079 | 0.202767 | 0.202637 |
| | Mean | 0.613673 | -0.71726 | -0.89472 | 0.585603 | 0.656596 | -0.99953 | -0.84736 | 0.618663 | 0.60694 |
| | Median | 0.642803 | -0.38947 | -0.58265 | 0.600619 | 0.671923 | -0.69949 | -0.41126 | 0.650056 | 0.588239 |
| | Max | 0.955582 | 0.178297 | 0.199158 | 0.947875 | 0.957912 | 0.189554 | 0.199151 | 0.949085 | 0.95292 |
| PCA3 | Min | -0.3256 | -0.30535 | -0.31509 | -0.19941 | -0.19977 | -0.19819 | -0.19983 | -0.31601 | -0.32437 |
| | Mean | -0.27114 | -0.2528 | -0.26165 | 0.635893 | 0.335092 | 0.188191 | 0.219518 | -0.27138 | -0.27931 |
| | Median | -0.27173 | -0.25626 | -0.26456 | -0.04339 | 0.008014 | -0.04381 | -0.04394 | -0.27672 | -0.29129 |
| | Max | -0.20023 | -0.20007 | -0.20018 | 34.91703 | 8.740083 | 7.182482 | 13.78985 | -0.20023 | -0.20086 |

TABLE 6-continued

The five PCA components (PCA1, PCA2, PCA3, PCA4, and PCA5) that define each of the 32 clusters and the sequences (SEQ ID NO: 1-SEQ ID NO: 5286) which make up each cluster. These five dimensions are representative of the ten features or attributes described above that were used to identify the optimal genomic loci. The minimum (Min), mean, median and maximum (Max) values for each PCA component are provided.

| | | Cluster23 (SEQ ID NO: 3731 -- SEQ ID NO: 3848) | Cluster24 (SEQ ID NO: 3849 -- SEQ ID NO: 3980) | Cluster25 (SEQ ID NO: 3981 -- SEQ ID NO: 4191) | Cluster26 (SEQ ID NO: 4192 -- SEQ ID NO: 4400) | Cluster27 (SEQ ID NO: 4401 -- SEQ ID NO: 4528) | Cluster28 (SEQ ID NO: 4529 -- SEQ ID NO: 4645) | Cluster29 (SEQ ID NO: 4646 -- SEQ ID NO: 4835) | Cluster30 (SEQ ID NO: 4836 -- SEQ ID NO: 5045) | Cluster31 (SEQ ID NO: 5046 -- SEQ ID NO: 5161) | Cluster32 (SEQ ID NO: 5162 -- SEQ ID NO: 5286) |
|---|---|---|---|---|---|---|---|---|---|---|---|
| PCA4 | Min | -1.17361 | | | | | -0.38758 | | | | -0.38206 |
| | Mean | -0.85262 | | | | | 0.833197 | | | | 0.758589 |
| | Median | -0.87973 | | | | | 0.567642 | | | | 0.57825 |
| | Max | -0.4226 | | | | | 3.04613 | | | | 2.974322 |
| PCA5 | Min | -0.19829 | | | | | -2.53365 | | | | -2.62344 |
| | Mean | 0.810572 | | | | | -0.84754 | | | | -0.70873 |
| | Median | 0.764994 | | | | | -0.77132 | | | | -0.57736 |
| | Max | 2.416623 | | | | | -0.20762 | | | | -0.2082 |
| | | -1.13483 | -1.21844 | -0.39205 | -0.39205 | | -0.39849 | -0.39561 | -0.36964 | | |
| | | -0.83671 | -0.8048 | 0.614565 | 0.614565 | | 0.600433 | 0.604744 | 0.646062 | | |
| | | -0.86109 | -0.8269 | 0.451215 | 0.451215 | | 0.449885 | 0.359338 | 0.523269 | | |
| | | -0.43388 | -0.41083 | 2.809658 | 2.809658 | | 2.884478 | 2.972785 | 2.6186 | | |
| | | -0.19924 | -0.19297 | -1.79801 | -1.79801 | | -2.44086 | -2.44086 | -2.6779 | | |
| | | 0.736591 | 0.728155 | -0.72144 | -0.72144 | | -0.80889 | -0.82297 | -0.72856 | | |
| | | 0.693731 | 0.657955 | -0.72833 | -0.72833 | | -0.70957 | -0.77948 | -0.59442 | | |
| | | 2.278981 | 2.616655 | -0.20335 | -0.20335 | | -0.20218 | -0.20251 | -0.20116 | | |
| PCA1 | Min | -0.39968 | -0.93205 | -0.38484 | -0.93175 | -0.36299 | -0.93202 | -0.39541 | -0.93174 | -0.38676 | -0.93219 |
| | Mean | 0.569528 | -0.7112 | 0.89369 | -0.71148 | 0.847871 | -0.6997 | 0.733638 | -0.71468 | 0.713562 | -0.72235 |
| | Median | 0.307897 | -0.71444 | 0.656779 | -0.7205 | 0.473467 | -0.71199 | 0.522102 | -0.72051 | 0.378272 | -0.72062 |
| | Max | 2.76172 | -0.40915 | 3.044789 | -0.40213 | 6.206739 | -0.40329 | 2.997077 | -0.40188 | 2.942702 | -0.40344 |
| PCA2 | Min | -4.50821 | -4.32937 | 0.205796 | 0.217611 | -3.95614 | -4.39001 | 0.203336 | 0.213622 | -3.27891 | -4.31097 |
| | Mean | -0.777 | -0.77438 | 0.615151 | 0.627195 | -0.58233 | -0.66813 | 0.642413 | 0.668567 | -0.54379 | -0.6389 |
| | Median | -0.41811 | -0.59493 | 0.63135 | 0.641379 | -0.23895 | -0.27959 | 0.691753 | 0.727605 | -0.27039 | -0.39873 |
| | Max | 0.196954 | 0.180603 | 0.941307 | 0.956251 | 0.199442 | 0.199682 | 0.947101 | 0.955864 | 0.197573 | 0.197193 |
| PCA3 | Min | -0.30606 | -0.31336 | -0.19852 | -0.19834 | -0.19909 | -0.19493 | -0.31606 | -0.32335 | -0.30162 | -0.31598 |
| | Mean | -0.25642 | -0.26736 | 0.171006 | 0.21757 | 0.20907 | 0.183239 | -0.26663 | -0.28001 | -0.25672 | -0.27043 |
| | Median | -0.26139 | -0.27169 | -0.03015 | -0.02662 | -0.03223 | -0.06903 | -0.27011 | -0.28811 | -0.25858 | -0.27998 |
| | Max | -0.20052 | -0.20409 | 4.462448 | 7.171082 | 7.193004 | 6.524651 | -0.20077 | -0.20004 | -0.20218 | -0.20128 |
| PCA4 | Min | -0.39748 | -0.39925 | -0.7756 | -0.74818 | -0.78247 | -0.75487 | -0.79614 | -0.74639 | -0.78065 | -0.74365 |
| | Mean | 0.668717 | 0.649507 | -0.63225 | -0.6052 | -0.61175 | -0.59977 | -0.62563 | -0.61235 | -0.62339 | -0.59687 |
| | Median | 0.41274 | 0.413211 | -0.63785 | -0.61495 | -0.61728 | -0.60438 | -0.63223 | -0.61292 | -0.63546 | -0.6038 |
| | Max | 2.854384 | 2.911189 | -0.40047 | -0.40417 | -0.40476 | -0.41372 | -0.41488 | -0.40099 | -0.40756 | -0.40546 |
| PCA5 | Min | -2.18571 | -2.49096 | -2.21238 | -2.21096 | -2.21537 | -2.20254 | -2.39722 | -2.17311 | -2.11438 | -2.35552 |
| | Mean | -0.85226 | -0.79404 | -0.8952 | -0.956 | -0.91416 | -0.91719 | -0.96664 | -0.96062 | -0.95439 | -0.98418 |
| | Median | -0.79315 | -0.76484 | -0.83735 | -0.91891 | -0.92024 | -0.83148 | -0.90166 | -0.94788 | -0.90938 | -0.885 |
| | Max | -0.20566 | -0.20015 | -0.20978 | -0.20039 | -0.22084 | -0.20408 | -0.2077 | -0.21493 | -0.20199 | -0.22725 |

Example 3: Design of Zinc Fingers to Bind Genomic Loci in *Zea mays*

Zinc finger proteins directed against the identified DNA sequences of the representative genomic loci were designed as previously described. See, e.g., Urnov et al., (2005) Nature 435:646-551. Exemplary target sequence and recognition helices are shown in Table 7 (recognition helix regions designs) and Table 8 (target sites). In Table 8, nucleotides in the target site that are contacted by the ZFP recognition helices are indicated in uppercase letters and non-contacted nucleotides are indicated in lowercase. Zinc Finger Nuclease (ZFN) target sites were designed for all of the previously described 72 selected genomic loci. Numerous ZFP designs were developed and tested to identify the fingers which bound with the highest level of efficiency with 72 different representative genomic loci target sites which were identified and selected in *Zea mays* as described above. The specific ZFP recognition helices (Table 7) which bound with the highest level of efficiency to the zinc finger recognition sequences were used for targeting and integration of a donor sequence within the *Zea mays* genome.

TABLE 7 zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 111879 | 111879 ZFN5 | SEQ ID NO: 5287 QSGDLTR | SEQ ID NO: 5288 RKDQLVA | SEQ ID NO: 5289 RSDDLTR | SEQ ID NO: 5290 TSSNRKT | SEQ ID NO: 5291 RSDTLSE | SEQ ID NO: 5292 ARSTRTN |
|  | 111879 ZFN7 | SEQ ID NO: 5293 RSDSLSV | SEQ ID NO: 5294 DRSNRKT | SEQ ID NO: 5295 QSSHLTR | SEQ ID NO: 5296 RSDALAR | SEQ ID NO: 5297 RSDDLTR | SEQ ID NO: 5298 DPSALRK |
| 111885 | 111885 ZFN1 | SEQ ID NO: 5299 RSDNLSQ | SEQ ID NO: 5300 ASNDRKK | SEQ ID NO: 5301 ERGTLAR | SEQ ID NO: 5302 RSDHLSR | SEQ ID NO: 5303 ERGTLAR | SEQ ID NO: 5304 QSGHLSR |
|  | 111885 ZFN2 | SEQ ID NO: 5305 RSANLAR | SEQ ID NO: 5306 DRSDLSR | SEQ ID NO: 5307 RSDTLSQ | SEQ ID NO: 5308 RSADLSR | SEQ ID NO: 5309 DRSNLSR | SEQ ID NO: 5310 NSRNLRN |
| 117404 | SIG115 737-31v1 | SEQ ID NO: 5311 RSDTLSV | SEQ ID NO: 5312 DRSHLAR | SEQ ID NO: 5313 DRSNLSR | SEQ ID NO: 5314 RRSDLKR | SEQ ID NO: 5315 RSDTLSE | SEQ ID NO: 5316 QNATRIN |
|  | SIG115 737_32v1 | SEQ ID NO: 5317 QSGSLTR | SEQ ID NO: 5318 QSGDLTR | SEQ ID NO: 5319 RSDVLSE | SEQ ID NO: 5320 TRNGLKY | N/A | N/A |
| 117408 | SIG120 523_11v1 | SEQ ID NO: 5321 RSDNLSR | SEQ ID NO: 5322 DNSNRKT | SEQ ID NO: 5323 QNAHRKT | SEQ ID NO: 5324 QKATRIT | SEQ ID NO: 5325 DRSHLTR | SEQ ID NO: 5326 RSDDRKK |
|  | SIG120 523_12v1 | SEQ ID NO: 5327 ASKTRTN | SEQ ID NO: 5328 QSGSLTR | SEQ ID NO: 5329 LRHHLTR | SEQ ID NO: 5330 QSAHLKA | N/A | N/A |
| 117400 | SIG115 246_5 | SEQ ID NO: 5331 QSGDLTR | SEQ ID NO: 5332 ASHNLRT | SEQ ID NO: 5333 DRSNLTR | SEQ ID NO: 5334 QSSDLSR | SEQ ID NO: 5335 DAGNRNK | N/A |
|  | SIG115 246_6 | SEQ ID NO: 5336 DRSDLSR | SEQ ID NO: 5337 RSDNLTR | SEQ ID NO: 5338 DRSHLSR | SEQ ID NO: 5339 TSGNLTR | SEQ ID NO: 5340 QSSDLSR | N/A |
| 117402 | SIG115 636_1v1 | SEQ ID NO: 5341 QSSDLSR | SEQ ID NO: 5342 HRSTRNR | SEQ ID NO: 5343 RSDDLTR | SEQ ID NO: 5344 DRSNLKA | SEQ ID NO: 5345 DRSHLTR | SEQ ID NO: 5346 QRSTLKS |
|  | SIG115 636_2v1 | SEQ ID NO: 5347 RSDALAR | SEQ ID NO: 5348 RSDDLTR | SEQ ID NO: 5349 DRSHLTR | SEQ ID NO: 5350 TSSNRKT | SEQ ID NO: 5351 RSDTLSE | SEQ ID NO: 5352 DRSHLAR |

TABLE 7-continued zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 117406 | SIG120 417-11v1 | SEQ ID NO: 5353 DRSARTR | SEQ ID NO: 5354 QSGHLSR | SEQ ID NO: 5355 QSGNLAR | SEQ ID NO: 5356 RSDVLST | SEQ ID NO: 5357 RYAYLTS | SEQ ID NO: 5358 RRWTLVG |
|  | SIG120 417-12v1 | SEQ ID NO: 5359 RSDNLSQ | SEQ ID NO: 5360 ASNDRKK | SEQ ID NO: 5361 QSGDLTR | SEQ ID NO: 5362 LKDTLRR | SEQ ID NO: 5363 QSGNLAR | N/A |
| 117411 | SIG120 621-15v1 | SEQ ID NO: 5364 QSGDLTR | SEQ ID NO: 5365 MQNYLSR | SEQ ID NO: 5366 RSDHLSE | SEQ ID NO: 5367 QNANRKT | SEQ ID NO: 5368 RSADLTR | N/A |
|  | SIG120 621-16v1 | SEQ ID NO: 5369 RSDNLSE | SEQ ID NO: 5370 QSANRTK | SEQ ID NO: 5371 RSDALSR | SEQ ID NO: 5372 DRSALAR | SEQ ID NO: 5373 RSDHLSE | SEQ ID NO: 5374 DSQNRIK |
| 117413 | SIG120 78_11v1 | SEQ ID NO: 5375 QSGDLTR | SEQ ID NO: 5376 DKGNLTK | SEQ ID NO: 5377 RSADLTR | SEQ ID NO: 5378 DRSHLAR | SEQ ID NO: 5379 RSDTLSE | SEQ ID NO: 5380 DRSNRKT |
|  | SIG120 78_12v1 | SEQ ID NO: 5381 DRSNLSR | SEQ ID NO: 5382 LRQDLKR | SEQ ID NO: 5383 RSDHLSE | SEQ ID NO: 5384 DRSALAR | SEQ ID NO: 5385 DRSALSR | SEQ ID NO: 5386 NRRGRWS |
| 117429 | SIG157 315_1v1 | SEQ ID NO: 5387 RPYTLRL | SEQ ID NO: 5388 HRSSLRR | SEQ ID NO: 5389 RSDSLLR | SEQ ID NO: 5390 WLSSLSA | SEQ ID NO: 5391 QSGDLTR | SEQ ID NO: 5392 DRSHLAR |
|  | SIG157 315_2v1 | SEQ ID NO: 5393 DRSNLSR | SEQ ID NO: 5394 LKQHLNE | SEQ ID NO: 5395 LRHHLTR | SEQ ID NO: 5396 QSGNLHV | SEQ ID NO: 5397 TSGHLSR | N/A |
| 124802 |  | SEQ ID NO: 5495 QSSDLSR | SEQ ID NO: 5496 QSGNLAR | SEQ ID NO: 5497 DRSNRTT | SEQ ID NO: 5498 DNSNRIK | N/A | N/A |
|  |  | SEQ ID NO: 5499 QSSDLSR | SEQ ID NO: 5500 RTDALRG | SEQ ID NO: 5501 RSDHLSE | SEQ ID NO: 5502 SYRSRWG | SEQ ID NO: 5503 DRSALAR | N/A |
| 121900 | SIGPPL 05_1 | SEQ ID NO: 5504 RSDTLSE | SEQ ID NO: 5505 QSGDLTR | SEQ ID NO: 5506 TSGNLTR | SEQ ID NO: 5507 DRSALAR | N/A | N/A |
|  | SIGPPL 05_2 | SEQ ID NO: 5508 RSDSLSV | SEQ ID NO: 5509 QSGDLTR | SEQ ID NO: 5510 DRSNLSR | SEQ ID NO: 5511 RQDSRSQ | SEQ ID NO: 5512 RSDHLSA | SEQ ID NO: 5513 QHGSLAS |
| 124810 | SIGPPL 06_9 | SEQ ID NO: 5514 RSANLAR | SEQ ID NO: 5515 RSDHLTT | SEQ ID NO: 5516 RSANLAR | SEQ ID NO: 5517 TNQNRIT | N/A | N/A |
|  | SIGPPL 06_10 | SEQ ID NO: 5518 QSGNLAR | SEQ ID NO: 5519 QSNQLAV | SEQ ID NO: 5520 QNAHRKT | SEQ ID NO: 5521 RSDDLSK | SEQ ID NO: 5522 RSDTRKT | N/A |
| 121902 | SIGPPL 07_1 | SEQ ID NO: 5523 QSSHLTR | SEQ ID NO: 5524 QSSDLTR | SEQ ID NO: 5525 RSDDLTR | SEQ ID NO: 5526 QSSDLRR | SEQ ID NO: 5527 TSGSLSR | SEQ ID NO: 5528 TSSNRAV |
|  | SIGPPL 07_2 | SEQ ID NO: 5529 RSDHLSR | SEQ ID NO: 5530 DRSARNS | SEQ ID NO: 5531 RSDTLSE | SEQ ID NO: 5532 SRCWRRK | N/A | N/A |

TABLE 7-continued zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 123802 | ZmPPL 18SIG_5 | SEQ ID NO: 5533 TSGNLTR | SEQ ID NO: 5534 LKQMLAV | SEQ ID NO: 5535 QSSNLAR | SEQ ID NO: 5536 RSDNLTR | SEQ ID NO: 5537 RSDNLST | SEQ ID NO: 5538 QSGHLSR |
|  | ZmPPL 18SIG_6 | SEQ ID NO: 5539 RSDNLAR | SEQ ID NO: 5540 QKKDRSY | SEQ ID NO: 5541 RSDVLSR | SEQ ID NO: 5542 DSRDRKN | N/A | N/A |
| 123805 | ZmSIG PPL19_1 | SEQ ID NO: 5543 RSAHLSR | SEQ ID NO: 5544 QSANRTK | SEQ ID NO: 5545 QSSDLSR | SEQ ID NO: 5546 QSSDLSR | SEQ ID NO: 5547 QWSTRKR | N/A |
|  | ZmSIG PPL19_2 | SEQ ID NO: 5548 QSSDLSR | SEQ ID NO: 5549 QSAHRKN | SEQ ID NO: 5550 RSDNLST | SEQ ID NO: 5551 DSSTRKT | SEQ ID NO: 5552 RSDHLSR | SEQ ID NO: 5553 DRSNRKT |
| 121992 | ZmPPL 20v2_1 | SEQ ID NO: 5554 QSSDLSR | SEQ ID NO: 5555 QAGNLSK | SEQ ID NO: 5556 DRSNLSR | SEQ ID NO: 5557 LKQHLTR | N/A | N/A |
|  | ZmPPL 20v2_2 | SEQ ID NO: 5558 DRSNLSR | SEQ ID NO: 5559 QSGDLTR | SEQ ID NO: 5560 QSSDLSR | SEQ ID NO: 5561 QAGNLSK | SEQ ID NO: 5562 QNAHRKT | N/A |
| 118643 | SIGPPL 09_1 | SEQ ID NO: 5563 RSDHLSQ | SEQ ID NO: 5564 QNAHRIT | SEQ ID NO: 5565 RSDDLTR | SEQ ID NO: 5566 QRSTLSS | SEQ ID NO: 5567 TSGNLTR | SEQ ID NO: 5568 DRSNLTR |
|  | SIGPPL 09_2 | SEQ ID NO: 5569 TSGNLTR | SEQ ID NO: 5570 RSDDLTR | SEQ ID NO: 5571 QSGDLTR | SEQ ID NO: 5572 MQNYLSR | SEQ ID NO: 5573 QSGNLAR | SEQ ID NO: 5574 DQSGLAH |
| 118648 | SIGPPL 10_5 | SEQ ID NO: 5575 rsdnlst | SEQ ID NO: 5576 drsalar | SEQ ID NO: 5577 lkqhltr | SEQ ID NO: 5578 rrddlrn | SEQ ID NO: 5579 rsddltr | SEQ ID NO: 5580 drsnlka |
|  | SIGPPL 10_6 | SEQ ID NO: 5581 rsdtlse | SEQ ID NO: 5582 qsgdltr | SEQ ID NO: 5583 qsgdltr | SEQ ID NO: 5584 drsvlrr | SEQ ID NO: 5585 rsdnlar | SEQ ID NO: 5586 drsnitr |
| 118650 | SIGPPL 21_1 | SEQ ID NO: 5587 DRSHLTR | SEQ ID NO: 5588 QSGDLTR | SEQ ID NO: 5589 QSGDLTR | SEQ ID NO: 5590 RSDNLSE | SEQ ID NO: 5591 KRGNRAK | N/A |
|  | SIGPPL 21_2 | SEQ ID NO: 5592 ERGTLAR | SEQ ID NO: 5593 RSDALAR | SEQ ID NO: 5594 RSDALSR | SEQ ID NO: 5595 DRSALAR | SEQ ID NO: 5596 ERGTLAR | SEQ ID NO: 5597 DRSALAR |
| 118654 | SIGPPL 22_3 | SEQ ID NO: 5598 QSSDLSR | SEQ ID NO: 5599 RSDHLSR | SEQ ID NO: 5600 RSDTLSQ | SEQ ID NO: 5601 QKATRIT | SEQ ID NO: 5602 RSDALAR | N/A |
|  | SIGPPL 22_4 | SEQ ID NO: 5603 RSDNLSV | SEQ ID NO: 5604 DRSHLAR | SEQ ID NO: 5605 RSDTLSR | SEQ ID NO: 5606 QSADRTK | SEQ ID NO: 5607 TSGHLSR | N/A |
| 118656 | SIGPPL 23_1 | SEQ ID NO: 5608 QRSNLVR | SEQ ID NO: 5609 DRSHLAR | SEQ ID NO: 5610 RSDTLSE | SEQ ID NO: 5611 RMYTLSK | SEQ ID NO: 5612 DRSALSR | SEQ ID NO: 5613 RSDDLTR |
|  | SIGPPL 23_2 | SEQ ID NO: 5614 RSDALTQ | SEQ ID NO: 5615 DRSDLSR | SEQ ID NO: 5616 RRTDLRR | SEQ ID NO: 5617 RSDNLAR | SEQ ID NO: 5618 QRSPLPA | N/A |

TABLE 7-continued zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 118659 | SIGPPL 24_4 | SEQ ID NO: 5619 RSDSLSA | SEQ ID NO: 5620 QNAHRKT | SEQ ID NO: 5621 ERGTLAR | SEQ ID NO: 5622 RSDNLTR | SEQ ID NO: 5623 TSGNLTR | SEQ ID NO: 5624 QRSHLSD |
|  | SIGPPL 24_3 | SEQ ID NO: 5625 QSGDLTR | SEQ ID NO: 5626 QRSNLNI | SEQ ID NO: 5627 RSDNLAR | SEQ ID NO: 5628 DRSVLHR | SEQ ID NO: 5629 DRSDLSR | SEQ ID NO: 5630 RQDTLRS |
| 118660 | SIGPPL 25_2 | SEQ ID NO: 5631 RSDALSR | SEQ ID NO: 5632 QSGSLTR | SEQ ID NO: 5633 RSDALSV | SEQ ID NO: 5634 DSSHRTR | SEQ ID NO: 5635 QSGDLTR | SEQ ID NO: 5636 QSGHLSR |
|  | SIGPPL 25_1 | SEQ ID NO: 5637 RSDNLAR | SEQ ID NO: 5638 HRNTLLG | SEQ ID NO: 5639 TSGSLSR | SEQ ID NO: 5640 RSDHLTT | SEQ ID NO: 5641 QSGDLTR | SEQ ID NO: 5642 RPYTLRL |
| 118767 | SIGPPL 26_1 | SEQ ID NO: 5643 RSADLTR | SEQ ID NO: 5644 RSDALAR | SEQ ID NO: 5645 RSDTLSQ | SEQ ID NO: 5646 RSDDRKK | SEQ ID NO: 5647 TSGSLSR | N/A |
|  | SIGPPL 26_2 | SEQ ID NO: 5648 RSDTLSA | SEQ ID NO: 5649 RSADRKK | SEQ ID NO: 5650 QRSNLVR | SEQ ID NO: 5651 DRSHLAR | SEQ ID NO: 5652 RSDALSV | N/A |
| 118769 | SIGPPL 27_1 | SEQ ID NO: 5653 DRSNLSR | SEQ ID NO: 5654 QSGNLAR | SEQ ID NO: 5655 RSDHLTQ | SEQ ID NO: 5656 QSGDLTR | SEQ ID NO: 5657 LRHQLKS | N/A |
|  | SIGPPL 27_2 | SEQ ID NO: 5658 RSADLTR | SEQ ID NO: 5659 QSGDLTR | SEQ ID NO: 5660 DRSHLSR | SEQ ID NO: 5661 TSGNLTR | SEQ ID NO: 5662 RSDHLSA | SEQ ID NO: 5663 TTRYRNR |
| 118663 | SIGPPL 28_1 | SEQ ID NO: 5664 QSSDLSR | SEQ ID NO: 5665 QSGSLTR | SEQ ID NO: 5666 QSGHLSR | SEQ ID NO: 5667 TSGNLTR | SEQ ID NO: 5668 QSGHLSR | N/A |
|  | SIGPPL 28_2 | SEQ ID NO: 5669 QSGNLAR | SEQ ID NO: 5670 DISNRK | SEQ ID NO: 5671 DRSDLSR | SEQ ID NO: 5672 RRTDLRR | SEQ ID NO: 5673 TSGSLTR | N/A |
| 118668 | SIGPPL 29_5 | SEQ ID NO: 5674 DRSHLSR | SEQ ID NO: 5675 TSGNLTR | SEQ ID NO: 5676 DRSNLSR | SEQ ID NO: 5677 FPGSRTR | SEQ ID NO: 5678 RNDDRKK | N/A |
|  | SIGPPL 29_6 | SEQ ID NO: 5679 TSGSLSR | SEQ ID NO: 5680 QLNNLKT | SEQ ID NO: 5681 RSDVLT | SEQ ID NO: 5682 ASGNLLN | SEQ ID NO: 5683 RSDNLSR | SEQ ID NO: 5684 DNSNRKT |
| 118669 | SIGPPL 30_1 | SEQ ID NO: 5685 RSDTLSQ | SEQ ID NO: 5686 ASANRTK | SEQ ID NO: 5687 QSSNLAR | SEQ ID NO: 5688 DSSDRKK | SEQ ID NO: 5689 RSDHLST | SEQ ID NO: 5690 QSGHLSR |
|  | SIGPPL 30_2 | SEQ ID NO: 5691 RSDHLSA | SEQ ID NO: 5692 SYWSRTV | SEQ ID NO: 5693 DRSALSR | SEQ ID NO: 5694 DRSHLAR | SEQ ID NO: 5695 RSDNLTR | N/A |
| 118670 | SIGPPL 31_1 | SEQ ID NO: 5696 DRSDLSR | SEQ ID NO: 5697 DRSNRNK | SEQ ID NO: 5698 RSDVLSE | SEQ ID NO: 5699 RNFSLTM | SEQ ID NO: 5700 RSDALAR | N/A |
|  | SIGPPL 31_2 | SEQ ID NO: 5701 QSGALAR | SEQ ID NO: 5702 QSDDLSR | SEQ ID NO: 5703 RRDILHQ | SEQ ID NO: 5704 RSADLTR | SEQ ID NO: 5705 QSGDLTR | N/A |

TABLE 7-continued zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 118673 | SIGPPL 32_5 | SEQ ID NO: 5706 QSGALAR | SEQ ID NO: 5707 DRSNLSR | SEQ ID NO: 5708 LKQHLTR | SEQ ID NO: 5709 RSDNLST | SEQ ID NO: 5710 RSDHLSR | N/A |
| | SIGPPL 32_6 | SEQ ID NO: 5711 QSSDLSR | SEQ ID NO: 5712 HRSNLNK | SEQ ID NO: 5713 DRSNLSR | SEQ ID NO: 5714 DASNLRQ | SEQ ID NO: 5715 TSSNLSR | N/A |
| 118674 | SIGPPL 33_1 | SEQ ID NO: 5716 RSDSLLR | SEQ ID NO: 5717 CREYRGK | SEQ ID NO: 5718 TSGHLSR | SEQ ID NO: 5719 RSDVLSA | SEQ ID NO: 5720 RNDHRIN | NA |
| | SIGPPL 33_2 | SEQ ID NO: 5721 QSGSLTR | SEQ ID NO: 5722 RSDNLRE | SEQ ID NO: 5723 QSGSLTR | SEQ ID NO: 5724 RLDNRTA | SEQ ID NO: 5725 RSDVLSN | SEQ ID NO: 5726 DRSTRIT |
| 118676 | SIGPPL 34_1 | SEQ ID NO: 5727 RSDSLLR | SEQ ID NO: 5728 WLSSLSA | SEQ ID NO: 5729 ERGTLAR | SEQ ID NO: 5730 TSGSLTR | SEQ ID NO: 5731 RSDTLSE | SEQ ID NO: 5732 QSGHLSR |
| | SIGPPL 34_2 | SEQ ID NO: 5733 QSGNLAR | SEQ ID NO: 5734 DISNRSK | SEQ ID NO: 5735 RSDHLSR | SEQ ID NO: 5736 HRYHRLS | N/A | N/A |
| 118677 | SIGPPL 35_1 | SEQ ID NO: 5737 QSGSLTR | SEQ ID NO: 5738 DRSHLAR | SEQ ID NO: 5739 DRSALSR | SEQ ID NO: 5740 RSDALAR | SEQ ID NO: 5741 QSSDLSR | SEQ ID NO: 5742 HKYHLRS |
| | SIGPPL 35_2 | SEQ ID NO: 5743 RSDHLSE | SEQ ID NO: 5744 RKDARIT | SEQ ID NO: 5745 ERGTLAR | SEQ ID NO: 5746 RSDALTQ | SEQ ID NO: 5747 DRSHLTR | SEQ ID NO: 5748 RSDHLTT |
| 118680 | SIGPPL 36_1 | SEQ ID NO: 5749 TSGSLSR | SEQ ID NO: 5750 QMHHLKT | SEQ ID NO: 5751 TSSNLSR | SEQ ID NO: 5752 QSGALAR | SEQ ID NO: 5753 RSDDLTR | N/A |
| | SIGPPL 36_2 | SEQ ID NO: 5754 DRSALSR | SEQ ID NO: 5755 RSDHLSR | SEQ ID NO: 5756 DRSARTR | SEQ ID NO: 5757 QSGHLSR | SEQ ID NO: 5758 RSDHLSE | SEQ ID NO: 5759 ARSTRTN |
| 118683 | SIGPPL 37_1 | SEQ ID NO: 5760 RSANLAR | SEQ ID NO: 5761 RNDDRKK | SEQ ID NO: 5762 DRSHLTR | SEQ ID NO: 5763 DRSNLTR | N/A | N/A |
| | SIGPPL 37_2 | SEQ ID NO: 5764 TSGSLSR | SEQ ID NO: 5765 DSSDRKK | SEQ ID NO: 5766 QSGDLTR | SEQ ID NO: 5767 DRSHLTR | SEQ ID NO: 5768 DRSHLAR | N/A |
| 118685 | SIGPPL 38_1 | SEQ ID NO: 5769 RSDHLSA | SEQ ID NO: 5770 TKSNRTK | SEQ ID NO: 5771 DRSNLTR | SEQ ID NO: 5772 RSDDLTR | SEQ ID NO: 5773 QKSSLRT | N/A |
| | SIGPPL 38_2 | SEQ ID NO: 5774 RREDLIT | SEQ ID NO: 5775 TSSNLSR | SEQ ID NO: 5776 DRSALSR | SEQ ID NO: 5777 RSDDRKT | SEQ ID NO: 5778 RSDTLSE | SEQ ID NO: 5779 HRRSRWG |
| 123833 | ZmSIG PPL39_1 | SEQ ID NO: 5780 RSDNLSA | SEQ ID NO: 5781 RNNDRKT | SEQ ID NO: 5782 QSGDLTR | SEQ ID NO: 5783 RSDDLTR | SEQ ID NO: 5784 QSSDLSR | SEQ ID NO: 5785 HKYHLRS |
| | ZmSIG PPL39_2 | SEQ ID NO: 5786 TNQNRIT | SEQ ID NO: 5787 HRSSLRR | SEQ ID NO: 5788 DSSTRKT | SEQ ID NO: 5789 QSATRTK | SEQ ID NO: 5790 QSSDLSR | SEQ ID NO: 5791 HRKSLSR |

TABLE 7-continued zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 118771 | SIGPPL 40_1 | SEQ ID NO: 5792 QSSDLSR | SEQ ID NO: 5793 QSTHRNA | SEQ ID NO: 5794 RSDHLTQ | SEQ ID NO: 5795 DRSDLSR | SEQ ID NO: 5796 RSDNLTR | N/A |
|  | SIGPPL 40_2 | SEQ ID NO: 5797 QSGDLTR | SEQ ID NO: 5798 DRSHLTR | SEQ ID NO: 5799 QSGSLTR | SEQ ID NO: 5800 DRSNLSR | SEQ ID NO: 5801 QSGNLAR | N/A |
| 121943 | ZmSIG PPL41_7 | SEQ ID NO: 5802 DRSALSR | SEQ ID NO: 5803 RSDALTQ | SEQ ID NO: 5804 RSDSLLR | SEQ ID NO: 5805 RSDALTQ | SEQ ID NO: 5806 RSDNLST | SEQ ID NO: 5807 DNSNRIN |
|  | ZmSIG PPL41_8 | SEQ ID NO: 5808 RSDNLST | SEQ ID NO: 5809 RSDNRTK | SEQ ID NO: 5810 RSDVLST | SEQ ID NO: 5811 WSSSRAA | SEQ ID NO: 5812 QSGSLTR | SEQ ID NO: 5813 TSSNRKT |
| 121946 | ZmSIG PPL42_7 | SEQ ID NO: 5814 QSSHLTR | SEQ ID NO: 5815 RSDALTQ | SEQ ID NO: 5816 ERGTLAR | SEQ ID NO: 5817 RNDDRKK | N/A | N/A |
|  | ZmSIG PPL42_8 | SEQ ID NO: 5818 QSGSLTR | SEQ ID NO: 5819 TSSNRKT | SEQ ID NO: 5820 RSDNLSV | SEQ ID NO: 5821 QNANRIT | SEQ ID NO: 5822 ERGTLAR | SEQ ID NO: 5823 RSDDLTR |
| 121949 | ZmSIG PPL43_3 | SEQ ID NO: 5824 RSDNLSE | SEQ ID NO: 5825 RHSALSA | SEQ ID NO: 5826 QSSDLSR | SEQ ID NO: 5827 QSYNRFV | SEQ ID NO: 5828 ERGTLAR | SEQ ID NO: 5829 TSGSLTR |
|  | ZmSIG PPL43_4 | SEQ ID NO: 5830 ERGTLAR | SEQ ID NO: 5831 RSDDLTR | SEQ ID NO: 5832 RSDHLSE | SEQ ID NO: 5833 RNQHRKN | SEQ ID NO: 5834 DRSHLAR | N/A |
| 121952 | ZmSIG PPL44_1 | SEQ ID NO: 5835 QSGNLAR | SEQ ID NO: 5836 QGANLIK | SEQ ID NO: 5837 RSDSLSV | SEQ ID NO: 5838 DRSDLSR | SEQ ID NO: 5839 QSGHLSR | N/A |
|  | ZmSIG PPL44_2 | SEQ ID NO: 5840 TSGSLSR | SEQ ID NO: 5841 QSGSLTR | SEQ ID NO: 5842 RSAHLSR | SEQ ID NO: 5843 RSDALST | SEQ ID NO: 5844 DRSTRTK | N/A |
| 121959 | ZmSIG PPL45_7 | SEQ ID NO: 5845 RSDDLSK | SEQ ID NO: 5846 QSATRTK | SEQ ID NO: 5847 RSDALTQ | SEQ ID NO: 5848 DRSHLTR | SEQ ID NO: 5849 TSSNRKT | N/A |
|  | ZmSIG PPL45_8 | SEQ ID NO: 5850 DRSALSR | SEQ ID NO: 5851 TSSNRKT | SEQ ID NO: 5852 RSADLTR | SEQ ID NO: 5853 RSDDLTR | SEQ ID NO: 5854 RSDVLST | SEQ ID NO: 5855 DCRNRWR |
| 121963 | ZmSIG PPL46_7 | SEQ ID NO: 5856 QSSDLSR | SEQ ID NO: 5857 QSGSLTR | SEQ ID NO: 5858 QSSDLSR | SEQ ID NO: 5859 RSDNLST | SEQ ID NO: 5860 RSDNRTK | N/A |
|  | ZmSIG PPL46_8 | SEQ ID NO: 5861 QSSDLSR | SEQ ID NO: 5862 AASNRSK | SEQ ID NO: 5863 DRSHLSR | SEQ ID NO: 5864 DRSHLAR | SEQ ID NO: 5865 RSDTLSA | SEQ ID NO: 5866 RSADRKK |
| 121971 | ZmSIG PPL48_7 | SEQ ID NO: 5867 RSDNLST | SEQ ID NO: 5868 DRSNRKT | SEQ ID NO: 5869 RSDALAR | SEQ ID NO: 5870 RSDNLST | SEQ ID NO: 5871 DRSALAR | N/A |
|  | ZmSIG PPL48_8 | SEQ ID NO: 5872 DRSDLSR | SEQ ID NO: 5873 DRSNRNK | SEQ ID NO: 5874 QSSDLSR | SEQ ID NO: 5875 WRSSLRQ | SEQ ID NO: 5876 RSDHLSQ | SEQ ID NO: 5877 TRSPLTT |

TABLE 7-continued zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 121972 | ZmSIG PPL49_1 | SEQ ID NO: 5878 TRDHLST | SEQ ID NO: 5879 RSDAR TN | SEQ ID NO: 5880 RSDHLS E | SEQ ID NO: 5881 QSNHR KT | SEQ ID NO: 5882 RSDAL AR | N/A |
|  | ZmSIG PPL49_2 | SEQ ID NO: 5883 ERGTL AR | SEQ ID NO: 5884 RSDALT Q | SEQ ID NO: 5885 RSDSLS V | SEQ ID NO: 5886 DRSAL AR | SEQ ID NO: 5887 QSSNLA R | SEQ ID NO: 5888 QSADRT K |
| 124097 | ZmSIG PPL50_5 | SEQ ID NO: 5889 RSDHLS A | SEQ ID NO: 5890 QSGDL TR | SEQ ID NO: 5891 QSSDLS R | SEQ ID NO: 5892 RSDNL AR | SEQ ID NO: 5893 FREGLY K | N/A |
|  | ZmSIG PPL50_6 | SEQ ID NO: 5894 TSGNLT R | SEQ ID NO: 5895 LKQML AV | SEQ ID NO: 5896 ERGTL AR | SEQ ID NO: 5897 RSDHLS R | SEQ ID NO: 5898 QSSHLT R | SEQ ID NO: 5899 QSSDLTR |
| 123818 | ZmPPL 51_7 | SEQ ID NO: 5900 RSDTLS E | SEQ ID NO: 5901 HRRSR WG | SEQ ID NO: 5902 RSDDLS V | SEQ ID NO: 5903 TSSNRT K | N/A | N/A |
|  | ZmPPL 51_8 | SEQ ID NO: 5904 RSDTLS Q | SEQ ID NO: 5905 QRDHRI K | SEQ ID NO: 5906 DRSNLS R | SEQ ID NO: 5907 TSGNLT R | SEQ ID NO: 5908 RSDSLL R | SEQ ID NO: 5909 WLSSLS A |
| 118705 | SIGPPL 52_5 | SEQ ID NO: 5910 DRSNLS R | SEQ ID NO: 5911 LRQNLI M | SEQ ID NO: 5912 QNAHR KT | SEQ ID NO: 5913 QSGAL AR | SEQ ID NO: 5914 QSGHLS R | N/A |
|  | SIGPPL 52_6 | SEQ ID NO: 5915 QSGNL AR | SEQ ID NO: 5916 LAYDR RK | SEQ ID NO: 5917 RSDVLS E | SEQ ID NO: 5918 RNFSLT M | SEQ ID NO: 5919 RSADLT R | SEQ ID NO: 5920 DSSDRK K |
| 118711 | SIGPPL 54_5 | SEQ ID NO: 5921 RSDNL AR | SEQ ID NO: 5922 DQSYR RT | SEQ ID NO: 5923 RSDNLS E | SEQ ID NO: 5924 TSSNRK T | N/A | N/A |
|  | SIGPPL 54_6 | SEQ ID NO: 5925 TSGSLS R | SEQ ID NO: 5926 RKELLR S | SEQ ID NO: 5927 RPYTLR L | SEQ ID NO: 5928 HRSSLR R | SEQ ID NO: 5929 DRSTRT K | SEQ ID NO: 5930 RSDYLA K |
| 118718 | ZmSIG PPL57_1 | SEQ ID NO: 5931 QSSDLS R | SEQ ID NO: 5932 QSTHR NA | SEQ ID NO: 5933 RSADLT R | SEQ ID NO: 5934 RSDDLT R | SEQ ID NO: 5935 DRSNLS R | SEQ ID NO: 5936 QSGNLA R |
|  | ZmSIG PPL57_2 | SEQ ID NO: 5937 QSGHL AR | SEQ ID NO: 5938 DRSHL AR | SEQ ID NO: 5939 RSANL AR | SEQ ID NO: 5940 QSANR TK | SEQ ID NO: 5941 RSDHLT Q | N/A |
| 118722 | ZmSIG PPL58_3 | SEQ ID NO: 5942 QSSDLS R | SEQ ID NO: 5943 RSDHLT Q | SEQ ID NO: 5944 DRSAL AR | SEQ ID NO: 5945 RSDYL AK | SEQ ID NO: 5946 QSGDL TR | N/A |
|  | ZmSIG PPL58_4 | SEQ ID NO: 5947 RSDNLQ | SEQ ID NO: 5948 QRQHR KT | SEQ ID NO: 5949 DQSNL RA | SEQ ID NO: 5950 RPYTLR L | SEQ ID NO: 5951 QSSNLA R | SEQ ID NO: 5952 RSDNLTT |
| 118726 | SIGPPL 59_5 | SEQ ID NO: 5953 QSGHL AR | SEQ ID NO: 5954 QRVAL QA | SEQ ID NO: 5955 ERGTL AR | SEQ ID NO: 5956 QSGDL TR | SEQ ID NO: 5957 RSDDLT | N/A |
|  | SIGPPL 59_6 | SEQ ID NO: 5958 QSSDLS R | SEQ ID NO: 5959 HRSNL NK | SEQ ID NO: 5960 RSADLT R | SEQ ID NO: 5961 TNQNRI T | SEQ ID NO: 5962 RSDAL AR | N/A |

TABLE 7-continued zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 118728 | ZmSIGPPL60_3 | SEQ ID NO: 5963 DSSALIN | SEQ ID NO: 5964 TSSNLSR | SEQ ID NO: 5965 RSDHLSR | SEQ ID NO: 5966 YGWYRHK | SEQ ID NO: 5967 TSGHLSR | SEQ ID NO: 5968 RSDNLTR |
|  | ZmSIGPPL60_4 | SEQ ID NO: 5969 QSGHLAR | SEQ ID NO: 5970 QRTNLVE | SEQ ID NO: 5971 DRSTRTK | SEQ ID NO: 5972 QSGNLHV | SEQ ID NO: 5973 RSDHLTQ | N/A |
| 118732 | SIGPPL61_5 | SEQ ID NO: 5974 RSDNLST | SEQ ID NO: 5975 RSDNRTK | SEQ ID NO: 5976 RSDNLAR | SEQ ID NO: 5977 QKVNLMS | SEQ ID NO: 5978 QSGALAR | N/A |
|  | SIGPPL61_6 | SEQ ID NO: 5979 QSGDLTR | SEQ ID NO: 5980 TQGYLRK | SEQ ID NO: 5981 RSDNLAR | SEQ ID NO: 5982 DSSGLTH | SEQ ID NO: 5983 RNDDRKK | N/A |
| 118733 | ZmSIGPPL62_1 | SEQ ID NO: 5984 DRSDLSR | SEQ ID NO: 5985 RRDYLRT | SEQ ID NO: 5986 RSDTLSE | SEQ ID NO: 5987 NNRDRTK | SEQ ID NO: 5988 RSDTLSE | SEQ ID NO: 5989 QSGDLTR |
|  | ZmSIGPPL62_2 | SEQ ID NO: 5990 QSSDLSR | SEQ ID NO: 5991 QSTHRNA | SEQ ID NO: 5992 RSDDLSK | SEQ ID NO: 5993 RSDALAR | N/A | N/A |
| 118735 | SIGPPL62_5 | SEQ ID NO: 5994 RSANLAR | SEQ ID NO: 5995 RSDDLTR | SEQ ID NO: 5996 RSDALST | SEQ ID NO: 5997 DRSTRTK | SEQ ID NO: 5998 QSGNLAR | SEQ ID NO: 5999 QSTPLFA |
|  | SIGPPL62_6 | SEQ ID NO: 6000 QSGHLAR | SEQ ID NO: 6001 ERIALVR | SEQ ID NO: 6002 RSDHLSE | SEQ ID NO: 6003 RSAHLSR | SEQ ID NO: 6004 RSDNLSV | N/A |
| 118739 | ZmSIGPPL64_1 | SEQ ID NO: 6005 RSDTLSE | SEQ ID NO: 6006 QSHNRTK | SEQ ID NO: 6007 DRSHLTR | SEQ ID NO: 6008 DRSALAR | SEQ ID NO: 6009 TSGSLTR | N/A |
|  | ZmSIGPPL64_2 | SEQ ID NO: 6010 LRHHLTR | SEQ ID NO: 6011 QSYARTL | SEQ ID NO: 6012 RSDNLST | SEQ ID NO: 6013 RSDDLTR | SEQ ID NO: 6014 RSAHLSR | SEQ ID NO: 6015 RSDNLTR |
| 118742 | SIGPPL65_1 | SEQ ID NO: 6016 RSDDLSK | SEQ ID NO: 6017 DRSNRKT | SEQ ID NO: 6018 DRSNLSR | SEQ ID NO: 6019 QRTHLRD | SEQ ID NO: 6020 QSGHLSR | N/A |
|  | SIGPPL65_2 | SEQ ID NO: 6021 QSSDLSR | SEQ ID NO: 6022 QSGNRTT | SEQ ID NO: 6023 DRSNLTR | SEQ ID NO: 6024 QSGHLAR | SEQ ID NO: 6025 QRTNLVE | N/A |
| 118745 | ZmSIGPPL66_1 | SEQ ID NO: 6026 QSGDLTR | SEQ ID NO: 6027 RRDPLIN | SEQ ID NO: 6028 QSGDLTR | SEQ ID NO: 6029 RSDSLSR | SEQ ID NO: 6030 DKSNRIK | N/A |
|  | ZmSIGPPL66_2 | SEQ ID NO: 6031 QSSDLSR | SEQ ID NO: 6032 QSGDLTR | SEQ ID NO: 6033 QSSDLSR | SEQ ID NO: 6034 TSGNLTR | SEQ ID NO: 6035 QTSDRNK | N/A |
| 124081 | ZmSIGPPL67_3 | SEQ ID NO: 6036 QSGSLTR | SEQ ID NO: 6037 RNDDRKK | SEQ ID NO: 6038 RSDSLSA | SEQ ID NO: 6039 QNAHRKT | SEQ ID NO: 6040 QNAHRKT | N/A |
|  | ZmSIGPPL67_4 | SEQ ID NO: 6041 QSGDLTR | SEQ ID NO: 6042 DKGNLTK | SEQ ID NO: 6043 QSSDLSR | SEQ ID NO: 6044 QSAHRKN | SEQ ID NO: 6045 QSSDLSR | N/A |

TABLE 7-continued zinc finger designs for the *Zea mays* selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 125361 | | SEQ ID NO: 6046 RSDALSR | SEQ ID NO: 6047 QSGSLTR | SEQ ID NO: 6048 QSGSLTR | SEQ ID NO: 6049 QSGSLTR | SEQ ID NO: 6050 TSGHLSR | SEQ ID NO: 6051 DRSHLAR |
| | | SEQ ID NO: 6052 QSGDLTR | SEQ ID NO: 6053 RSDHLSR | SEQ ID NO: 6054 RSDHLST | SEQ ID NO: 6055 RSDHLSR | N/A | N/A |
| 118753 | SIGPPL69_5 | SEQ ID NO: 6056 QSSDLSR | SEQ ID NO: 6057 RSDYLRK | SEQ ID NO: 6058 QSGDLTR | SEQ ID NO: 6059 LRQTLNS | SEQ ID NO: 6060 QSGHLSR | N/A |
| | SIGPPL69_6 | SEQ ID NO: 6061 RSDTLSV | SEQ ID NO: 6062 DNSTRIK | SEQ ID NO: 6063 RSDNLST | SEQ ID NO: 6064 DNSNRIN | SEQ ID NO: 6065 TSSNLSR | N/A |
| 124878 | | SEQ ID NO: 6066 RSDVLSA | SEQ ID NO: 6067 QNATRIN | SEQ ID NO: 6068 RSDVLSE | SEQ ID NO: 6069 QSGNLAR | SEQ ID NO: 6070 RSDNLSV | N/A |
| | | SEQ ID NO: 6071 QSADRTK | SEQ ID NO: 6072 DRSNLTR | SEQ ID NO: 6073 RSDNLSE | SEQ ID NO: 6074 KRCNLRC | N/A | N/A |
| 123829 | ZmSIGPPL71_5 | SEQ ID NO: 6075 DRSNLSR | SEQ ID NO: 6076 DSSARNT | SEQ ID NO: 6077 TSGNLTR | SEQ ID NO: 6078 DRSNLTR | SEQ ID NO: 6079 DRSNLSR | SEQ ID NO: 6080 QRSNLDS |
| | ZmSIGPPL71_6 | SEQ ID NO: 6081 QSGNLAR | SEQ ID NO: 6082 QKVNRAG | SEQ ID NO: 6083 RSDNLSV | SEQ ID NO: 6084 QRNHRTT | SEQ ID NO: 6085 QKATRIT | N/A |
| 118761 | ZmSIGPPL72_3 | SEQ ID NO: 6086 QSGALAR | SEQ ID NO: 6087 LRHNLRA | SEQ ID NO: 6088 DRSTRTK | SEQ ID NO: 6089 HRSARKR | SEQ ID NO: 6090 RSDHLSE | SEQ ID NO: 6091 TSSDRTK |
| | ZmSIGPPL72_4 | SEQ ID NO: 6092 RSDSLSR | SEQ ID NO: 6093 DKSNRIK | SEQ ID NO: 6094 RSDDLTR | SEQ ID NO: 6095 DRSHLTR | SEQ ID NO: 6096 DRSNLTR | N/A |
| 121904 | SIGPPL74_1 | SEQ ID NO: 6097 RSDNLTT | SEQ ID NO: 6098 RQWSLRI | SEQ ID NO: 6099 TSGHLSR | SEQ ID NO: 6100 QSSDLSR | SEQ ID NO: 6101 RSDDLTR | N/A |
| | SIGPPL74_2 | SEQ ID NO: 6102 RSANLAR | SEQ ID NO: 6103 RLDNRTA | SEQ ID NO: 6104 QSGHLAR | SEQ ID NO: 6105 DSSNREA | N/A | N/A |
| 121905 | ZmSIGPPL75_1 | SEQ ID NO: 6106 RSDALSR | SEQ ID NO: 6107 RSDNLTR | SEQ ID NO: 6108 RSADLTR | SEQ ID NO: 6109 RSDNLTR | N/A | N/A |
| | ZmSIGPPL75_2 | SEQ ID NO: 6110 RSDNLSV | SEQ ID NO: 6111 RSDTRTE | SEQ ID NO: 6112 TSGSLSR | SEQ ID NO: 6113 QSGNLAR | SEQ ID NO: 6114 RSADLTR | N/A |
| 121917 | SIGPPL76_2 | SEQ ID NO: 6115 TSGSLSR | SEQ ID NO: 6116 RSDHLTT | SEQ ID NO: 6117 RSDDLTR | SEQ ID NO: 6118 QRSTLSS | SEQ ID NO: 6119 ERGTLAR | SEQ ID NO: 6120 QSGHLSR |
| | SIGPPL76_1 | SEQ ID NO: 6121 RSDHLSQ | SEQ ID NO: 6122 DNASRIR | SEQ ID NO: 6123 RSDNLST | SEQ ID NO: 6124 AQWTRAC | SEQ ID NO: 6125 RSDHLSE | SEQ ID NO: 6126 DKANRTR |

TABLE 7-continued zinc finger designs for the Zea mays selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 121918 | ZmSIG PPL77_2 | SEQ ID NO: 6127 QSSDLSR | SEQ ID NO: 6128 LRHNLRA | SEQ ID NO: 6129 RSDTLST | SEQ ID NO: 6130 DRSSRIK | N/A | N/A |
|  | ZmSIG PPL77_1 | SEQ ID NO: 6131 QSGALAR | SEQ ID NO: 6132 RSDNLTR | SEQ ID NO: 6133 RSDNLST | SEQ ID NO: 6134 DRSNLTR | SEQ ID NO: 6135 DRSDLSR | SEQ ID NO: 6136 DSSTRRR |
| 121909 | SIGPPL 78_1 | SEQ ID NO: 6137 DRSALAR | SEQ ID NO: 6138 DRSALSR | SEQ ID NO: 6139 DRSHLAR | SEQ ID NO: 6140 RSDNLST | SEQ ID NO: 6141 RSDARAN | N/A |
|  | SIGPPL 78_2 | SEQ ID NO: 6142 RSDHLST | SEQ ID NO: 6143 DSSNRIK | SEQ ID NO: 6144 QSGALAR | SEQ ID NO: 6145 RSDDLTR | SEQ ID NO: 6146 QSGSLTR | N/A |
| 121912 | SIGPPL 79_1 | SEQ ID NO: 6147 DRSHLSR | SEQ ID NO: 6148 DRSHLAR | SEQ ID NO: 6149 QSSDLSR | SEQ ID NO: 6150 QSGDLTR | SEQ ID NO: 6151 RSDNLSE | SEQ ID NO: 6152 HSNARKT |
|  | SIGPPL 79_2 | SEQ ID NO: 6153 RSDALSV | SEQ ID NO: 6154 DSSHRTR | SEQ ID NO: 6155 QSGDLTR | SEQ ID NO: 6156 ASHNLRT | SEQ ID NO: 6157 RSDHLST | SEQ ID NO: 6158 TSANLSR |
| 121981 | ZmSIG PPL80_3 | SEQ ID NO: 6159 DRSDLSR | SEQ ID NO: 6160 DRSNLTR | SEQ ID NO: 6161 RSDSLLR | SEQ ID NO: 6162 RLDWLPM | SEQ ID NO: 6163 RSADLTR | SEQ ID NO: 6164 TSGNLTR |
|  | ZmSIG PPL80_4 | SEQ ID NO: 6165 RSDNLSQ | SEQ ID NO: 6166 DRSNRTK | SEQ ID NO: 6167 DSSDRKK | SEQ ID NO: 6168 RSDHLSE | SEQ ID NO: 6169 QSASRKN | N/A |
| 124091 | ZmSIG PPL81_3 | SEQ ID NO: 6170 RSDVLST | SEQ ID NO: 6171 STAALSY | SEQ ID NO: 6172 QSANRTT | SEQ ID NO: 6173 QNAHRKT | SEQ ID NO: 6174 QSSDLSR | N/A |
|  | ZmSIG PPL81_4 | SEQ ID NO: 6175 QRNHRTT | SEQ ID NO: 6176 DRSNLTR | SEQ ID NO: 6177 TSGNLTR | SEQ ID NO: 6178 QSNQLRQ | SEQ ID NO: 6179 RSDALTQ | N/A |
| 127268* |  | SEQ ID NO: 6620 DRSALAR | SEQ ID NO: 6621 DYYGRHG | SEQ ID NO: 6622 DRSHLAR | SEQ ID NO: 6623 YRSSLKE | SEQ ID NO: 6624 TSGNLTR | N/A |
|  |  | SEQ ID NO: 6625 HHHVLVQ | SEQ ID NO: 6626 QNATRTK | SEQ ID NO: 6627 DRSTRTK | SEQ ID NO: 6628 RRDNLHS | SEQ ID NO: 6629 QKATRTT | SEQ ID NO: 6630 HRSSLRR |
| 120993* |  | SEQ ID NO: 6631 QSSDLSR | SEQ ID NO: 6632 QWSTRKR | SEQ ID NO: 6633 RSDVLSE | SEQ ID NO: 6634 QTVHRNS | SEQ ID NO: 6635 RSDTLSE | SEQ ID NO: 6636 FRGSLTW |
|  |  | SEQ ID NO: 6637 RSDNLST | SEQ ID NO: 6638 RSTHRTQ | SEQ ID NO: 6639 RSDNLSV | SEQ ID NO: 6640 QKATRIN | SEQ ID NO: 6641 DRSNLTR | N/A |
| 228254* |  | SEQ ID NO: 6642 QSGNLAR | SEQ ID NO: 6643 CRQNLAN | SEQ ID NO: 6644 DRSNLSR | SEQ ID NO: 6645 DGRNLRH | SEQ ID NO: 6646 RSDHLST | SEQ ID NO: 6647 RSDNLTR |
|  |  | SEQ ID NO: 6648 DRSNRTT | SEQ ID NO: 6649 QNATRIN | SEQ ID NO: 6650 QSGNLAR | SEQ ID NO: 6651 HKLSLSI | SEQ ID NO: 6652 DRSDLSR | SEQ ID NO: 6653 YRSNLVR |

TABLE 7-continued zinc finger designs for the Zea mays selected genomic loci (N/A indicates "not applicable"). It should be noted that the ZFP recognition helices that are identified with an asterisk (*) were designed for targeting and integration of a donor sequence, but the completion of donor integration within these genomic loci has not been completed.

| pDAB Number | ZFP Number | F1 | F2 | F3 | F4 | F5 | F6 |
|---|---|---|---|---|---|---|---|
| 200497* | | SEQ ID NO: 6654 DRSALSR | SEQ ID NO: 6655 QSGSLTR | SEQ ID NO: 6656 RSDNLTR | SEQ ID NO: 6657 RQDCLSL | SEQ ID NO: 6658 RNDNRKT | N/A |
| | | SEQ ID NO: 6659 QSGNLAR | SEQ ID NO: 6660 DQSGLAH | SEQ ID NO: 6661 QSANRTK | SEQ ID NO: 6662 DRSDLSR | SEQ ID NO: 6663 RSHHLKA | N/A |
| 66202* | | SEQ ID NO: 6664 QSGNLAR | SEQ ID NO: 6665 QSGSLTR | SEQ ID NO: 6666 DRSALSR | SEQ ID NO: 6667 QSGSLTR | SEQ ID NO: 6668 QSGNLAR | N/A |
| | | SEQ ID NO: 6669 QSGNLAR | SEQ ID NO: 6670 WRISLA | SEQ ID NO: 6671 RSDNLSE | SEQ ID NO: 6672 RSQHRKT | SEQ ID NO: 6673 QSSDLSR | N/A |
| 5607* | | SEQ ID NO: 6674 RSANLAR | SEQ ID NO: 6675 RSDHLTT | SEQ ID NO: 6676 RSDNLSE | SEQ ID NO: 6677 DRSHLAR | SEQ ID NO: 6678 QSAHRKN | SEQ ID NO: 6679 LKHHLTD |
| | | SEQ ID NO: 6680 TSGNLTR | SEQ ID NO: 6681 DRSNLTR | SEQ ID NO: 6682 RSDNLSQ | SEQ ID NO: 6683 RKADRTK | SEQ ID NO: 6684 TSGNLTR | SEQ ID NO: 6685 DSSNLAT |

TABLE 8

Zinc finger target site of Zea mays selected genomic loci

| Locus ID | Name | pDAB Number | ZFP Number and Binding Site (5'→3') | SEQ ID NO: |
|---|---|---|---|---|
| optimal_loci_204637 | OGL1 | 111879 | 111879ZFN5: ctACTCCGTATGCGAAGGCAcg | 5398 |
| | | | 111879ZFN7: taTTCGCGGTGGGACACTTGat | 5399 |
| optimal_loci_204726 | OGL2 | 111885 | 111885ZFN1: ccGGAGCCGGGGCCTCCCAGgc | 5400 |
| | | | 111885ZFN2: atCGCGACGCGACGcGACGAGac | 5401 |
| optimal_loci_156393 | OGL 12 | 117404 | SIG115737_31v1: TGCATGCGCAGTA | 5402 |
| | | | 51G115737_32v1: ACACCGGCGCACGGCACG | 5403 |
| optimal_loci_198387 | OGL 15 | 117408 | SIG120523_11v1: AGAGGTGTAACC | 5404 |
| | | | SIG120523_12v1: TCGGGCACAAGAAACGAG | 5405 |
| optimal_loci_31710 | OGL 08 | 117400 | SIG115246_5: TACGCTGACAATGCA | 5406 |
| | | | 51G115246_6: CCAGCTGATGGAGAGGAC | 5407 |
| optimal_loci_64542 | OGL 11 | 117402 | SIG115636_1v1: AGAGCAGGCGAG | 5408 |
| | | | 51G115636_2v1: AGCAAAGTGAGTAGTT | 5409 |
| optimal_loci_197372 | OGL14 | 117406 | SIG120417_11v1: TGGATGGAAGGAATC | 5410 |
| | | | 51G120417_12v1: GAAGCTACATCCCAG | 5411 |
| optimal_loci_232228 | OGL 16 | 117411 | SIG120621_15v1: TACGCGCAACGGAACGCA | 5412 |
| | | | 51G120621_16v1: CACCGGTGTCGTGTAACAG | 5413 |
| optimal_loci_285621 | OGL17 | 117413 | SIG12078_11v1: CCCGGACGACGCCGAG | 5414 |
| | | | SIG12078_12v1: GACATGGCACGCGCATCGAG | 5415 |
| optimal_loci_157315 | OGL 13 | 117429 | SIG157315_1v1: GCATGTGTGGTTTTG | 5416 |
| | | | SIG157315_2v1: GGTCAAGGTAGTGAC | 5417 |

TABLE 8-continued

Zinc finger target site of *Zea mays* selected genomic loci

| Locus ID | Name | pDAB Number | ZFP Number and Binding Site (5'→3') | SEQ ID NO: |
|---|---|---|---|---|
| optimal_loci_43577 | OGL04 | 124802 | ZFN_binding_1: AGCTTCAATAGTA | 6180 |
| | | | ZFN_binding_2: GTCTTCCGGTTGGCT | 6181 |
| optimal_loci_301774 | OGL05 | 121900 | ZFN_binding_3: GTCGATGCACCG | 6182 |
| | | | ZFN_binding_4: CTAAGGATGGACGCAGTG | 6183 |
| optimal_loci_232222 | OGL06 | 124810 | ZFN_binding_5: CATGAGAGGGAT | 6184 |
| | | | ZFN_binding_6: ATGTCGTAGAAAAGAA | 6185 |
| optimal_loci_203704 | OGL07 | 121902 | ZFN_binding_7: CATGTTCGCTGCGGCTGGA | 6186 |
| | | | ZFN_binding_8: AGTCCGCTCGGG | 6187 |
| optimal-loci_59517 | OGL09 | 118643 | ZFN_binding_9: GACGATCTAGCGAGAAGG | 6188 |
| | | | ZFN_binding_10: ATCGAAGAACGCAGCGGAT | 6189 |
| optimal_loci_25001 | OGL10 | 118648 | ZFN_binding_12: CACGCGCCGGGTGTCTAG | 6190 |
| | | | ZFN_binding_13: GACGAGCACCGCCCCACCG | 6191 |
| optimal_loci_112632 | OGL18 | 123802 | ZFN_binding_14: CGGGTACTGGGAAAGGAG | 6192 |
| | | | ZFN_binding_15: GAGCGTCCTGATTGACATG | 6193 |
| optimal_loci_28905 | OGL19 | 123805 | ZFN_binding_16: ACGGTGCATCAAGCTTAAG | 6194 |
| | | | ZFN_binding_17: CAAGGGACCTAGTGAGCT | 6195 |
| optimal_loci_129164 | OGL20 | 121992 | ZFN_binding_18: GGTGACTAAGCT | 6196 |
| | | | ZFN_binding_19: AGATAAGCTGCAGAC | 6197 |
| optimal_loci_2425 | OGL21 | 118650 | ZFN_binding_20: GAGCAGGCAGGCAGGC | 6198 |
| | | | ZFN_binding_21: GTCGTCGTCGTGCGTGGCC | 6199 |
| optimal_loci_122036 | OGL22 | 118654 | ZFN_binding_22: GTGGCAACGGGGGCT | 6200 |
| | | | ZFN_binding_23: GGTTCAGCGGGCTAG | 6201 |
| optimal_loci_5735 | OGL23 | 118656 | ZFN_binding_24: GCGGTCTTGCCGGGCGAA | 6202 |
| | | | ZFN_binding_25: CTAGAGGCGCCCATG | 6203 |
| optimal_loci_178978 | OGL24 | 118659 | ZFN_binding_26: ACGGACAGCCGAGAAAGCA | 6204 |
| | | | ZFN_binding_27: CGAGATCGAGGCCAGATCG | 6205 |
| optimal_loci_288388 | OGL25 | 118660 | ZFN_binding_28: TTGCCATGGGTTATTGAG | 6206 |
| | | | ZFN_binding_29: GGAGCATGGCCAGGTAGTG | 6207 |
| optimal_loci_60310 | OGL26 | 118767 | ZFN_binding_30: CCAGTTCCGACGAGTGGCG | 6208 |
| | | | ZFN_binding_31: GGCCTGGGCGAACGCCGCCG | 6209 |
| optimal_loci_243330 | OGL27 | 118769 | ZFN_binding_32: AGTGCAAGGGAAGAC | 6210 |
| | | | ZFN_binding_33: AGGAGGGATGGAGCAGCG | 6211 |
| optimal_loci_127038 | OGL28 | 118663 | ZFN_binding_34: GGAGATAGGAGTAGCT | 6212 |
| | | | ZFN_binding_35: GTTGCGCCCTACGAA | 6213 |
| optimal_loci_262784 | OGL29 | 118668 | ZFN_binding_36: TCGGTTGACCGATGGC | 6214 |
| | | | ZFN_binding_37: AACGAGCCATATGCAAGTT | 6215 |
| optimal_loci_344662 | OGL30 | 118669 | ZFN_binding_38: GGATGGCTCCGAATGATATG | 6216 |
| | | | ZFN_binding_39: GAGGGCGTCTTGAGG | 6217 |
| optimal_loci_153894 | OGL31 | 118670 | ZFN_binding_40: GTGTTGCTGTACGAC | 6218 |
| | | | ZFN_binding_41: GCAGCGAACGGCTGTA | 6219 |
| optimal_loci_28771 | OGL32 | 118673 | ZFN_binding_42: GGGTAGGGGTGACGTA | 6220 |
| | | | ZFN_binding_43: GATCACGACATATCCA | 6221 |
| optimal_loci_1098 | OGL33 | 118674 | ZFN_binding_44: TGGGTGGGTTTGCGTG | 6222 |
| | | | ZFN_binding_45: CCCATGCAGGTAAAGGTA | 6223 |
| optimal_loci_97772 | OGL34 | 118676 | ZFN_binding_46: GGACTGGGTGCCTGTGTG | 6224 |
| | | | ZFN_binding_47: CGTGGGTACGAA | 6225 |
| optimal_loci_236662 | OGL35 | 118677 | ZFN_binding_48: CGTGCTGTGGTCTGGCGTA | 6226 |
| | | | ZFN_binding_49: TGGGGCTATGGCCATGGGG | 6227 |

TABLE 8-continued

Zinc finger target site of Zea mays selected genomic loci

| Locus ID | Name | pDAB Number | ZFP Number and Binding Site (5'→3') | SEQ ID NO: |
|---|---|---|---|---|
| optimal_loci_139485 | OGL36 | 118680 | ZFN_binding_50: GCGGTACGATAGTGTT | 6228 |
| | | | ZFN_binding_51: ACTCGGGGAGTCGGGGTC | 6229 |
| optimal_loci_301175 | OGL37 | 118683 | ZFN_binding_52: GACGGATCGGAG | 6230 |
| | | | ZFN_binding_53: GGCGGATGCATCCGTT | 6231 |
| optimal_loci_152337 | OGL38 | 118685 | ZFN_binding_54: ATAGCGGACCGATCGG | 6232 |
| | | | ZFN_binding_55: ATCCCGGCCGGTCGATTCG | 6233 |
| optimal_loci_202616 | OGL39 | 123833 | ZFN_binding_56: cgtgcttgcggcaccgcag | 6234 |
| | | | ZFN_binding_57: gccgctgcacccgttcat | 6235 |
| optimal_loci_282323 | OGL40 | 118771 | ZFN_binding_58: GAGGACAGGCGAGCT | 6236 |
| | | | ZFN_binding_59: GAAGACGTAGGCGCA | 6237 |
| optimal_loci_262782 | OGL41 | 121943 | ZFN_binding_60: CACAAGATGGTGATGGTC | 6238 |
| | | | ZFN_binding_61: CATGTATGTATGTAGTAG | 6239 |
| optimal_loci_236455 | OGL42 | 121946 | ZFN_binding_62: TCGGCCATGGGA | 6240 |
| | | | ZFN_binding_63: GCGGCCAAAAAGCATGTA | 6241 |
| optimal_loci_162531 | OGL43 | 121949 | ZFN_binding_64: GGTGCCAAAGCCATGCAG | 6242 |
| | | | ZFN_binding_65: GGCTGGCGGGCGGCC | 6243 |
| optimal_loci_344663 | OGL44 | 121952 | ZFN_binding_66: GGAGACTCGATAAGAA | 6244 |
| | | | ZFN_binding_67: GCCATGTGGGGTAGTT | 6245 |
| optimal_loci_337001 | OGL45 | 121959 | ZFN_binding_68: CATGGCATGGCATCG | 6246 |
| | | | ZFN_binding_69: CACATGCGCGGCGCATGTC | 6247 |
| optimal_loci_238100 | OGL46 | 121963 | ZFN_binding_70: TAGTAGGCTAGTAGCT | 6248 |
| | | | ZFN_binding_71: ACGCCGCGGCGGCTTGCGCT | 6249 |
| optimal_loci_264359 | OGL48 | 121971 | ZFN_binding_72: ATCTAGGTGCAACTAG | 6250 |
| optimal_loci_282653 | OGL49 | 121972 | ZFN_binding_73: GTGAAACGGATGTGT | 6251 |
| | | | ZFN_binding_74: TCAGAATATCATGATGGCC | 6252 |
| optimal_loci_80282 | OGL50 | 124097 | ZFN_binding_75: TGCGAGCGCTGCATGG | 6253 |
| | | | ZFN_binding_76: GCTGGAGGGGCCAATGAT | 6254 |
| optimal_loci_291068 | OGL51 | 123818 | ZFN_binding_77: TATCCGATCCCG | 6255 |
| | | | ZFN_binding_78: TGTGTGGATGACGAAACG | 6256 |
| optimal_loci_56395 | OGL52 | 118705 | ZFN_binding_79: GGAGTAAGAAATGAC | 6257 |
| | | | ZFN_binding_80: TCCGCGTTGCTGTCTGAA | 6258 |
| optimal_loci_114664 | OGL54 | 118711 | ZFN_binding_81: TATCAGCTCGAG | 6259 |
| | | | ZFN_binding_82: TAGACCTGTTTTGATGGTT | 6260 |
| optimal_loci_53137 | OGL57 | 118718 | ZFN_binding_83: GAAGACGGCGGCGAGAGCT | 6261 |
| | | | ZFN_binding_84: AGGGAAGAGAGGAGGA | 6262 |
| optimal_loci_344664 | OGL58 | 118722 | ZFN_binding_85: GCACAGATCAGGGCT | 6263 |
| | | | ZFN_binding_86: AAGGATTTGCACAGACAG | 6264 |
| optimal_loci_81941 | OGL59 | 118726 | ZFN_binding_87: GCGGCAGCCATAGGA | 6265 |
| | | | ZFN_binding_88: GTGCATGCGTATCCA | 6266 |
| optimal_loci_321514 | OGL60 | 118728 | ZFN_binding_89: GAGGGTCTTGGGGTGATATC | 6267 |
| | | | ZFN_binding_90: AGGAAAGCCCAAGGA | 6268 |
| optimal_loci_301180 | OGL61 | 118732 | ZFN_binding_91: GTACAAGAGTAGTAG | 6269 |
| | | | ZFN_binding_92: TCGATCGAGGGCGCA | 6270 |
| optimal_loci_348776 | OGL62 | 118733 | ZFN_binding_93: CCACCGTCTCCGTAGGCC | 6271 |
| | | | ZFN_binding_94: GTGTCGAGAGCT | 6272 |
| optimal_loci_244439 | OGL63 | 118735 | ZFN_binding_95: ATAGAAAACCATGGCGGAG | 6273 |
| | | | ZFN_binding_96: AAGGGGCGGCAACGGA | 6274 |
| optimal_loci_348258 | OGL64 | 118739 | ZFN_binding_97: GTTGTCGGATAACCG | 6275 |
| | | | ZFN_binding_98: GAGGGGGAGTAGCTAGGT | 6276 |

TABLE 8-continued

Zinc finger target site of Zea mays selected genomic loci

| Locus ID | Name | pDAB Number | ZFP Number and Binding Site (5'→3') | SEQ ID NO: |
|---|---|---|---|---|
| optimal_loci_322501 | OGL65 | 118742 | ZFN_binding_99: GGACGAGACCAAATCG | 6277 |
| | | | ZFN_binding_100: CAAGGAGACAAAGCT | 6278 |
| optimal_loci_244324 | OGL66 | 118745 | ZFN_binding_101: TACGTGGCAATTGGCA | 6279 |
| | | | ZFN_binding_102: TCAGATGCTGCAGCT | 6280 |
| optimal_loci_97232 | OGL67 | 124081 | ZFN_binding_103: AGAAGATCGATCGGTA | 6281 |
| | | | ZFN_binding_104: GCTTGAGCTCACGCA | 6282 |
| optimal_loci_282499 | OGL68 | 125361 | ZFN_binding_105: CACTACTACTACTACCGCC | 6283 |
| | | | ZFN_binding_106: GGGTGGGGGGCA | 6284 |
| optimal_loci_155031 | OGL69 | 118753 | ZFN_binding_107: GGACCTACAATAGGCA | 6285 |
| | | | ZFN_binding_108: GATCACAAGACCAAG | 6286 |
| optimal_loci_301773 | OGL70 | 124878 | ZFN_binding_109: CATTGTCAGTTCCTT | 6287 |
| | | | ZFN_binding_110: CAGCAGGACTCT | 6288 |
| optimal_loci_283161 | OGL71 | 123829 | ZFN_binding_111: AAGACAGACGATGTC | 6289 |
| | | | ZFN_binding_112: ACAAAAAAGCAAGAA | 6290 |
| optimal_loci_55524 | OGL72 | 118761 | ZFN_binding_113: TCACGGTGTTACCCATGTA | 6291 |
| | | | ZFN_binding_114: GACGGATGCGTACGTG | 6292 |
| optimal_loci_127268 | OGL73 | 124086 | ZFN_binding_131: GTTGTTATTCAAACA | 6293 |
| | | | ZFN_binding_132: CACAAGTAATGTGGA | 6294 |
| optimal_loci_137693 | OGL74 | 121904 | ZFN_binding_115: GCGGCTGGTTTGCAG | 6295 |
| | | | ZFN_binding_116: CACGGACAGGAG | 6296 |
| optimal_loci_265551 | OGL75 | 121905 | ZFN_binding_117: GAGGCGGAGGTG | 6297 |
| | | | ZFN_binding_118: AGGGCGGAAGTTACGGAG | 6298 |
| optimal_loci_128078 | OGL76 | 121917 | ZFN_binding_119: GGAGCCCCCAGCGTGGGTT | 6299 |
| | | | ZFN_binding_120: GACCGGTCAGTAGGTCAAG | 6300 |
| optimal_loci_168286 | OGL77 | 121918 | ZFN_binding_121: TTCACGTCATGCT | 6301 |
| | | | ZFN_binding_122: GCCGACGACTAGGAGGTA | 6302 |
| optimal_loci_3733 | OGL78 | 121909 | ZFN_binding_123: CTGTAGGGCGTCGTC | 6303 |
| | | | ZFN_binding_124: GTAGCGGTACTACTGG | 6304 |
| optimal_loci_203075 | OGL79 | 121912 | ZFN_binding_125: ATCCAGGCAGCTGGCGGC | 6305 |
| | | | ZFN_binding_126: GATTGGAATGCAGGCCCG | 6306 |
| optimal_loci_232484 | OGL80 | 121981 | ZFN_binding_127: GATGCGTCTGGTGTGACGAC | 6307 |
| | | | ZFN_binding_128: ACACAGTCCTACTAG | 6308 |
| optimal_loci_136086 | OGL81 | 124091 | ZFN_binding_129: GCTCGAAAACTTATG | 6309 |
| | | | ZFN_binding_130: ATGAAAGATGACCGA | 6310 |
| optimal_loci_228254 | OGL55 | n/a | TTCATGGTTGTTACCACTCatnnnatGATCCCTTTGAAGTAAAC | 6686 |
| optimal_loci_66202 | OGL47 | n/a | TTCTACGATTACTTCtannctGCTAGTCAGATTGAA | 6687 |
| optimal_loci_120993 | OGL56 | n/a | TGATGCAAGGTGGCGTAAGgnnggGACATAAAGAGGCAG | 6688 |
| optimal_loci_200497 | OGL53 | n/a | GATTACCTCCACCTTtnnctAGGCCCTAATATCGAA | 6689 |
| optimal_loci_5607 | OGL03 | n/a | ATCCCTCTATCCTTCACGaannGAACGATCTCGAAGGACGAT | 6690 |

The *Zea mays* representative genomic loci zinc finger designs were incorporated into zinc finger expression vectors encoding a protein having at least one finger with a CCHC structure. See, U.S. Patent Publication No. 2008/0182332. In particular, the last finger in each protein had a CCHC backbone for the recognition helix. The non-canonical zinc finger-encoding sequences were fused to the nuclease domain of the type IIS restriction enzyme FokI (amino acids 384-579 of the sequence of Wah et al., (1998) Proc. Natl. Acad. Sci. USA 95:10564-10569) via a four amino acid ZC linker and an opaque-2 nuclear localization signal derived from *Zea mays* to form zinc-finger nucleases (ZFNs). See, U.S. Pat. No. 7,888,121. Zinc fingers for the various functional domains were selected for in vivo use. Of the numerous ZFNs that were designed, produced and tested to bind to the putative genomic target site, the ZFNs described in Table 8 above were identified as having in vivo activity and were characterized as being capable of efficiently binding and cleaving the unique *Zea mays* genomic polynucleotide target sites in planta.

ZFN Construct Assembly

Plasmid vectors containing ZFN gene expression constructs, which were identified as previously described, were designed and completed using skills and techniques commonly known in the art (see, for example, Ausubel or Maniatis). Each ZFN-encoding sequence was fused to a sequence encoding an opaque-2 nuclear localization signal (Maddaloni et al., (1989) Nuc. Acids Res. 17:7532), that was positioned upstream of the zinc finger nuclease. The non-canonical zinc finger-encoding sequences were fused to the nuclease domain of the type IIS restriction enzyme FokI (amino acids 384-579 of the sequence of Wah et al. (1998) Proc. Natl. Acad. Sci. USA 95:10564-10569). Expression of the fusion proteins was driven by the strong constitutive promoter from the *Zea mays* Ubiquitin gene, (which includes the 5' untranslated region (UTR) (Toki et al., (1992) Plant Physiology 100; 1503-07). The expression cassette also included the 3' UTR (comprising the transcriptional terminator and polyadenylation site) from the *Zea mays* peroxidase 5 gene (Per5) gene (US Patent Publication No. 2004/0158887). The self-hydrolyzing 2A encoding the nucleotide sequence from *Thosea asigna* virus (Szymczak et al., (2004) Nat Biotechnol. 22:760-760) was added between the two Zinc Finger Nuclease fusion proteins that were cloned into the construct.

The plasmid vectors were assembled using the IN-FUSION™ Advantage Technology (Clontech, Mountain View, Calif.). Restriction endonucleases were obtained from New England BioLabs (Ipswich, Mass.) and T4 DNA Ligase (Invitrogen, Carlsbad, Calif.) was used for DNA ligation. Plasmid preparations were performed using NUCLEOSPIN® Plasmid Kit (Macherey-Nagel Inc., Bethlehem, Pa.) or the Plasmid Midi Kit (Qiagen) following the instructions of the suppliers. DNA fragments were isolated using QIAQUICK GEL EXTRACTION KIT™ (Qiagen) after agarose tris-acetate gel electrophoresis. Colonies of all ligation reactions were initially screened by restriction digestion of miniprep DNA. Plasmid DNA of selected clones was sequenced by a commercial sequencing vendor (Eurofins MWG Operon, Huntsville, Ala.). Sequence data were assembled and analyzed using the SEQUENCHER™ software (Gene Codes Corp., Ann Arbor, Mich.).

Plasmids were constructed and confirmed via restriction enzyme digestion and via DNA sequencing.

Zinc Finger Cloning Via Automated Workflow

A subset of Zinc Finger Nuclease vectors were cloned via an automated DNA construction pipeline. Overall, the automated pipeline resulted in vector constructions with identical ZFN architecture as described previously. Each Zinc Finger monomer, which confers the DNA binding specificity of the ZFN, were divided into 2-3 unique sequences at a KPF amino acid motif. Both the 5' and 3' ends of the ZFN fragments were modified with inclusion of a BsaI recognition site (GGTCTCN) and derived overhangs. Overhangs were distributed such that a 6-8 part assembly would only result in the desired full length expression clone. Modified DNA fragments were synthesized de novo (Synthetic Genomics Incorporated, La Jolla, Calif.). A single maize backbone, pDAB118791 was used in all of the maize ZFN builds. It contained the ZmUbi1 promoter and the Opaque2 NLS as well as the FokI domain and the ZmPer5 3'UTR. Cloned in between the Opaque 2 NLS and the FokI domain was a BsaI flanked SacB gene from *Bacillus subtilis*. When putative ligation events were plated on Sucrose containing media, the SacB cassette acts as a negative selection agent reducing or eliminating vector backbone contamination. A second part repeatedly utilized in all builds was pDAB117462. This vector contains the first monomer Fok1 domain, the t2A stutter sequence, and the $2^{nd}$ monomer Opaque2 NLS all flanked by BsaI sites.

Using these materials as the ZFN DNA parts library, a Freedom Evo 150 (TECAN, Mannedorf, Switzerland) manipulated the addition of 75-100 ng of each DNA plasmid or synthesized fragment from 2D bar coded tubes into a PCR plate (ThermoFisher, Waltham, Mass.). BsaI (NEB, Ipswich, Mass.) and T4 DNA ligase (NEB, Ipswich, Mass.) supplemented with Bovine Serum Albumin protein (NEB, Ipswich, Mass.) and T4 DNA Ligase Buffer (NEB, Ipswich, Mass.) were added to the reaction. Reactions were cycled (25×) with incubations for 3 minutes at 37° C. and 4 minutes at 16° C. C1000 Touch Thermo Cycler (BioRad, Hercules Calif.). Ligated material was transformed and screened in Top10 cells (Life Technologies Carlsbad, Calif.) by hand or using a Qpix460 colony picker and LabChip GX (Perkin Elmer, Waltham, Mass.). Correctly digesting colonies were sequence confirmed provided to plant transformation.

Universal Donor Construct Assembly

To support rapid testing of a large number of target loci, a novel, flexible universal donor system sequence was designed and constructed. The universal donor polynucleotide sequence was compatible with high throughput vector construction methodologies and analysis. The universal donor system was composed of at least three modular domains: a variable ZFN binding domain, a non-variable analytical and user defined features domain, and a simple plasmid backbone for vector scale up. The non-variable universal donor polynucleotide sequence was common to all donors and permits design of a finite set of assays that can be used across all of the *Zea mays* target sites thus providing uniformity in targeting assessment and reducing analytical cycle times. The modular nature of these domains allowed for high throughput donor assembly. Additionally, the universal donor polynucleotide sequence has other unique features aimed at simplifying downstream analysis and enhancing the interpretation of results. It contains asymmetric restriction site sequence that allows the digestion of PCR products into diagnostically predicted sizes. Sequences comprising secondary structures that were expected to be problematic in PCR amplification were removed. The universal donor polynucleotide sequence is small in size (less than 3.0 Kb). Finally, the universal donor polynucleotide sequence was built upon the high copy pUC19 backbone that allows a large amount of test DNA to be bulked in a timely fashion.

Figure 7:
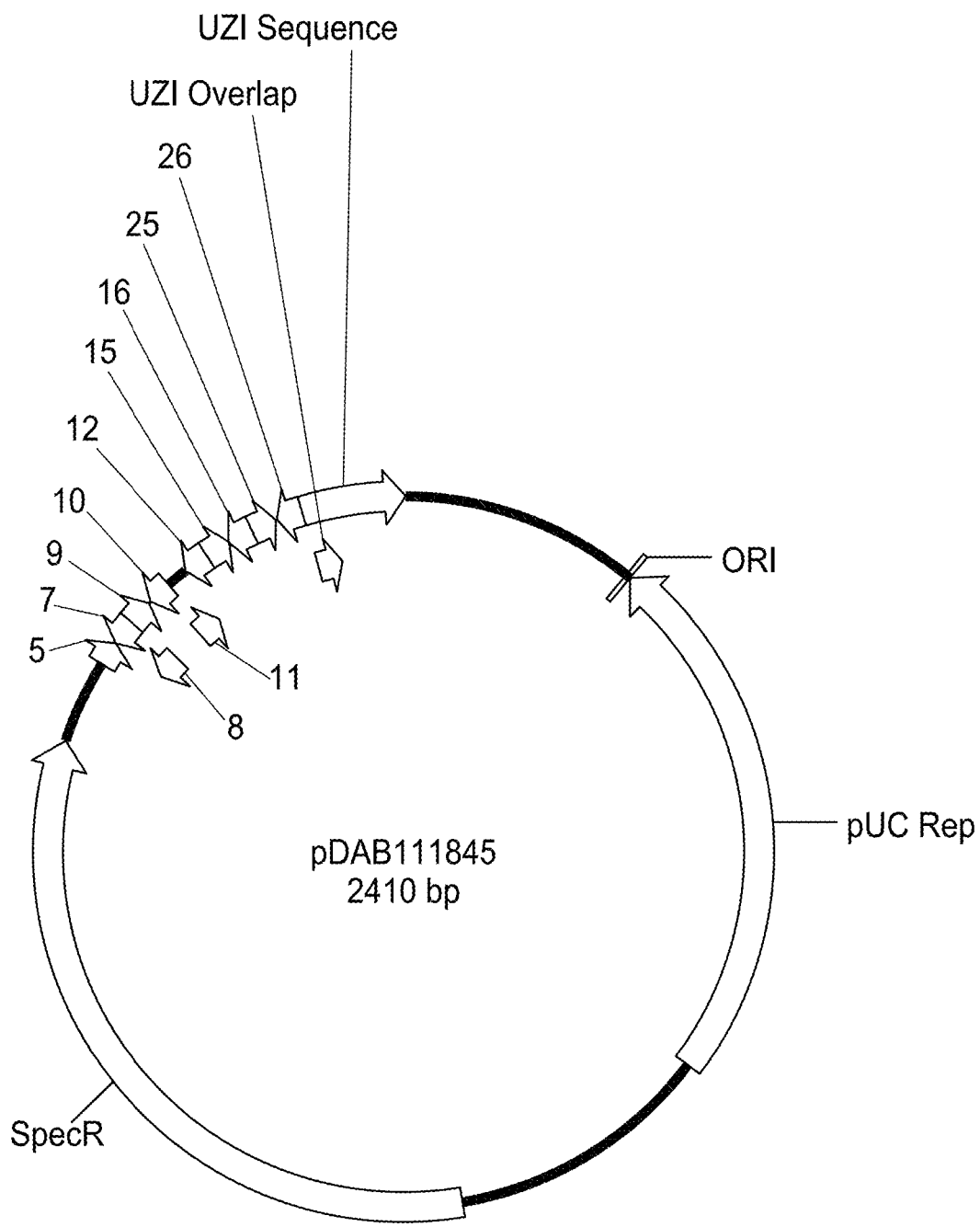
FIG. 7. Provides a plasmid map of pDAB111845 (SEQ ID NO:5418). The numbered elements (i.e., 5, 7, 8, 9, 10, 11, 12, 15, 16, 25, and 26) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette.
Figure 15:
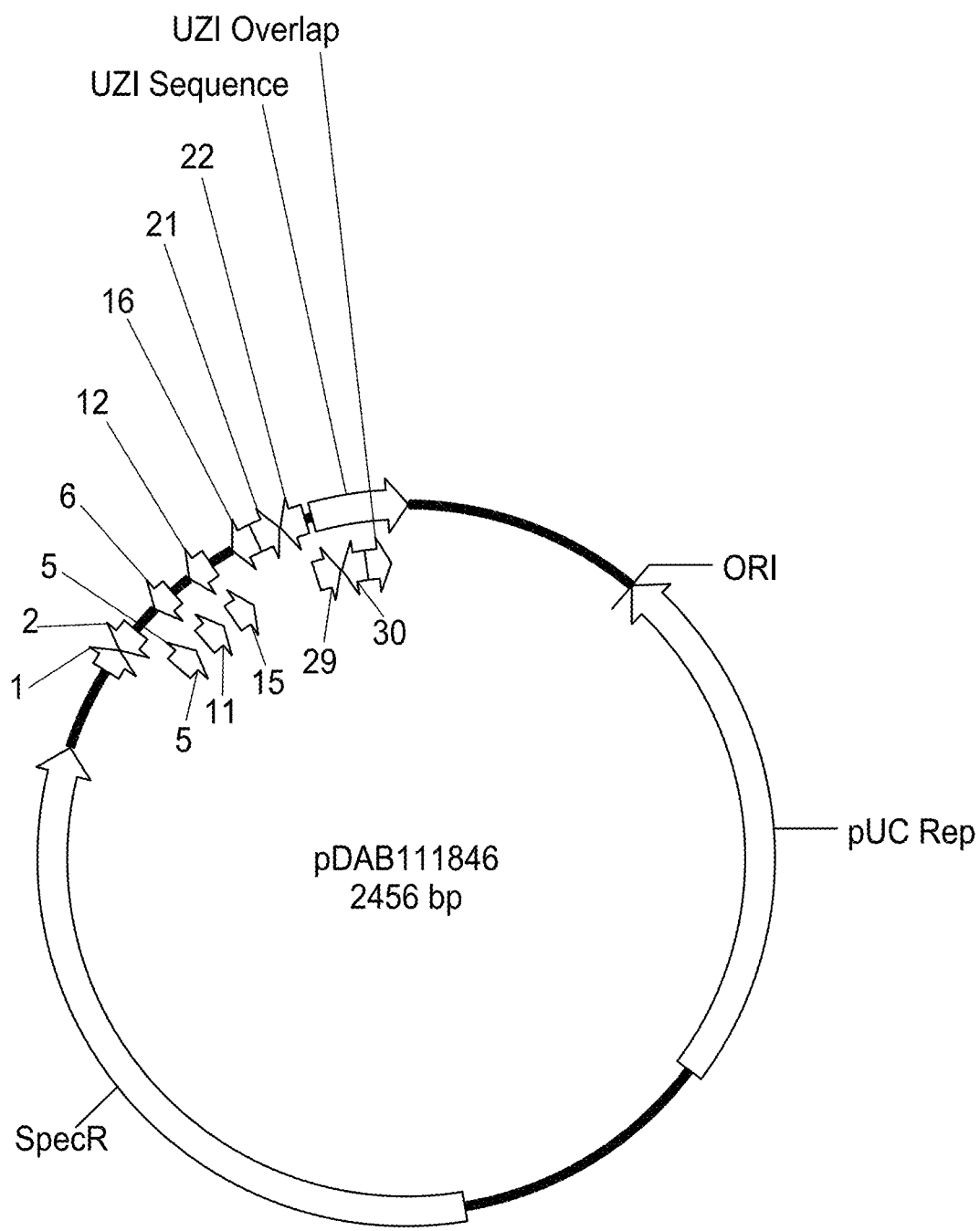
FIG. 15. Plasmid map of pDAB111846 (SEQ ID NO:5419). The numbered elements (i.e., 1, 2, 5, 6, 11, 12, 15, 16, 21, 22, 29 and 30) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette.
Figure 16:
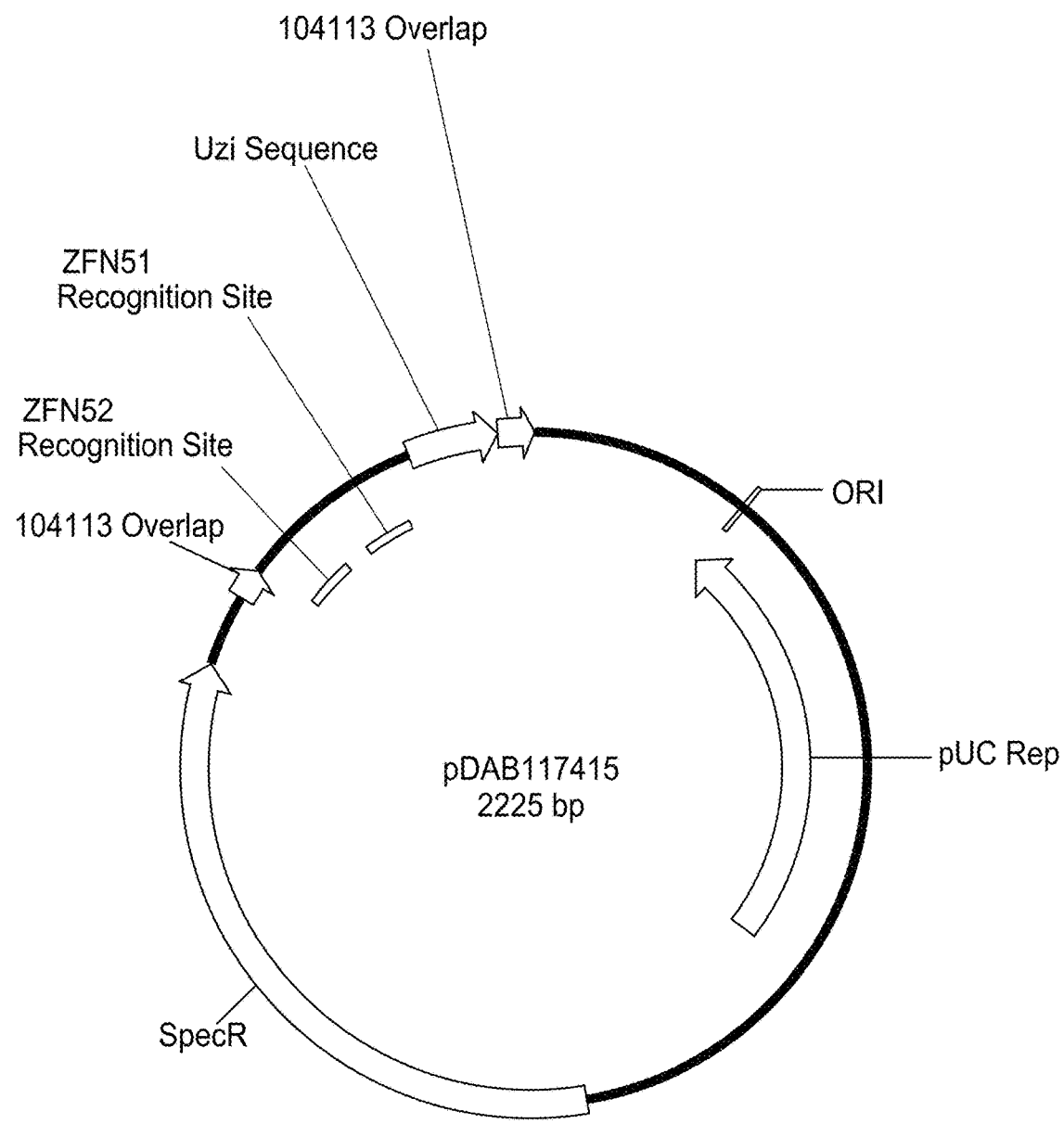
FIG. 16. Plasmid map of pDAB117415 (SEQ ID NO:5420). The numbered elements (i.e., ZFN51 and ZFN52) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 17:
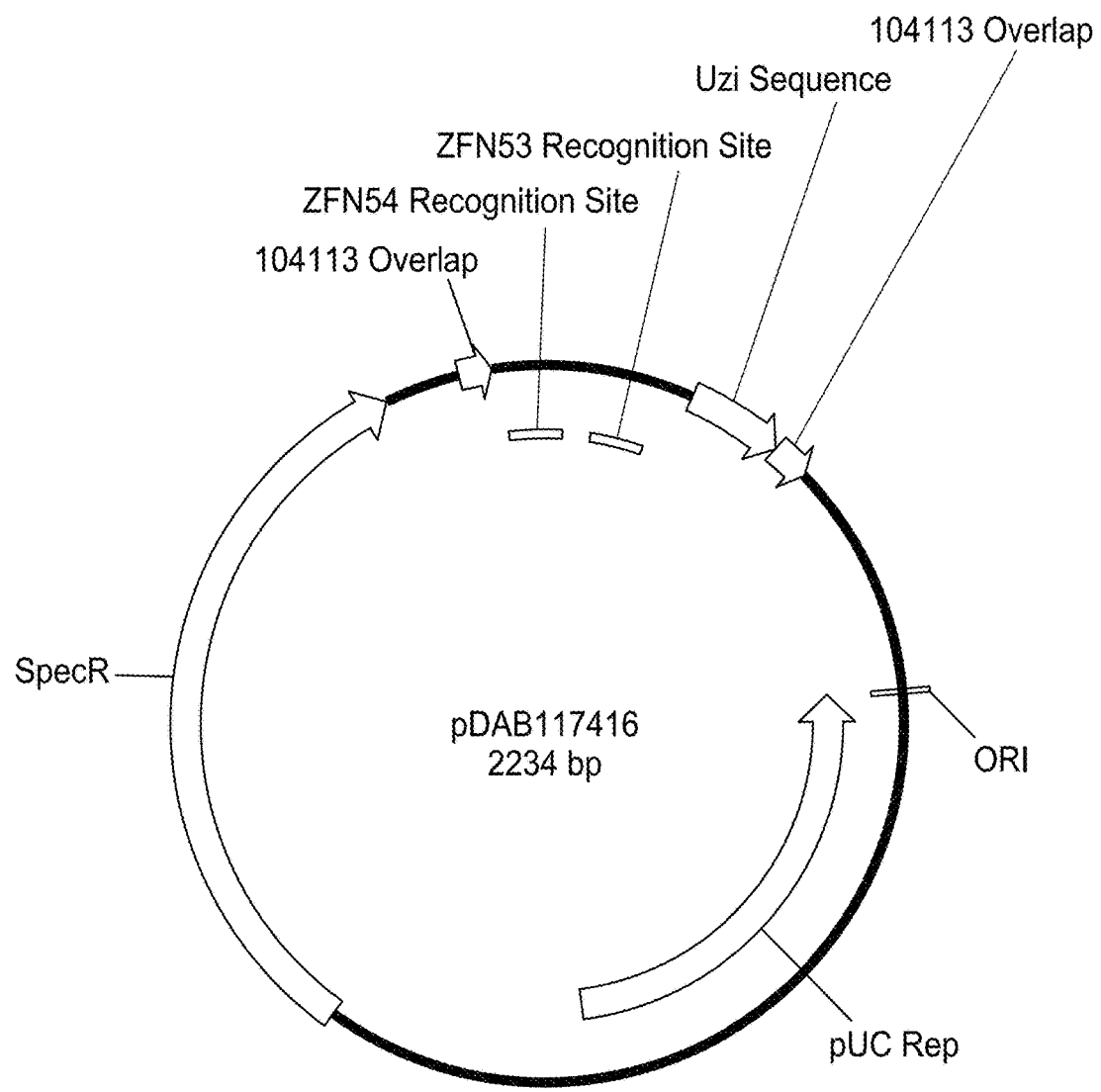
FIG. 17. Plasmid map of pDAB117416 (SEQ ID NO:5421). The numbered elements (i.e., ZFN54 and ZFN53) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 18:
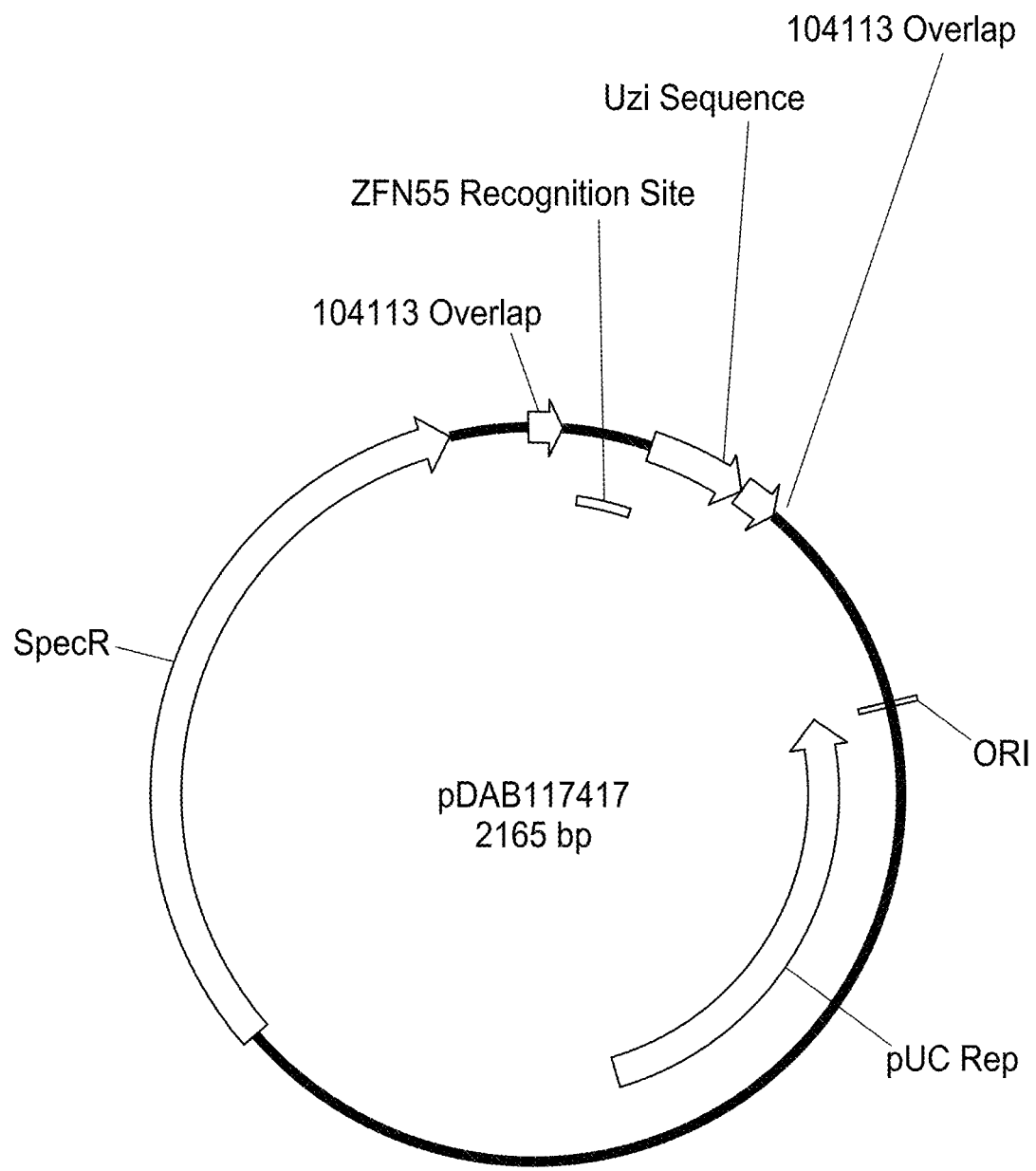
FIG. 18. Plasmid map of pDAB117417 (SEQ ID NO:5422). The numbered element (i.e., ZFN55) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 19:
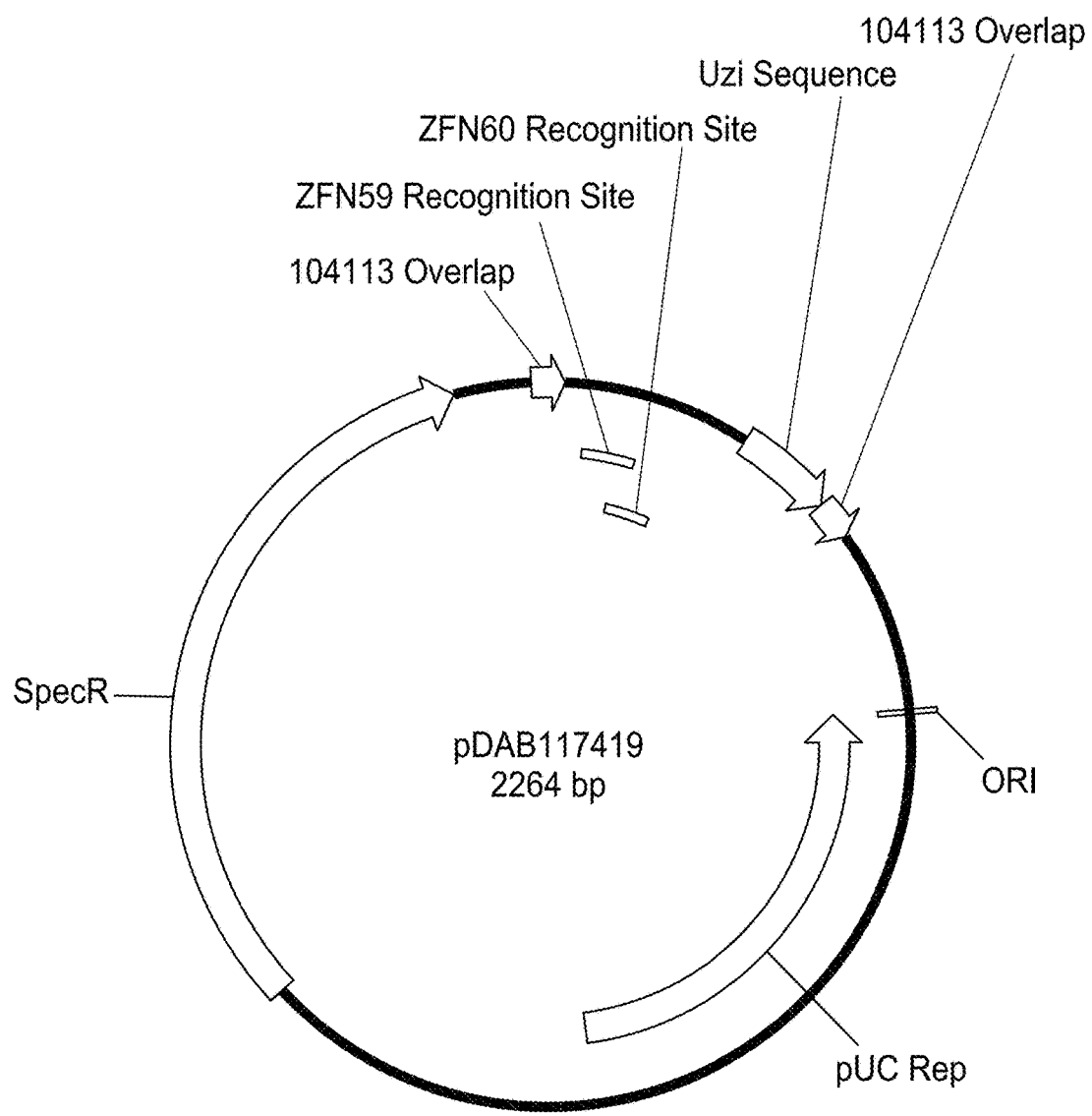
FIG. 19. Plasmid map of pDAB117419 (SEQ ID NO:5423). The numbered elements (i.e., ZFN59 and ZFN60) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 20:
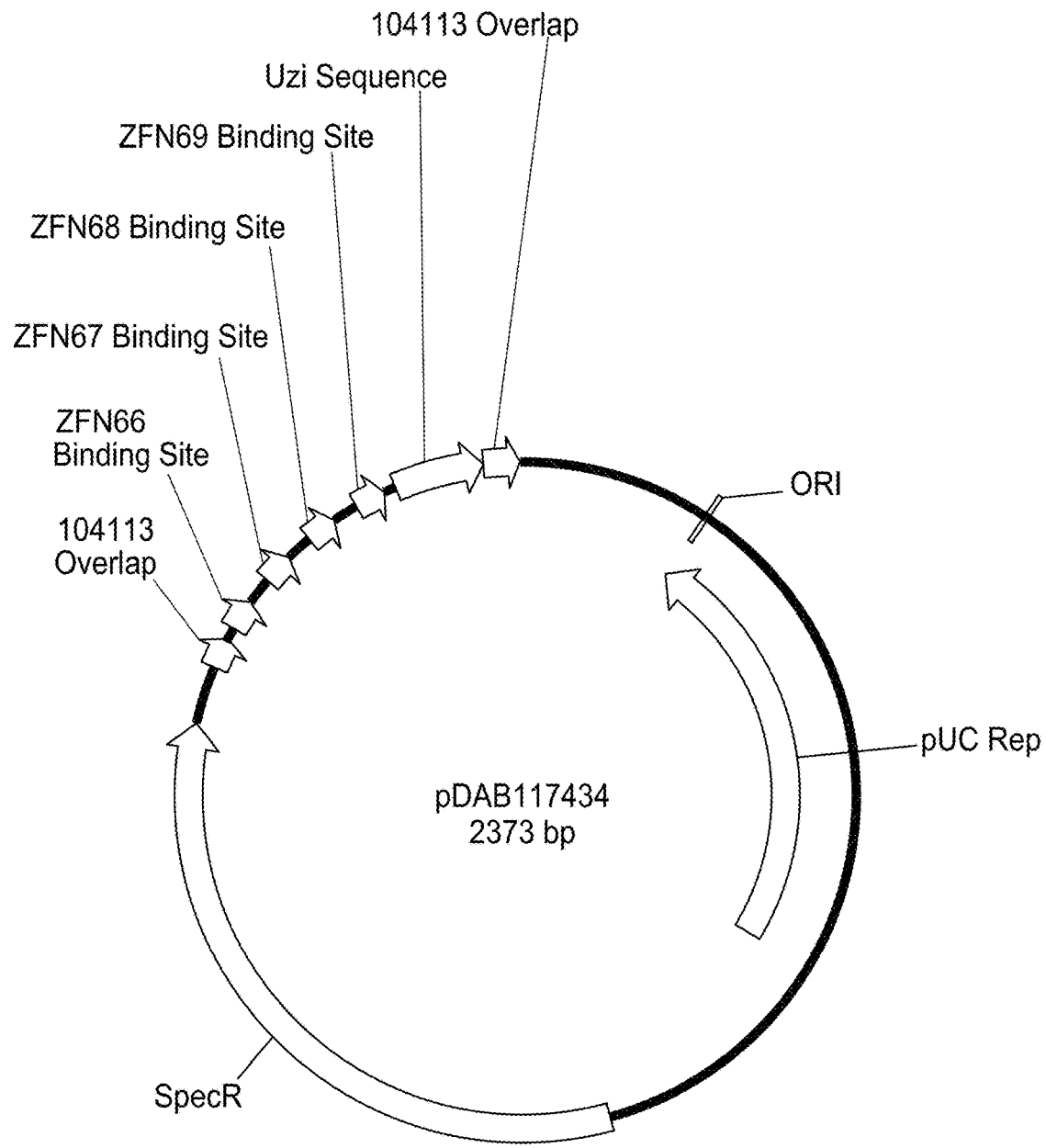
FIG. 20. Plasmid map of pDAB117434 (SEQ ID NO:5424). The numbered elements (i.e., ZFN66, ZFN67, ZFN68 and ZFN69) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 21:
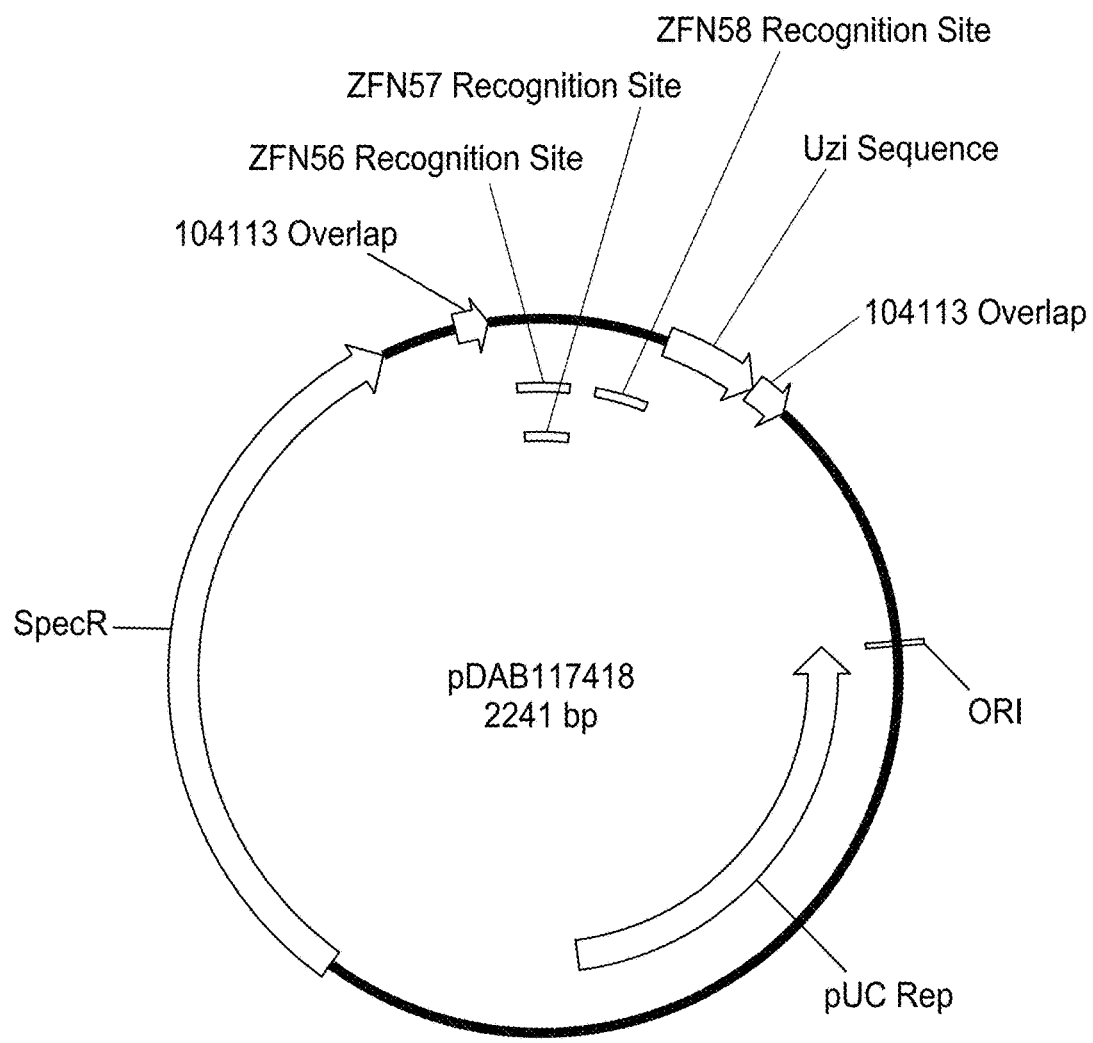
FIG. 21. Plasmid map of pDAB117418 (SEQ ID NO:5425). The numbered elements (i.e., ZFN56, ZFN57, and ZFN58) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 22:
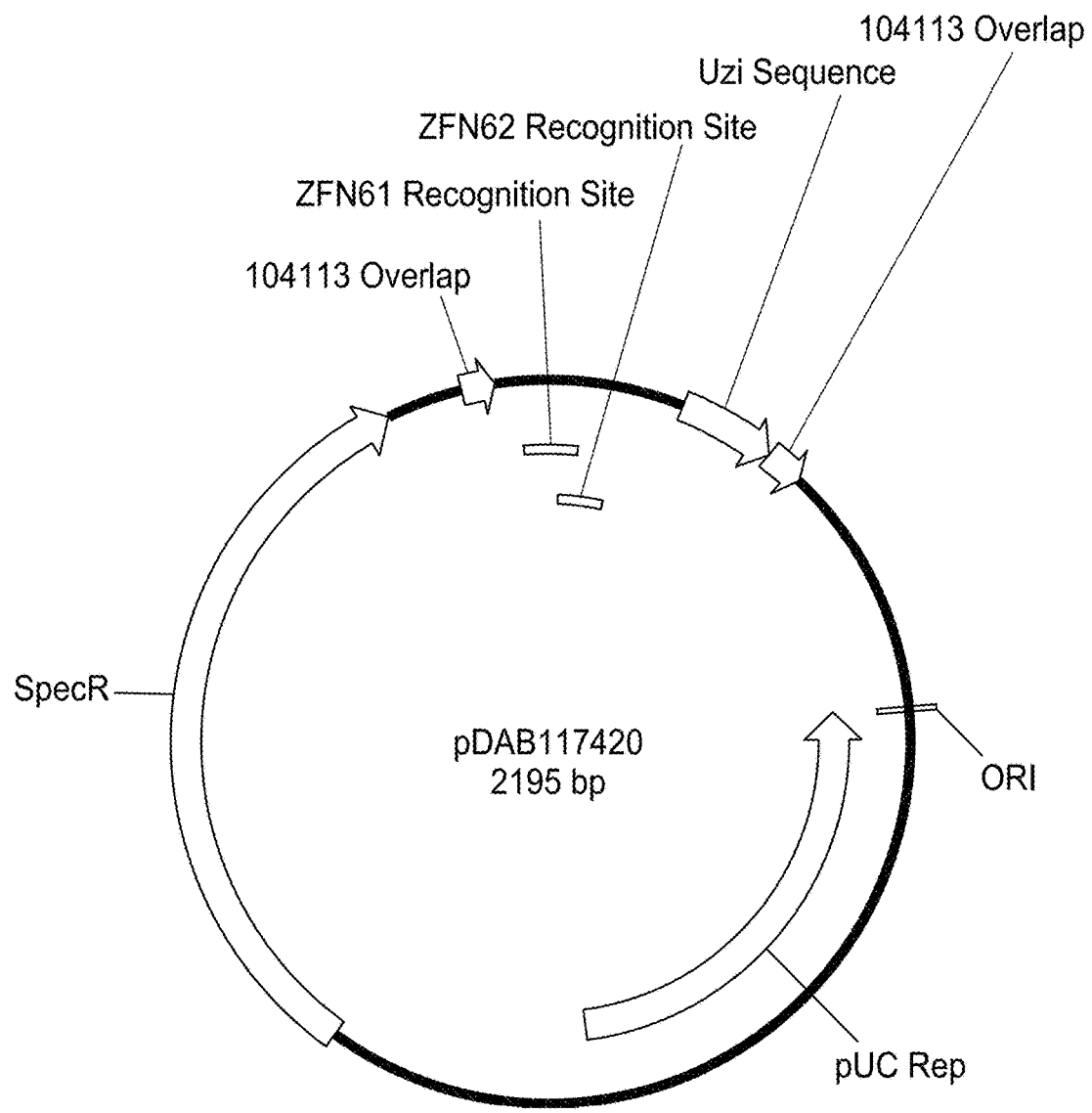
FIG. 22. Plasmid map of pDAB117420 (SEQ ID NO:5426). The numbered elements (i.e., ZFN61 and ZFN62) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).
Figure 23:
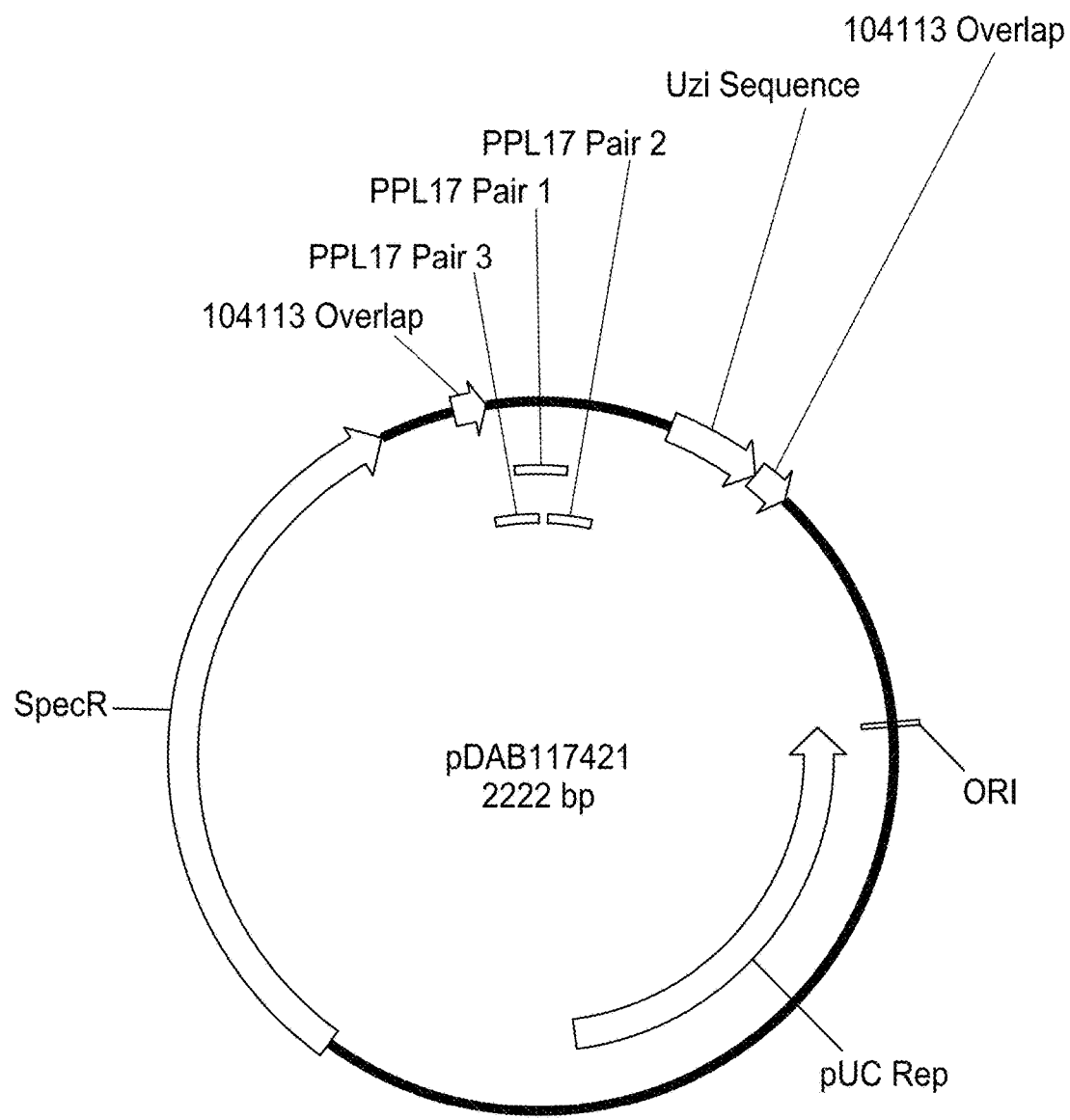
FIG. 23. Plasmid map of pDAB117421 (SEQ ID NO:5427). The numbered elements (i.e., PPL17 Pair 3, PPL17 Pair 1, and PPL17 Pair2) correspond with zinc finger nuclease binding sequences of about 20 to 35 base pairs in length that are recognized and cleaved by corresponding zinc finger nuclease proteins. These zinc finger binding sequences and the annotated "UZI Sequence" (which is a 100-150 bp template region containing restriction sites and DNA sequences for primer design or coding sequences) comprise the universal donor cassette. Further included in this plasmid design is the "104113 Overlap" which are sequences that share homology to the plasmid vector for high throughput assembly of the universal donor cassettes within a plasmid vector (i.e., via Gibson assembly).

As an embodiment, an example plasmid comprising a universal donor polynucleotide sequence is provided as SEQ ID NO:5418 and FIG. 7. In an additional embodiment, a universal donor polynucleotide sequence is provided as: pDAB11846, SEQ ID NO:5419, FIG. 15; pDAB117415, SEQ ID NO:5420, FIG. 16; pDAB117416, SEQ ID NO:5421, FIG. 17; pDAB117417, SEQ ID NO:5422, FIG. 18; pDAB117419, SEQ ID NO:5423, FIG. 19; pDAB117434 SEQ ID NO:5424, FIG. 20; pDAB117418, SEQ ID NO:5425, FIG. 21; pDAB117420, SEQ ID NO:5426, FIG. 22; and, pDAB117421, SEQ ID NO:5427, FIG. 23. In another embodiment, additional sequences comprising the universal donor polynucleotide sequence with functionally expressing coding sequence or nonfunctional (promoterless) expressing coding sequences can be constructed.

Figure 8:
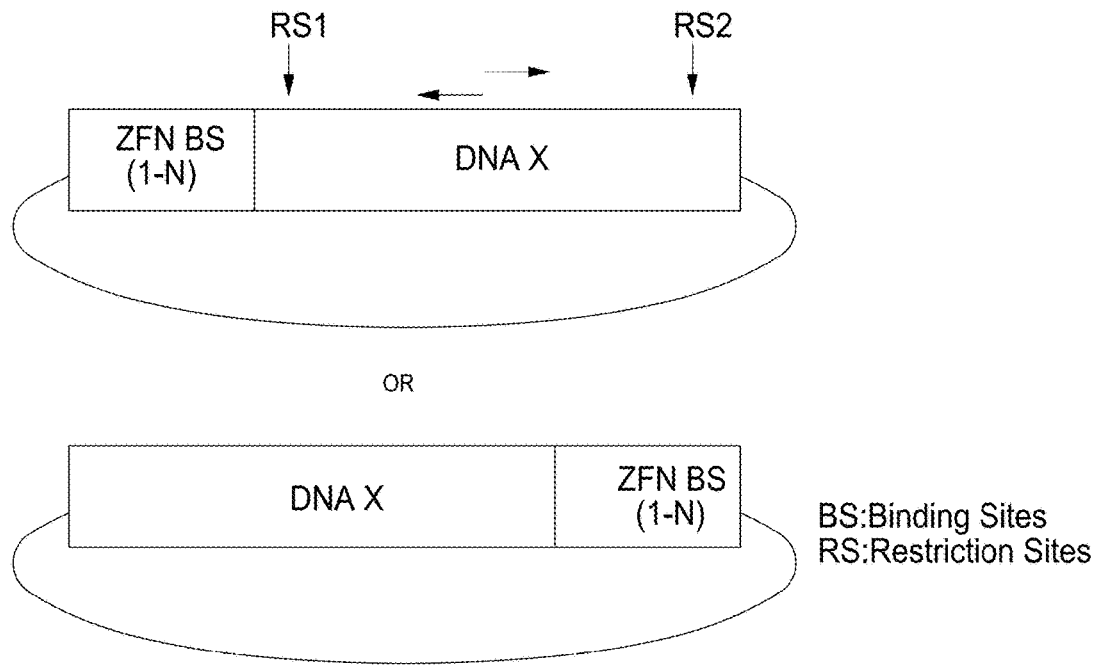
FIG. 8. Representation of the universal donor polynucleotide sequence for integration via non-homologous end joining (NHEJ). Two proposed vectors are provide wherein a DNA of interest (DNA X) comprises one or more (i.e., "1-N") zinc finger binding sites (ZFN BS) at either end of the DNA of interest. Vertical arrows show unique restriction sites and horizontal arrows represent potential PCR primer sites.

In another embodiment, the universal donor polynucleotide sequence is a small 2-3 Kb modular donor system delivered as a plasmid. This is a minimal donor, comprising any number of ZFN binding sites, a short 100-150 bp template region referred to as "DNA X" or "UZI Sequence" (SEQ ID NO:5428) that carries restriction sites and DNA sequences for primer design or coding sequences, and a simple plasmid backbone (FIG. 8). The entire plasmid was inserted through NHEJ following DNA double strand breaks at the appropriate ZFN binding site; the ZFN binding sites can be incorporated tandemly. This embodiment of a universal donor polynucleotide sequence was most suitable for rapid screening of target sites and ZFNs, and sequences that were difficult to amplify are minimized in the donor.

Figure 9:
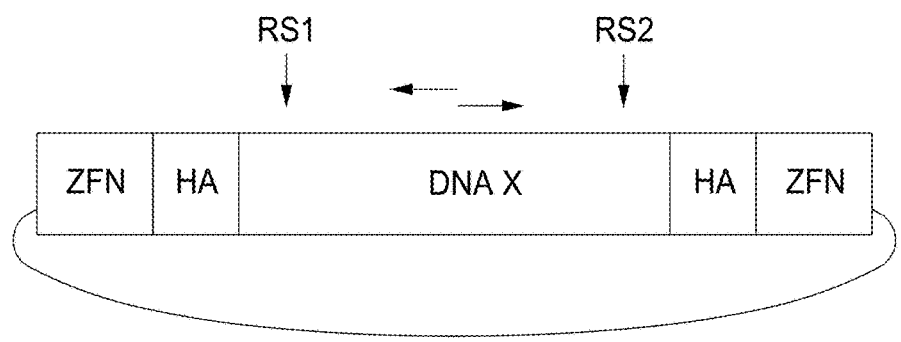
FIG. 9. Representation of the universal donor polynucleotide sequence for integration via homologous-directed repair (HDR). A DNA of interest (DNA X) comprising two regions of homologous sequences (HA) flanking the DNA of interest with zinc finger nuclease binding sites (ZFN) bracketing the DNAX and HA sequences. Vertical arrows show unique restriction sites and horizontal arrows represent potential PCR primer sites.

In a further embodiment the universal donor polynucleotide sequence was made up of at least 4 modules and carries ZFN binding sites, homology arms, DNA X with either just the approximately 100 bp analytical piece or coding sequences. This embodiment of the universal donor polynucleotide sequence was suitable for interrogating HDR mediated gene insertion at a variety of target sites, with several ZFNs (FIG. 9).

The universal donor polynucleotide sequence can be used with all targeting molecules with defined DNA binding domains, with two modes of targeted donor insertion (NHEJ/HDR). As such, when the universal donor polynucleotide sequence was co-delivered with the appropriate ZFN expression construct, the donor vector and the maize genome was cut in one specific location dictated by the binding of the particular ZFN. Once linearized, the donor can be incorporated into the genome by NHEJ or HDR. The different analytical considerations in the vector design can then be exploited to determine the Zinc Finger which maximizes the efficient delivery of targeted integration. (FIG. 10).

Example 4: Zea mays Transformation Procedures

Figure 11:
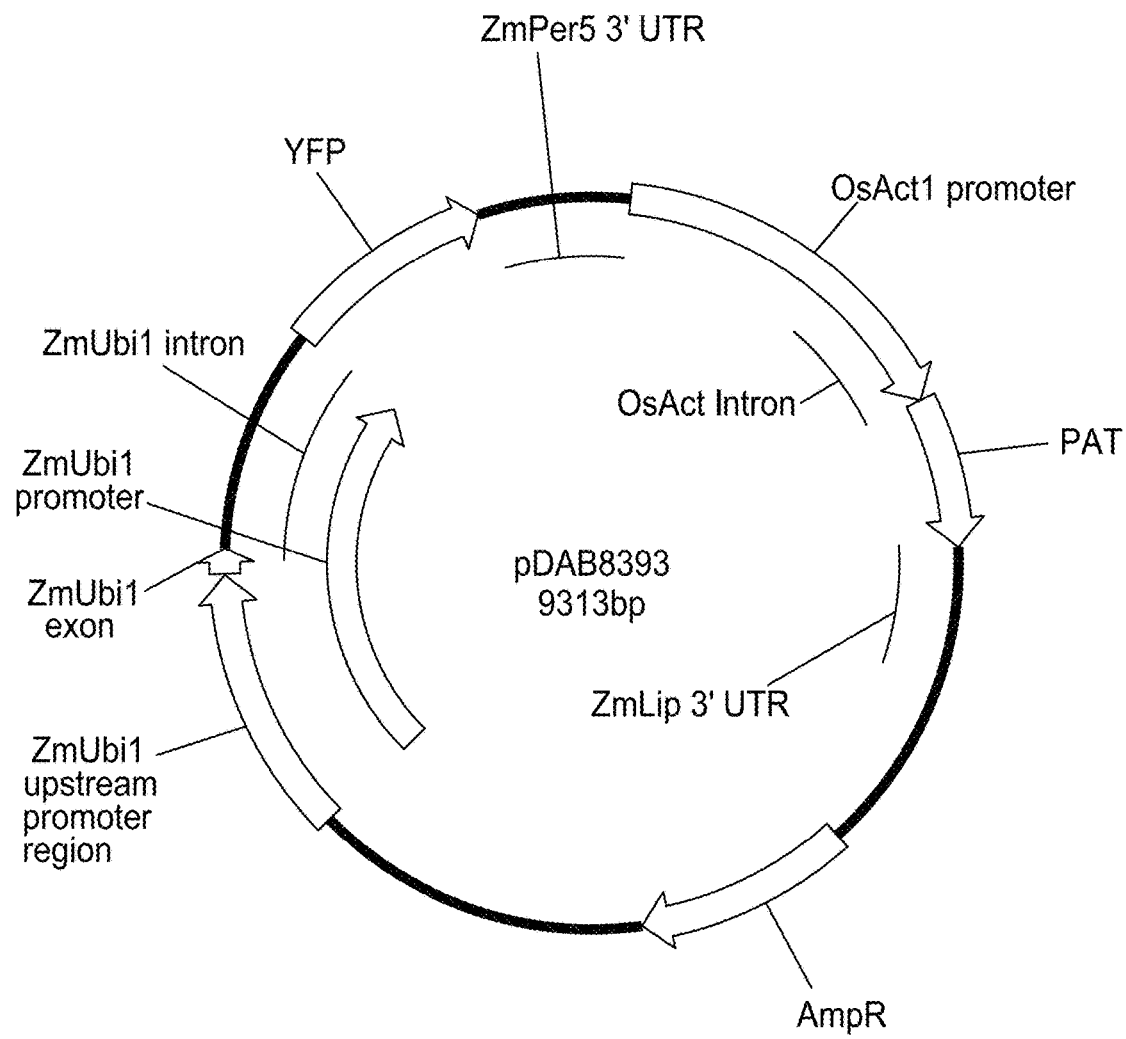
FIG. 11. Plasmid map of pDAB8393.

Before delivery to Zea mays c.v. Hi-II protoplasts, plasmid DNA for each ZFN construct was prepared from cultures of E. coli using the PURE YIELD PLASMID MAXIPREP SYSTEM® (Promega Corporation, Madison, Wis.) or PLASMID MAXI KIT® (Qiagen, Valencia, Calif.) following the instructions of the suppliers.
Protoplast Isolation Zea mays c.v. Hi-II suspension cells were maintained at a 3.5 day maintenance schedule, 4 mL packed cell volume (PCV) of cells were collected and transferred to 50 mL sterile conical tubes (Fisher Scientific) containing 20 mL of enzyme solution (0.6% PECTOLYASE™, 6% CELLULASE™ ("Onozuka" R10; Yakult Pharmaceuticals, Japan), 4 mM MES (pH 5.7), 0.6 M mannitol, 15 mM $MgCl_2$). The cultures were capped and wrapped in PARAFILM™ and placed on a platform rocker (Thermo Scientific, Vari Mix platform Rocker) at speed setting 10 for incubation for 16-18 hours at room temperature until protoplasts were released. Following incubation, a drop of cells was checked under microscope to check the quality of digestion and digested cells were filtered through 100 µm cell strainer, rinsed with 10 mL W5 media [2 mM MES (pH5.7), 205 mM NaCl, 167 mM $CaCl_2$, 6.7 mM KCl], followed by filtering through 70 µm and 40 µm cell strainers. The 100 µm and 40 µm strainer was rinsed with 10 mL W5 media. The filtered protoplasts along with rinsed media were collected in 50 mL centrifuge tube and final volume was approximately 40 mL. 8 mL of "Heavy Gradient solution" [500 mM sucrose, 1 mM $CaCl_2$, 5 mM MES (pH6.0)] was then slowly added to the bottom of the protoplast/enzyme solution, centrifuged in a centrifuge with a swing arm bucket rotor for 15 minutes at 300-350×g. Following centrifugation, about 7-8 mL of protoplast band was removed, washed with 25 mL of W5, and centrifuged for 15 minutes at 180-200×g. The protoplasts were then resuspended in 10 mLs of MMG solution[4 mM MES (pH 5.7), 0.6 M mannitol, 15 mM $MgCl_2$]. Protoplasts were counted using a haemocytometer or flow cytometer and diluted to 1.67 million per mL using MMG.
Transformation of Zea mays c.v. HI-II Suspension Culture Derived Protoplasts Using PEG Approximately 0.5 million protoplasts (300 µl in MMG solution) were transferred to 2 mL tubes, and mixed with 40 µl of DNA and incubated at room temperature for 5-10 minutes. Next, 300 µl of freshly prepared PEG solution[36% PEG 4000, 0.3 M mannitol, 0.4M $CaCl_2$] was added, and the mixture was incubate at room temperature 15-20 minutes with periodic mixing by inversion. After incubation, 1 ml of W5 wash was added slowly and mixed gently and protoplasts were pelleted by centrifugation at 180-200×g for 15 minutes. The pellet was resuspended in 1 mL of WI media [4 mM MES (pH 5.7), 0.6 M mannitol, 20 mM KCl] and protoplast containing tube wrapped with aluminum foil and incubated in room temperature overnight for about 16 hours.
Transformation of ZFN and Donor For each of the selected genomic loci of Table 5, the Zea mays protoplasts were transfected with a yfp gene expressing control, ZFN alone, donor alone and a mixture of ZFN and donor at 1:10 ratio (by weight). The total amount of DNA for transfection of 0.5 million protoplasts was 80 µg. All treatments were conducted in replicates of either 3 or 6. The yfp gene expressing control used was pDAB8393 (FIG. 11) containing the Zea mays Ubiquitin 1 promoter—yellow fluorescent protein coding sequence—Zea mays Per5 3'UTR and the Rice Actin1 promoter—pat coding sequence—Zea mays lipase 3'UTR gene expression cassettes. To provide a consistent amount of total DNA per transfection, either salmon sperm or a plasmid containing the yfp gene was used as filler where necessary. In a typical targeting experiment, 4 µg of ZFN alone or with 36 µg of donor were transfected and appropriate amount of salmon sperm or pUC19 plasmid DNA was added to bring the overall amount of DNA to 80 µg. Inclusion of yfp gene expressing plasmid as filler allows assessment of transfection quality across multiple loci and replicate treatments.

Example 5: Cleavage of Genomic Loci in Zea mays Via Zinc Finger Nuclease

ZFN transfected Zea mays c.v. Hi-II protoplasts were harvested 24 hours post-transfection, by centrifugation at 1600 rpm in 2 ml EPPENDORF™ tubes and the supernatant was completely removed. Genomic DNA was extracted from protoplast pellets using the QIAGEN PLANT DNA EXTRACTION KIT™ (Qiagen, Valencia, Calif.). The isolated DNA was resuspended in 50 µL of water and concentration was determined by NANODROP® (Invitrogen, Grand Island, N.Y.). The integrity of the DNA was estimated by running samples on 0.8% agarose gel electrophoresis. All samples were normalized (20-25 ng/µL) for PCR amplification to generate amplicons for sequencing (Illumina, Inc., San Diego, Calif.). Bar-coded PCR primers for amplifying regions encompassing each test ZFN recognition sequence from treated and control samples were designed and purchased from IDT (Coralville, Iowa, HPLC purified). Optimum amplification conditions were identified by gradient PCR using 0.2 µM appropriate bar-coded primers, ACCUPRIME PFX SUPERMIX™ (Invitrogen, Carlsbad, Calif.) and 100 ng of template genomic DNA in a 23.5 µL reaction. Cycling parameters were initial denaturation at 95° C. (5 min) followed by 35 cycles of denaturation (95° C., 15 sec), annealing (55-72° C., 30 sec), extension (68° C., 1 min) and a final extension (68° C., 7 min). Amplification products were analyzed on 3.5% TAE agarose gels and and appropriate annealing temperature for each primer combination was determined and used to amplify amplicons from control and ZFN treated samples as described above. All amplicons were purified on 3.5% agarose gels, eluted in water and concentrations were determined by NANODROP™. For Next Generation Sequencing, approximately 100 ng of PCR amplicon from the ZFN treated and corresponding maize protoplast controls were pooled together and sequenced using llumina Next Generation Sequencing (NGS).

Figure 12:
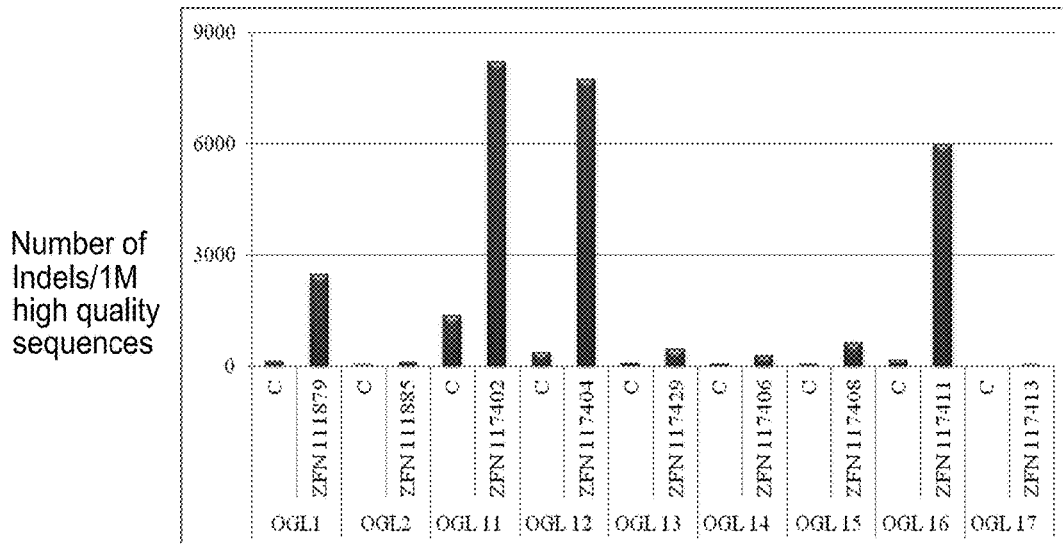
FIG. 12. ZFN cleavage activity at Zea mays selected genomic loci targets. Cleavage activity is represented as number of sequences with indels (insertions and deletions) at the ZFN cleavage site per 1 million high quality reads.

The cleavage activity of appropriate ZFNs at each *Zea mays* selected genomic loci were assayed. Short amplicons encompassing the ZFN cleavage sites were amplified from the genomic DNA and subjected to Illumina NGS from ZFN treated and control protoplasts. The ZFN induced cleavage or DNA double strand break was resolved by the cellular NHEJ repair pathway by insertion or deletion of nucleotides (indels) at the cleavage site and presence of indels at the cleavage site is thus a measure of ZFN activity and is determined by NGS. Cleavage activity of the target specific ZFNs was estimated as the number of sequences with indels per 1 million high quality sequences using NGS analysis software (Patent publication 2012-0173,153, data Analysis of DNA sequences) (FIG. 12). Activities in the range of 5-100 fold over controls were observed for *Zea mays* selected genomic loci targets and were further confirmed by sequence alignments that showed a diverse footprint of indels at each ZFN cleavage site. This data suggests that the *Zea mays* selected genomic loci were amenable to cleavage by ZFNs. Differential activity at each target was reflective of its chromatin state and amenability to cleavage as well as the efficiency of expression of each ZFN.

Figure 13:
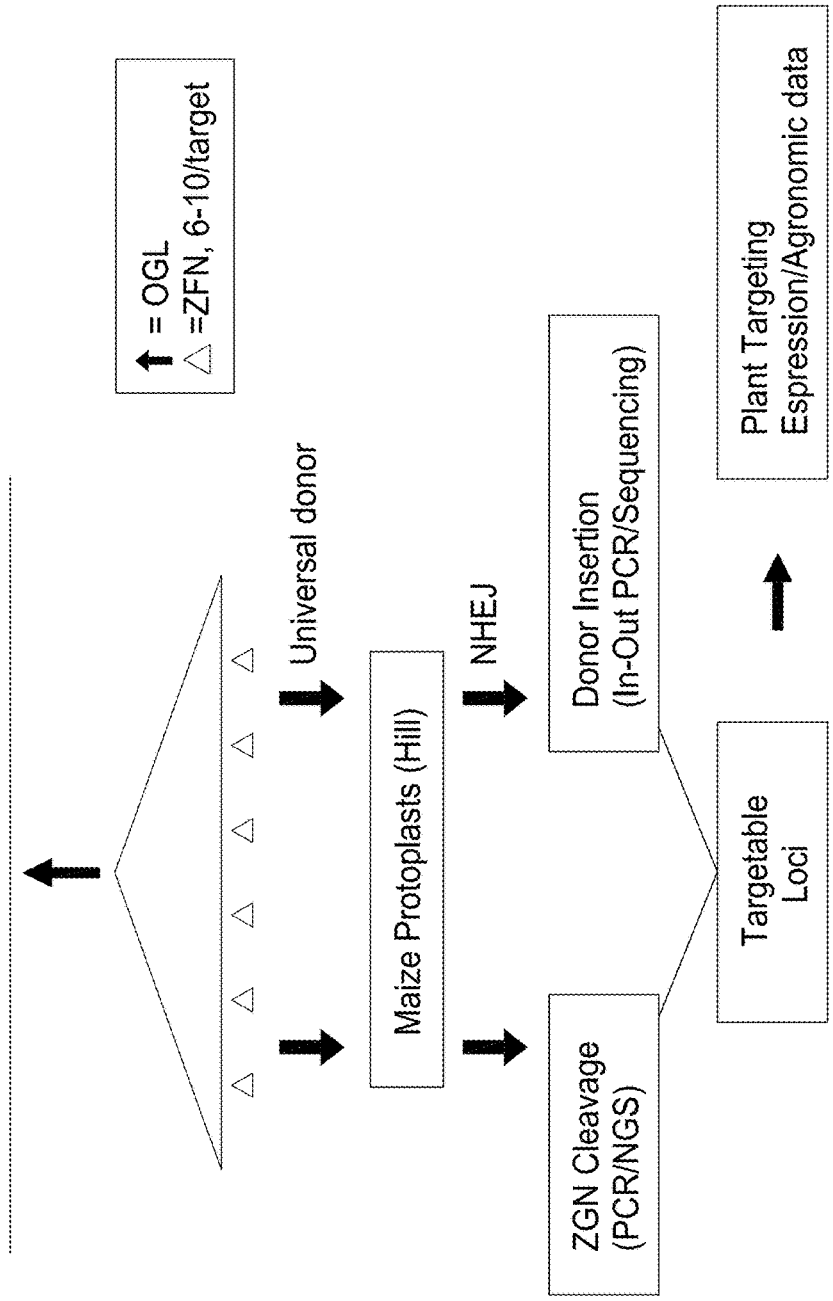
FIG. 13. Validation of *Zea mays* selected genomic loci targets using NHEJ based Rapid Targeting Analysis (RTA) method.

Example 6: Rapid Targeting Analysis of the Integration of a Polynucleotide Donor Validation of the targeting of the universal donor polynucleotide sequence within the *Zea mays* selected genomic loci targets via non-homologous end joining (NHEJ) meditated donor insertion, was performed using a semi-throughput protoplast based Rapid Testing Analysis method. For each *Zea mays* selected genomic loci target, 3-6 ZFN designs were tested and targeting was assessed by measuring ZFN mediated cleavage by Next Generation Sequencing methods (FIG. 12) and donor insertion by junctional in-out PCR (FIG. 13). *Zea mays* selected genomic loci that were positive in both assays were identified as a targetable locus.

ZFN Donor Insertion Rapid Testing Analysis

To determine if a *Zea mays* selected genomic loci target can be targeted for donor insertion, a ZFN construct and universal donor polynucleotide construct were co-delivered to maize protoplasts which were incubated for 24 hours before the genomic DNA was extracted for analysis. If the expressed ZFN was able to cut the target binding site both at the *Zea mays* selected genomic loci target and in the donor, the linearized donor would then be inserted into the cleaved target site in the maize genome via the non-homologous end joining (NHEJ) pathway. Confirmation of targeted integration at the *Zea mays* selected genomic loci target was completed based on an "In-Out" PCR strategy, where an "In" primer recognizes sequence at the native optimal genomic loci and an "Out" primer binds to sequence within the donor DNA. The primers were designed in a way that only when the donor DNA was inserted at the *Zea mays* selected genomic loci target, would the PCR assay produce an amplification product with the expected size. The In-Out PCR assay was performed at both the 5'- and 3'-ends of the insertion junction. The primers used for the analysis of integrated polynucleotide donor sequences are provided in Table 9.

ZFN Donor Insertion at Target Loci Using Nested "In-Out" PCR

All PCR amplifications were conducted using a TAKARA EX TAQ HS™ kit (Clonetech, Mountain View, Calif.). The first In-Out PCR was carried out in 20 µL final reaction volume that contains 1× TAKARA EX TAQ HS™ buffer, 0.2 mM dNTPs, 0.2 µM "Out" primer (Table 9), 0.05 µM "In" primer (designed from the universal donor cassette described above), 0.75 unit of TAKARA EX TAQ HS™ polymerase, and 10 ng extracted maize protoplast DNA. The reaction was then carried out using a PCR program that consisted of 94° C. for 2 min, 20 cycles of 98° C. for 12 sec and 68° C. for 2 min, followed by 72° C. for 10 min and held at 4° C. Final PCR products were run on an agarose gel along with 1 KB PLUS DNA LADDER™ (Life Technologies, Grand Island, N.Y.) for visualization.

The nested In-Out PCR was conducted in 20 µL final reaction volume that contained 1× TAKARA EX TAQ HS™ buffer, 0.2 mM dNTPs, 0.2 µM "Out" primer (Table 9), 0.1 µM "In" primer (designed from the universal donor cassette described above, Table 10), 0.75 unit of TAKARA EX TAQ HS™ polymerase, and 1 µL of the first PCR product. The reaction was then carried out using a PCR program that consisted of 94° C. for 2 min, 31 cycles of 98° C. for 12 sec, 66° C. for 30 sec and 68° C. for 45 sec, followed by 72° C. for 10 min and held at 4° C. Final PCR products were run on an agarose gel along with 1 KB PLUS DNA LADDER™ (Life Technologies, Grand Island, N.Y.) for visualization.

TABLE 9

List of all "Out" primers for nested In-Out PCR analysis of optimal genomic loci.

| OGL1 | First PCR | 5'- end | APL02-5PriF1 | SEQ ID NO: 5430 CGCCACAAATCTGAACCAGCA |
|---|---|---|---|---|
| | | | Spec-PriR1 | SEQ ID NO: 5431 CCACGATCGACATTGATCTGGCTA |
| | | 3'- end | APL02-3PriR1 | SEQ ID NO: 5432 GCGACATATCAGGCCAACAGG |
| | | | Uzi-PriF1 | SEQ ID NO: 5433 GGGATATGTGTCCTACCGTATCAGG |

TABLE 9-continued

List of all "Out" primers for nested In-Out
PCR analysis of optimal genomic loci.

|   |   |   |   |   |
|---|---|---|---|---|
|   | Nest<br>PCR | 5'-<br>end | APL02-<br>5nstPriF1 | SEQ ID NO: 5434<br>CCAGCATACAGTTAGGGCCCA |
|   |   |   | Spec-<br>nstPriR1 | SEQ ID NO: 5435<br>GTTGCCTTGGTAGGTCCAGC |
|   |   | 3'-<br>end | APL02-<br>3nstPriR1 | SEQ ID NO: 5436<br>CGAAAACTCAGCATGCGGGAA |
|   |   |   | Uzi-<br>nstPriF1 | SEQ ID NO: 5437<br>GAGCCATCAGTCCAACACTGC |
| OGL2 | First<br>PCR | 5'-<br>end | APL01-<br>5PriF1 | SEQ ID NO: 5438<br>ACAGGCGTACAGCAACACCA |
|   |   | 3'-<br>end | APL01-<br>3PriR1 | SEQ ID NO: 5439<br>GACCCTATGGTGTTGGATCCCA |
|   | Nest<br>PCR | 5'-<br>end | APL01-<br>5nstPriF1 | SEQ ID NO: 5440<br>CGGGAGCTAGGCAACAAATCG |
|   |   | 3'-<br>end | APL01-<br>3nstPriR1 | SEQ ID NO: 5441<br>TCTGACTAAACGGGTGGATGCTG |
| OGL8 | First<br>PCR | 5'-<br>end | OGL08-<br>5nstPriF2 | SEQ ID NO: 5442<br>CGGATCAGTTGATTCGCTCACTTTCA |
|   |   | 3'-<br>end | OGL08-<br>3PriR | SEQ ID NO: 5443<br>GCCGAAAAGCAGCAACTGGAA |
|   | Nest<br>PCR | 5'-<br>end | OGL08-<br>5nstPriF | SEQ ID NO: 6619<br>GATTGCTACGCAGACCGCCTA |
|   |   | 3'-<br>end | OGL08-<br>3nstPriR | SEQ ID NO: 5444<br>CACTATTCCTCCGGCATGCAG |
| OGL11 | First<br>PCR | 5'-<br>end | OGL11-<br>5PriF | SEQ ID NO: 5445<br>TGACCTATTGATCGGTCGGCTC |
|   |   | 3'-<br>end | OGL11-<br>3PriR2 | SEQ ID NO: 5446<br>TGCCTTGAATCTCAGGGATGCA |
|   | Nest<br>PCR | 5'-<br>end | OGL11-<br>5nstPriF | SEQ ID NO: 5447<br>GCCGAAGCTAACTAGCGGACA |
|   |   | 3'-<br>end | OGL11-<br>3nstPriR2 | SEQ ID NO: 5448<br>CATGGAGTAGCAGCTGTGCTG |
| OGL12 | First<br>PCR | 5'-<br>end | OGL12-<br>5PriF | SEQ ID NO: 5449<br>GAAAAGCAGTCACCGGCTCTG |
|   |   | 3'-<br>end | OGL12-<br>3PriR | SEQ ID NO: 5450<br>CCATGGACATGAATTCGGCACG |
|   | Nest<br>PCR | 5'-<br>end | OGL12-<br>5nstPriF | SEQ ID NO: 5451<br>CTTTTGCACCACGGAGCAGAC |
|   |   | 3'-<br>end | OGL12-<br>3nstPriR | SEQ ID NO: 5452<br>GCTAGCAAAACTTTGAAGCTCGCTC |
| OGL13 | First<br>PCR | 5'-<br>end | OGL13-<br>5PriF | SEQ ID NO: 5453<br>GAGGTCCCTTACGGGTCATCG |
|   |   | 3'-<br>end | OGL13-<br>3PriR | SEQ ID NO: 5454<br>ACCAGGTCTATCTTGCGCAGAC |
|   | Nest<br>PCR | 5'-<br>end | OGL13-<br>5nstPriF | SEQ ID NO: 5455<br>AATAGCGTGGTCGGGTCCTAG |
|   |   | 3'-<br>end | OGL13-<br>3nstPriR | SEQ ID NO: 5456<br>ACGAACGATCCAAGGTGCAGT |
| OGL14 | First<br>PCR | 5'-<br>end | OGL14-<br>5PriF | SEQ ID NO: 5457<br>TAGAGACGAGGACTCTGGGCT |
|   |   | 3'-<br>end | OGL14-<br>3PriR | SEQ ID NO: 5458<br>AAGTCCAACATGGGCACAACC |
|   | Nest<br>PCR | 5'-<br>end | OGL14-<br>5nstPriF | SEQ ID NO: 5459<br>CCTCGTTAAGGGTGCAGGTTG |
|   |   | 3'-<br>end | OGL14-<br>3nstPriR | SEQ ID NO: 5460<br>CCAAGTCAGCTTCTAAGCCATCAAAC |
| OGL15 | First<br>PCR | 5'-<br>end | OGL15-<br>5PriF | SEQ ID NO: 5461<br>AACCCTAGACTTCTGCCTGGTG |
|   |   | 3'-<br>end | OGL15-<br>3PriR | SEQ ID NO: 5462<br>GCTCACTTACGAGCAGATCCCA |
|   | Nest<br>PCR | 5'-<br>end | OGL15-<br>5nstPriF | SEQ ID NO: 5463<br>GGTGCACGCATGTTCTCATGT |
|   |   | 3-<br>end | OGL15-<br>3nstPriR | SEQ ID NO: 5464<br>TGTTTACCGCAGCCATGCTTG |

TABLE 9-continued

List of all "Out" primers for nested In-Out
PCR analysis of optimal genomic loci.

| OGL16 | First PCR | 5'-end | OGL16-5PriF | SEQ ID NO: 5465 GTTGTATACGGCATCCATCCGCT |
| --- | --- | --- | --- | --- |
| | | 3'-end | OGL16-3PriR | SEQ ID NO: 5466 GAATGAAACTGGTGGTCTGCTCC |
| | Nest PCR | 5'-end | OGL16-5nstPriF | SEQ ID NO: 5467 CCGACGAGGTACAAGTAGCAGG |
| | | 3'-end | OGL16-3nstPriR | SEQ ID NO: 5468 CCCGTAGTCCAGATTCTTGTGGT |
| OGL17 | First PCR | 5'-end | OGL17-5PriF | SEQ ID NO: 5469 GTCGTTTGTTCGGAAGGGGAG |
| | | 3'-end | OGL17-3PriR | SEQ ID NO: 5470 CGTAGTTGTCCGGCATGTCCT |
| | Nest PCR | 5'-end | OGL17-5nstPriF | SEQ ID NO: 5471 TGTATCCCTTCGGTGAGCACG |
| | | 3'-end | OGL17-3nstPriR | SEQ ID NO: 5472 TGAATCGACTCGCTGACAGGTG |
| OGL04 | First PCR | 5' end | OGL04-5PriF | SEQ ID NO: 6311 CAACCAGAAACGTCCTGCACTG |
| | | | Spec-PriR1 | SEQ ID NO: 6312 CCACGATCGACATTGATCTGGCTA |
| | | 3'-end | OGL04-3PriR | SEQ ID NO: 6313 AAATCCAAGCCACGTACGCAC |
| | | | UnivDonor-3PriF1 | SEQ ID NO: 6314 GTTTCATCAAGCCTTACGGTCACC |
| | Nest PCR | 5'-end | OGL04-5nstPriF | SEQ ID NO: 6315 ACACCAATTGCCCATTTGGCA |
| | | | Spec-nstPriR2 | SEQ ID NO: 6316 GCTGGCGATGAGCGAAATGTAG |
| | | 3'-end | OGL04-3nstPriR | SEQ ID NO: 6317 TTGGTTAGCAGCACGGATGGA |
| | | | UnivDonor-3PriF2 | SEQ ID NO: 6318 CAGCAACGTCGGTTCGAGATG |
| OGL05 | First PCR | 5'-end | OGL05-1-5PriF | SEQ ID NO: 6319 ATGCCACTTTCGAAGAGAGGACG |
| | | 3'-end | OGL05-1-3PriR2 | SEQ ID NO: 6320 CATCTCCAACGTCATCGGCAC |
| | Nest PCR | 5'-end | OGL05-1-5nstPriF | SEQ ID NO: 6321 GGGAAACAGATTCGTCAGCTTGC |
| | | 3'-end | OGL05-1-3nstPriR | SEQ ID NO: 6322 GCCTATCCAGTGGCGGATACA |
| OGL06 | First PCR | 5'-end | OGL06-5PriF | SEQ ID NO: 6323 CTTGCTCTACAACTCTGCCCCA |
| | | | Spec-PriR1 | SEQ ID NO: 6324 CCACGATCGACATTGATCTGGCTA |
| | | 3'-end | OGL06-3PriR | SEQ ID NO: 6325 AGTCGGTACCTGCAAGCTACG |
| | | | UnivDonor-3PriF1 | SEQ ID NO: 6326 GTTTCATCAAGCCTTACGGTCACC |
| | Nest PCR | 5'-end | OGL06-5nstPriF | SEQ ID NO: 6327 TGGATTTGAGGCCAACTGCAC |
| | | | Spec-nstPriR2 | SEQ ID NO: 6328 GCTGGCGATGAGCGAAATGTAG |
| | | 3'-end | OGL06-3nstPriR | SEQ ID NO: 6329 TCTGCATTGTTGGGATCGACCA |
| | | | UnivDonor-3PriF2 | SEQ ID NO: 6330 CAGCAACGTCGGTTCGAGATG |
| OGL07 | First PCR | 5'-end | OGL07-1-5nstPriF | SEQ ID NO: 6331 ACGATCGCAGGTTATCCTCGC |
| | | 3'-end | OGL07-1-3PriR | SEQ ID NO: 6332 CTTGTCGGTTGCTGTGTGGAC |
| | Nest PCR | 5'-end | OGL07-1-5nstPriF | SEQ ID NO: 6333 AACACGGATGGCCTGCAATG |
| | | 3'-end | OGL07-1-3nstPriR | SEQ ID NO: 6334 GCATGGGCGTACGTCACTTG |

TABLE 9-continued

List of all "Out" primers for nested In-Out
PCR analysis of optimal genomic loci.

| | | | | | |
|---|---|---|---|---|---|
| OGL09 | First PCR | 5'-end | OGL09-5PriF | SEQ ID NO: 6335 | ACCCAGAATCTCTGGTTCCGT |
| | | 3'-end | OGL09-3PriR | SEQ ID NO: 6336 | CAGGAAGCTCTGCATCTGCG |
| | Nest PCR | 5'-end | OGL09-5nstPriF | SEQ ID NO: 6337 | AGTCTTTGATGTAAACGTCTTGCCT |
| | | 3'-end | OGL9-3nstPriR | SEQ ID NO: 6338 | GCATGGAAACACCAGGTCGA |
| | | | | | |
| OGL10 | First PCR | 5'-end | OGL10-5PriF | SEQ ID NO: 6339 | GCAGCGAATAGGAATGCGAGAC |
| | | 3'-end | OGL10-3PriR | SEQ ID NO: 6340 | TAACCTTGTTTCGCTGACTCCC |
| | Nest PCR | 5'-end | OGL10-5nstPriF | SEQ ID NO: 6341 | CTTCTTCTACCTACACGCACCAG |
| | | 3'-end | OGL10-3nstPriR | SEQ ID NO: 6342 | GATCCGTTTCCTCACTCTCGC |
| | | | | | |
| OGL18 | First PCR | 5'-end | OGL18-5PriF | SEQ ID NO: 6343 | AGGTGAATCTTCCGTGGCTGT |
| | | 3'-end | OGL18-3PriR | SEQ ID NO: 6344 | CCATAATCAGTGTGACTGGTGGCT |
| | Nest PCR | 5'-end | OGL18-5nstPriF | SEQ ID NO: 6345 | CGGATCTAAGGTGCCCTGTCT |
| | | 3'-end | OGL18-3nstPriR | SEQ ID NO: 6346 | GTCTAGCTCATGGAAGTGGGAGG |
| | | | | | |
| OGL19 | First PCR | 5'-end | OGL19-5PriF | SEQ ID NO: 6347 | GACTTCTAAGCCCCAAGGCCTA |
| | | 3'-end | OGL19-3PriR2 | SEQ ID NO: 6348 | AGATCTTTTGGCTCCCTCTCACC |
| | Nest PCR | 5'-end | OGL19-5nstPriF | SEQ ID NO: 6349 | GTGCTTCGAGGGCTCAAGGTA |
| | | 3'-end | OGL19-3nstPriR2 | SEQ ID NO: 6350 | ATTGCTCACCCCATCCCCTT |
| | | | | | |
| OGL20 | First PCR | 5'-end | OGL20-5PriF | SEQ ID NO: 6351 | GGCTATGACCCGGACACTACC |
| | | 3'-end | OGL20-3PriR | SEQ ID NO: 6352 | CAGTTGGGCGTCAAGTTAGTTCAG |
| | Nest PCR | 5'-end | OGL20-5nstPriF | SEQ ID NO: 6353 | AAGTCCACAAGGATCTGACCACG |
| | | 3'-end | OGL20-3nstPriR | SEQ ID NO: 6354 | TGAAACTTTGGTTCAGTCTGCTCG |
| | | | | | |
| OGL21 | First PCR | 5'-end | OGL21-5PriF | SEQ ID NO: 6355 | TATGTCCAAGCCACGAGAAGC |
| | | 3'-end | OGL21-3PriR | SEQ ID NO: 6356 | ACTGCAGGTACTACTGGTACGC |
| | Nest PCR | 5'-end | OGL21-5nstPriF | SEQ ID NO: 6357 | GCTACAGTATAGCAGGAGCAGC |
| | | 3'-end | OGL21-3nstPriR | SEQ ID NO: 6358 | GTCCTACTATACGCTGCCGC |
| | | | | | |
| OGL22 | First PCR | 5'-end | OGL22-5PriF | SEQ ID NO: 6359 | CAATCCTTCTGAGCTGCACCG |
| | | 3'-end | OGL22-3PriR | SEQ ID NO: 6360 | GGTGTCAATGACCTCACGAGC |
| | Nest PCR | 5'-end | OGL22-5nstPriF | SEQ ID NO: 6361 | CCGTACCAAACAGGCAAGCAG |
| | | 3'-end | OGL22-3nstPriR | SEQ ID NO: 6362 | GATCGCCCATATGCTTGGATTCAC |
| | | | | | |
| OGL23 | First PCR | 5'-end | OGL23-5PriF | SEQ ID NO: 6363 | GGATTAGGACGGCTGACTGGT |
| | | 3'-end | OGL23-3PriR | SEQ ID NO: 6364 | GTTGCTTTGTTTGCGTGCTCC |
| | Nest PCR | 5'-end | OGL23-5nstPriF | SEQ ID NO: 6365 | TTAAAGTGCTAGCTGACTGACCGA |
| | | 3'-end | OGL23-3nstPriR | SEQ ID NO: 6366 | GGCCCATGCCTTAGGTTGAC |

TABLE 9-continued

List of all "Out" primers for nested In-Out
PCR analysis of optimal genomic loci.

| | | | | | |
|---|---|---|---|---|---|
| OGL24 | First PCR | 5'-end | OGL24-5PriF | SEQ ID NO: 6367 | ACTGAGACTGGGAGTCTGGGA |
| | | 3'-end | OGL24-3PriR | SEQ ID NO: 6368 | CGCCGTCCGACTGTTATTACC |
| | Nest PCR | 5'-end | OGL24-5nstPriF | SEQ ID NO: 6369 | CTTCGGCCTTGGATTGGATCAC |
| | | 3'-end | OGL24-3nstPriR | SEQ ID NO: 6370 | ACAACGCAGATCCCTAGAATCCA |
| OGL25 | First PCR | 5'-end | OGL25-5PriF | SEQ ID NO: 6371 | GGGATCTCTTGTCACCAAATCAGC |
| | | 3'-end | OGL25-3PriR | SEQ ID NO: 6372 | TTGACAGTGAGACATGGGAGTACC |
| | Nest PCR | 5'-end | OGL25-5nstPriF | SEQ ID NO: 6373 | TGCCTGCATTGCATCGATCTG |
| | | 3'-end | OGL25-3nstPriR | SEQ ID NO: 6374 | AGTACCCACTGTCACTGCACG |
| OGL26 | First PCR | 5'-end | OGL26-5PriF | SEQ ID NO: 6375 | ATCTTCACCAAGTATCCCACACCT |
| | | 3'-end | OGL26-3PriR2 | SEQ ID NO: 6376 | GCTGTGTTAGTATCGTCGAAGGCT |
| | Nest PCR | 5'-end | OGL26-5nstPriF | SEQ ID NO: 6377 | TCAAACCTCACCTGATGTATCGCT |
| | | 3'-end | OGL26-3nstPriR2 | SEQ ID NO: 6378 | CGAACCTCCAATTTATCGGCAATCG |
| OGL27 | First PCR | 5'-end | OGL27-5PriF | SEQ ID NO: 6379 | AAGTCCCTAGAGCCCTCATGC |
| | | 3'-end | OGL27-3PriR | SEQ ID NO: 6380 | GAGAGTTAGGAGGGAGCATGGC |
| | Nest PCR | 5'-end | OGL27-5nstPriF | SEQ ID NO: 6381 | GTGTCCGAGATAGGTCGTGTCC |
| | | 3'-end | OGL27-3nstPriR | SEQ ID NO: 6382 | TTGAACTTGGGCATGAGTGGGA |
| OGL28 | First PCR | 5'-end | OGL28-5PriF | SEQ ID NO: 6383 | GTCGGCTGTGCGTTATGAGAC |
| | | 3'-end | OGL28-3PriR | SEQ ID NO: 6384 | GATTAATCGGTTATCGGTGGACGC |
| | Nest PCR | 5'-end | OGL28-5nstPriF | SEQ ID NO: 6385 | ACGGACAGATCACAGATCGGG |
| | | 3'-end | OGL28-3nstPriR | SEQ ID NO: 6386 | CCTTAATCCGGTTTGGTGAACCC |
| OGL29 | First PCR | 5'-end | OGL29-5PriF | SEQ ID NO: 6387 | GCTTACACCGATGCAGGGGTA |
| | | 3'-end | OGL29-3PriR | SEQ ID NO: 6388 | GGTTGACATCGGAATTCGTGCC |
| | Nest PCR | 5'-end | OGL29-5nstPriF | SEQ ID NO: 6389 | TGAAAGAGCGGCCCAACTAC |
| | | 3'-end | OGL29-3nstPriR | SEQ ID NO: 6390 | TTAATGCTGGCCTCTCCTGCA |
| OGL30 | First PCR | 5'-end | OGL30-5PriF | SEQ ID NO: 6391 | ATGAAGAGCACCAGCTACCCC |
| | | 3'-end | OGL30-3PriR | SEQ ID NO: 6392 | GGAAGATGGAACCACATGCCC |
| | Nest PCR | 5'-end | OGL30-5nstPriF | SEQ ID NO: 6393 | GGCTACAAAACCCAAGAGGGG |
| | | 3'-end | OGL30-3nstPriR | SEQ ID NO: 6394 | CCCTTTCATGCAACGATCAGGC |
| OGL31 | First PCR | 5'-end | OGL31-5PriF | SEQ ID NO: 6395 | TGTTCAGTTGGTAAGTCGTCGCT |
| | | 3'-end | OGL31-3PriR | SEQ ID NO: 6396 | GTTCTTGGAGAGTGATTGTCGGC |
| | Nest PCR | 5'-end | OGL31-5nstPriF | SEQ ID NO: 6397 | CTTCACCTCAAGGGAAGCAAGC |
| | | 3'-end | OGL31-3nstPriR | SEQ ID NO: 6398 | GGTGAAACTGAGCTGGGAATTGG |

TABLE 9-continued

List of all "Out" primers for nested In-Out
PCR analysis of optimal genomic loci.

| | | | | |
|---|---|---|---|---|
| OGL32 | First PCR | 5'-end | OGL32-5PriF | SEQ ID NO: 6399 GATCCACAACCACATTCAACAAGGT |
| | | 3'-end | OGL32-3PriR | SEQ ID NO: 6400 TGATCAAACTAGAGGCCTGATGACG |
| | Nest PCR | 5'-end | OGL32-5nstPriF | SEQ ID NO: 6401 GGACAAATGACATGTAACCCACTCC |
| | | 3'-end | OGL32-3nstPriR | SEQ ID NO: 6402 ATGACGACAGCGTGTTTGTGG |
| OGL33 | First PCR | 5'-end | OGL33-5PriF | SEQ ID NO: 6403 AGCTCCACTTCCAGTAGTCCTG |
| | | 3'-end | OGL33-3PriR | SEQ ID NO: 6404 CGGATAGCGTCCACAAACGAG |
| | Nest PCR | 5'-end | OGL33-5nstPriF | SEQ ID NO: 6405 AATCATGCGGCTGTCGAAAGG |
| | | 3'-end | OGL33-3nstPriR | SEQ ID NO: 6406 GCGATAAGAAAGCATCCTGCGG |
| OGL34 | First PCR | 5'-end | OGL34-5PriF | SEQ ID NO: 6407 ACTGTACCACCGAAAGACGACC |
| | | 3'-end | OGL34-3PriR | SEQ ID NO: 6408 CCCGTCTCACTGTGGATCTATGTC |
| | Nest PCR | 5'-end | OGL34-5nstPriF | SEQ ID NO: 6409 AAAGACGACCAAACAGTCCTGC |
| | | 3'-end | OGL34-3nstPriR | SEQ ID NO: 6410 GAGTCAACGTGTCAGTGTCACC |
| OGL35 | First PCR | 5'-end | OGL35-5PriF | SEQ ID NO: 6411 AGGTGTAGTCCTGCTCTGTCTG |
| | | 3'-end | OGL35-3PriR | SEQ ID NO: 6412 AACTGAAGACACTGACGACATCCA |
| | Nest PCR | 5'-end | OGL35-5nstPriF | SEQ ID NO: 6413 TAGGGCGCTAGGCATGTACTC |
| | | 3'-end | OGL35-3nstPriR | SEQ ID NO: 6414 GTGGCCTTCTAGGTACACTAGGG |
| OGL36 | First PCR | 5'-end | OGL36-5PriF | SEQ ID NO: 6415 GCAACCAACTTTGTCGGATGCT |
| | | 3'-end | OGL36-3PriR | SEQ ID NO: 6416 AAAGCTCACCTCACAGCACGA |
| | Nest PCR | 5'-end | OGL36-5nstPriF | SEQ ID NO: 6417 TCATAGATTTCGCGTGGTTGAACTG |
| | | 3'-end | OGL36-3nstPriR | SEQ ID NO: 6418 ACTCTGCAGCCATGAATTCCAC |
| OGL37 | First PCR | 5'-end | OGL37-5PriF | SEQ ID NO: 6419 GAGAAACCGAGGGATCGGAACA |
| | | 3'-end | OGL37-3PriR | SEQ ID NO: 6420 ACATGTACGTGTGCGAGAGTCG |
| | Nest PCR | 5'-end | OGL37-5nstPriF | SEQ ID NO: 6421 AGTACGACTGGAATCCAACGCG |
| | | 3'-end | OGL37-3nstPriR | SEQ ID NO: 6422 CTCTCCCTAGCTCGACGCTTG |
| OGL38 | First PCR | 5'-end | OGL38-5PriF | SEQ ID NO: 6423 GTAGCACTGCACCGTTCATGC |
| | | 3'-end | OGL38-3PriR | SEQ ID NO: 6424 ACTCTCCTTCCCTCGACGGTA |
| | Nest PCR | 5'-end | OGL38-5nstPriF | SEQ ID NO: 6425 AGGAGATGAAGGCTTTGTCCCC |
| | | 3'-end | OGL38-3nstPriR | SEQ ID NO: 6426 GCAAACCTGCATGGTTGATGC |
| OGL39 | First PCR | 5'-end | OGL39-5PriF | SEQ ID NO: 6427 TTGGGTTTGTGCACCACACTC |
| | | 3'-end | OGL39-3PriR | SEQ ID NO: 6428 GCTTCTGGAAAAACGCCAGCA |
| | Nest PCR | 5'-end | OGL39-5nstPriF | SEQ ID NO: 6429 ATTCCTTGCGCTCCGTACGAA |
| | | 3'-end | OGL39-3nstPriR | SEQ ID NO: 6430 CTTTGCATTGCAGGCACGGTTA |
| OGL40 | First PCR | 5'-end | OGL40-5PriF | SEQ ID NO: 6431 CCGAGGTTAAATCCACAGGCG |
| | | 3'-end | OGL40-3PriR | SEQ ID NO: 6432 GCGCATTTCCTTGCCCTCAAA |
| | Nest PCR | 5'- | OGL40- | SEQ ID NO: 6433 |

TABLE 9-continued

List of all "Out" primers for nested In-Out
PCR analysis of optimal genomic loci.

| | | | | |
|---|---|---|---|---|
| | PCR | end | 5nstPriF | GTTCACAGGTACGACAGCAGC |
| | | 3'- | OGL40- | SEQ ID NO: 6434 |
| | | end | 3nstPriR | TACGTTGCCACCAAAAGAGCC |
| OGL41 | First | 5'- | OGL41- | SEQ ID NO: 6435 |
| | PCR | end | 5PriF | AGCAGGCTACTGTGGTCAGG |
| | | 3'- | OGL41- | SEQ ID NO: 6436 |
| | | end | 3PriR | CGATTGCATACAGCAGGTGCC |
| | Nest | 5'- | OGL41- | SEQ ID NO: 6437 |
| | PCR | end | 5nstPriF | GGCAGGTTTTGAAGGACCCC |
| | | 3'- | OGL41- | SEQ ID NO: 6438 |
| | | end | 3nstPriR | ACGAGCAATGCAGTGAAGGGT |
| OGL42 | First | 5'- | OGL42- | SEQ ID NO: 6439 |
| | PCR | end | 5PriF | TGAGAACGAAACCCGTCAAGCA |
| | | 3'- | OGL42- | SEQ ID NO: 6440 |
| | | end | 3PriR | CACGTCGATCAAACGGCGAG |
| | Nest | 5'- | OGL42- | SEQ ID NO: 6441 |
| | PCR | end | 5nstPriF | CGTCAAGCATGCAGAAAGGCT |
| | | 3'- | OGL42- | SEQ ID NO: 6442 |
| | | end | 3nstPriR | CCCCTAATCCGCACCGTGTA |
| OGL43 | First | 5'- | OGL43- | SEQ ID NO: 6443 |
| | PCR | end | 5PriF | CCTGTTCCTTCTCCCGAATGC |
| | | 3'- | OGL43- | SEQ ID NO: 6444 |
| | | end | 3PriR | GGTACAAAGTGAAAAGGGCCGG |
| | Nest | 5'- | OGL43- | SEQ ID NO: 6445 |
| | PCR | end | 5nstPriF | GTGCAATCAAGCCTTGCCCAT |
| | | 3'- | OGL43- | SEQ ID NO: 6446 |
| | | end | 3nstPriR | GAAGTGATGGTCCCTGCCAC |
| OGL44 | First | 5'- | OGL44- | SEQ ID NO: 6447 |
| | PCR | end | 5PriF | GGCTCTAACACATGGTGAGGC |
| | | 3'- | OGL44- | SEQ ID NO: 6448 |
| | | end | 3PriR | AATCATGGTCCTAGTTGTAGCCCC |
| | Nest | 5'- | OGL44- | SEQ ID NO: 6449 |
| | PCR | end | 5nstPriF | ACTAGGATGAGGGAGCCAATGG |
| | | 3'- | OGL44- | SEQ ID NO: 6450 |
| | | end | 3nstPriR | CTATGGAGATGCCTCCCACCAT |
| OGL45 | First | 5'- | OGL45- | SEQ ID NO: 6451 |
| | PCR | end | 5PriF | GAAGAGCTCGGCATCGGAGAT |
| | | 3'- | OGL45- | SEQ ID NO: 6452 |
| | | end | 3PriR | TCCCAAAACGAACTGTGTGCG |
| | Nest | 5'- | OGL45- | SEQ ID NO: 6453 |
| | PCR | end | 5nstPriF | TGGCTAGAGCGACCTTGTTCG |
| | | 3'- | OGL45- | SEQ ID NO: 6454 |
| | | end | 3nstPriR | TCGAGATCAGGCATCCACACC |
| OGL46 | First | 5'- | OGL46- | SEQ ID NO: 6455 |
| | PCR | end | 5PriF | CCAAAGTATTTGGTGGGATTCTCGC |
| | | 3'- | OGL46- | SEQ ID NO: 6456 |
| | | end | 3PriR | CTGCAACAAGTGAAAAGCGCC |
| | Nest | 5'- | OGL46- | SEQ ID NO: 6457 |
| | PCR | end | 5nstPriF | GGATTCTCGCTTTTTCCCACCAAG |
| | | 3'- | OGL46- | SEQ ID NO: 6458 |
| | | end | 3nstPriR | TACATCGATCCAGCTCGTGCTG |
| OGL47 | First | 5'- | OGL47- | SEQ ID NO: 6459 |
| | PCR | end | 5PriF | CGGAACACTAAAACGGGGACATG |
| | | | Spec- | SEQ ID NO: 6460 |
| | | | PriR1 | CCACGATCGACATTGATCTGGCTA |
| | | 3'- | OGL47- | SEQ ID NO: 6461 |
| | | end | 3PriR | TCTTCCTGGCAAGCACTAGGAAC |
| | | | UnivDonor-3PriF1 | SEQ ID NO: 6462 |
| | | | | GTTTCATCAAGCCTTACGGTCACC |
| | Nest | 5'- | OGL47- | SEQ ID NO: 6463 |
| | PCR | end | 5nstPriF | ACCGAGTAAGGGCTTGTTCGG |
| | | | Spec-nstPriR2 | SEQ ID NO: 6464 |
| | | | | GCTGGCGATGAGCGAAATGTAG |
| | | 3'- | OGL47- | SEQ ID NO: 6465 |
| | | end | 3nstPriR | TCTCCAGCAACCCCTAGATGC |
| | | | UnivDonor-3PriF2 | SEQ ID NO: 6466 |
| | | | | CAGCAACGTCGGTTCGAGATG |

TABLE 9-continued

List of all "Out" primers for nested In-Out
PCR analysis of optimal genomic loci.

| | | | | | |
|---|---|---|---|---|---|
| OGL48 | First PCR | 5'-end | OGL48-5PriF | SEQ ID NO: 6467 | GCAGTGACACTATAGCCACGTGT |
| | | 3'-end | OGL48-3PriR | SEQ ID NO: 6468 | GCCCAATCAATTGTCCCTGGAC |
| | Nest PCR | 5'-end | OGL48-5nstPriF | SEQ ID NO: 6469 | TGCTACCCAATGGTGTGGACTT |
| | | 3'-end | OGL48-3nstPriR | SEQ ID NO: 6470 | AATGCCCATTCGGTTGAACCC |
| OGL49 | First PCR | 5'-end | OGL49-5PriF | SEQ ID NO: 6471 | TCTGATGATCGGGTTGAGGCC |
| | | 3'-end | OGL49-3PriR | SEQ ID NO: 6472 | CCTCCGGAATCATTTCCCGTTG |
| | Nest PCR | 5'-end | OGL49-5nstPriF | SEQ ID NO: 6473 | GTGCTGATCTGGTTGTGGGTC |
| | | 3'-end | OGL49-3nstPriR | SEQ ID NO: 6474 | CGGAACAATTCCTGGGCACAA |
| OGL50 | First PCR | 5'-end | OGL50-5PriF | SEQ ID NO: 6475 | AGCTATGGTTAACGGGAATGCCA |
| | | | Spec-PriR1 | SEQ ID NO: 6476 | CCACGATCGACATTGATCTGGCTA |
| | | 3'-end | OGL50-3PriR | SEQ ID NO: 6477 | TCTAGCGAGAGGTGGTCAGGT |
| | | | UnivDonor-3PriF1 | SEQ ID NO: 6478 | GTTTCATCAAGCCTTACGGTCACC |
| | Nest PCR | 5'-end | OGL50-5nstPriF | SEQ ID NO: 6479 | GCTGAAATTGCTGCATCATGGC |
| | | | Spec-nstPriR1 | SEQ ID NO: 6480 | GTTGCCTTGGTAGGTCCAGC |
| | | 3'-end | OGL50-3nstPriR | SEQ ID NO: 6481 | AGCTGCTACATCTGTGGTCGG |
| | | | UnivDonor-3PriF2 | SEQ ID NO: 6482 | CAGCAACGTCGGTTCGAGATG |
| OGL51 | First PCR | 5'-end | OGL51-5PriF | SEQ ID NO: 6483 | CCTTCACAGTACTTGAACTGCTGCA |
| | | 3'-end | OGL51-3PriR | SEQ ID NO: 6484 | CACTCACATGGTGCGTTCCG |
| | Nest PCR | 5'-end | OGL51-5nstPriF | SEQ ID NO: 6485 | TGTATGCCTCGTCATCGAGGG |
| | | 3'-end | OGL51-3nstPriR | SEQ ID NO: 6486 | AGGGGAATGACCAGGAGCAG |
| OGL52 | First PCR | 5'-end | OGL52-5PriF | SEQ ID NO: 6487 | TCACGTACTGACCACAGAACACC |
| | | 3'-end | OGL52-3PriR | SEQ ID NO: 6488 | GAATATGCTCCACGCGCATCTC |
| | Nest PCR | 5'-end | OGL52-5nstPriF | SEQ ID NO: 6489 | GCTGACTCTAAAACCGCCTTGTG |
| | | 3'-end | OGL52-3nstPriR | SEQ ID NO: 6490 | GATCCGGCTTGTTCGCTTGAC |
| OGL53 | First PCR | 5'-end | OGL53-5PriF | SEQ ID NO: 6491 | AACCATAGTGGCTCGCCAGT |
| | | 3'-end | OGL53-3PriR | SEQ ID NO: 6492 | AATCGCACTAGGTCAGCATGGT |
| | Nest PCR | 5'-end | OGL53-5nstPriF | SEQ ID NO: 6493 | GATCATGTCGTTAGCCTCCAACCA |
| | | 3'-end | OGL53-3nstPriR | SEQ ID NO: 6494 | GTGAAGACTCGAGCTTGGCCT |
| OGL54 | First PCR | 5'-end | OGL54-5PriF2 | SEQ ID NO: 6495 | CAACAAGCTGGTTTGCAGGGT |
| | | 3'-end | OGL54-3PriR | SEQ ID NO: 6496 | TAACCCCCTTAGAGATGCACATGC |
| | Nest PCR | 5'-end | OGL54-5nstPriF2 | SEQ ID NO: 6497 | ACCCCAGCAAATTGGACGATCT |
| | | 3'-end | OGL54-3nstPriR | SEQ ID NO: 6498 | TAGATCGATGAAACCGGTCGATGTG |

TABLE 9-continued

List of all "Out" primers for nested In-Out
PCR analysis of optimal genomic loci.

| Locus | PCR | End | Primer Name | SEQ ID NO | Sequence |
|---|---|---|---|---|---|
| OGL55 | First PCR | 5'-end | OGL55-5PriF | SEQ ID NO: 6499 | GACCAACCATTTGTTGCCCCT |
| | | 3'-end | OGL55-3PriR | SEQ ID NO: 6500 | CACGTCTTTGTAGCGACTGTCCA |
| | Nest PCR | 5'-end | OGL55-5nstPriF | SEQ ID NO: 6501 | TCCGAAAACTCAAGCATGCCC |
| | | 3'-end | OGL55-3nstPriR | SEQ ID NO: 6502 | GTGGTGAACTTCCCTCTAGACCC |
| OGL56 | First PCR | 5'-end | OGL56-5PriF2 | SEQ ID NO: 6503 | TGGAAAAACGTAGATGTGCTTGCC |
| | | 3'-end | OGL56-3PriR2 | SEQ ID NO: 6504 | CAAGCTCTTTGATCGTGGTTGACG |
| | Nest PCR | 5'-end | OGL56-5nstPriF2 | SEQ ID NO: 6505 | GCAGTAAACCTAGTGATGCTGCCT |
| | | 3'-end | OGL56-3nstPriR2 | SEQ ID NO: 6506 | ATGCTTGGTCAACGTGCCAC |
| OGL57 | First PCR | 5'-end | OGL57-5PriF2 | SEQ ID NO: 6507 | CGGTGAATGCAAGCTGGATCAC |
| | | 3'-end | OGL57-3PriR2 | SEQ ID NO: 6508 | GCACTTGTGCTATCCGCCAG |
| | Nest PCR | 5'-end | OGL57-5nstPriF2 | SEQ ID NO: 6509 | CTTTTGGTGGCGGAGATCAGG |
| | | 3'-end | OGL57-3nstPriR2 | SEQ ID NO: 6510 | TGGAGGAGGAAATCTCTGCTATTCGT |
| OGL58 | First PCR | 5'-end | OGL58-5PriF | SEQ ID NO: 6511 | ACAGTGGACTCCCTCGCAAG |
| | | 3'-end | OGL58-3PriR2 | SEQ ID NO: 6512 | GTAAGCTTCCTCGACACCTCCA |
| | Nest PCR | 5'-end | OGL58-5nstPriF | SEQ ID NO: 6513 | TCTGAAGCACAGTTTAGCCGCA |
| | | 3'-end | OGL58-3nstPriR2 | SEQ ID NO: 6514 | GTGGTTATCTGTAGCTTGAGCACTGA |
| OGL59 | First PCR | 5'-end | OGL59-5PriF2 | SEQ ID NO: 6515 | TGTGTTCCTTCTCCATGCACCT |
| | | 3'-end | OGL59-3PriR2 | SEQ ID NO: 6516 | CCTTGTCACGGAGACTCTCGG |
| | Nest PCR | 5'-end | OGL59-5nstPriF2 | SEQ ID NO: 6517 | TCACATGCCTCAACTGGAGCA |
| | | 3'-end | OGL59-3nstPriR2 | SEQ ID NO: 6518 | TGGAAGGGCAAAACTGAGCC |
| OGL60 | First PCR | 5'-end | OGL60-5PriF | SEQ ID NO: 6519 | GCGACCTTTTCATTGTTGGAGTAGG |
| | | 3'-end | OGL60-3PriR | SEQ ID NO: 6520 | TACCACACCATCGAGCCGTC |
| | Nest PCR | 5'-end | OGL60-5nstPriF | SEQ ID NO: 6521 | ACGATTCAGTAGGTAGGGTGCCT |
| | | 3'-end | OGL60-3nstPriR | SEQ ID NO: 6522 | ACCCATTTCGAGCTGCCTGT |
| OGL61 | First PCR | 5'-end | OGL61-5PriF | SEQ ID NO: 6523 | CCATGCAGATGTCGAGGCAAC |
| | | 3'-end | OGL61-3PriR | SEQ ID NO: 6524 | TACTGCCTTCTGAACCGTCGG |
| | Nest PCR | 5'-end | OGL61-5nstPriF | SEQ ID NO: 6525 | TGTTTAGCTACATCCACGGGCAT |
| | | 3'-end | OGL61-3nstPriR | SEQ ID NO: 6526 | ACTGCAATGACAAGGCACATCC |
| OGL62 | First PCR | 5'-end | OGL62-5PriF | SEQ ID NO: 6527 | GCACGTCGTTAGTGATCGAGCT |
| | | 3'-end | OGL62-3PriR | SEQ ID NO: 6528 | GTTGTCAACGAAGCCCGTCTAATTG |
| | Nest PCR | 5'-end | OGL62-5nstPriF | SEQ ID NO: 6529 | CCTGCAGTTAACGCAGACGTG |
| | | 3'-end | OGL62-3nstPriR | SEQ ID NO: 6530 | CTAGACCGTACTATTGTGCTGTGAAG |

TABLE 9-continued

List of all "Out" primers for nested In-Out
PCR analysis of optimal genomic loci.

| OGL63 | First PCR | 5'-end | OGL63-5PriF | SEQ ID NO: 6531 TCCTTACTGGCCCCTAGTCCA |
| --- | --- | --- | --- | --- |
| | | 3'-end | OGL63-3PriR | SEQ ID NO: 6532 CTCCCACGAGCGACTAGCTAC |
| | Nest PCR | 5'-end | OGL63-5nstPriF | SEQ ID NO: 6533 TGCAACTATGGACTTGGCCACA |
| | | 3'-end | OGL63-3nstPriR | SEQ ID NO: 6534 CCTCACGAATAAAAGCACCCCC |
| OGL64 | First PCR | 5'-end | OGL64-5PriF | SEQ ID NO: 6535 AGTCTACGTGGCATACAACCCC |
| | | 3'-end | OGL64-3PriR | SEQ ID NO: 6536 GAAACTTGGACCTTGCTGTCGG |
| | Nest PCR | 5'-end | OGL64-5nstPriF | SEQ ID NO: 6537 AGGTCTCGAACAAACTCCCTATGC |
| | | 3'-end | OGL64-3nstPriR | SEQ ID NO: 6538 CCATTCCATGAAGACCGACTCCA |
| OGL65 | First PCR | 5'-end | OGL65-5PriF | SEQ ID NO: 6539 ACCAAATCCGTTTGCTTTCACCG |
| | | 3'-end | OGL65-3PriR | SEQ ID NO: 6540 CTCTGACAGATACCACGTTCGCT |
| | Nest PCR | 5'-end | OGL65-5nstPriF | SEQ ID NO: 6541 CACCGTTTCACGAAGCTGCA |
| | | 3'-end | OGL65-3nstPriR | SEQ ID NO: 6542 ACCGAAATCTGCGCGCTAGTT |
| OGL66 | First PCR | 5'-end | OGL66-5PriF | SEQ ID NO: 6543 ACAGAAGAGGTTGCGGAGTAACG |
| | | 3'-end | OGL66-3PriR | SEQ ID NO: 6544 AAACAAAATCGTATCGCCGAGCAG |
| | Nest PCR | 5'-end | OGL66-5nstPriF | SEQ ID NO: 6545 TACTTGGACCGGCCTCTACCT |
| | | 3'-end | OGL66-3nstPriR | SEQ ID NO: 6546 AACCTTGCAACAGCCCCAAAT |
| OGL67 | First PCR | 5'-end | OGL67-5PriF | SEQ ID NO: 6547 AGGTAATACCAGTGAGCCGAC |
| | | | Spec-PriR1 | SEQ ID NO: 6548 CCACGATCGACATTGATCTGGCTA |
| | | 3'-end | OGL67-3PriR | SEQ ID NO: 6549 CACTCTGTACTGGGAGAGGG |
| | | | UnivDonor-3PriF1 | SEQ ID NO: 6550 GTTTCATCAAGCCTTACGGTCACC |
| | Nest PCR | 5'-end | OGL67-5nstPriF | SEQ ID NO: 6551 ATAATGCAGCGCTTGCAGAT |
| | | | Spec-nstPriR2 | SEQ ID NO: 6552 GCTGGCGATGAGCGAAATGTAG |
| | | 3'-end | OGL67-3nstPriR | SEQ ID NO: 6553 CTCAATTCCATGTGCAACCAAAC |
| | | | UnivDonor-3PriF2 | SEQ ID NO: 6554 CAGCAACGTCGGTTCGAGATG |
| OGL68 | First PCR | 5'-end | OGL68-5PriF | SEQ ID NO: 6555 GTGGTGATACCGTCGTCTCTCC |
| | | 3'-end | OGL68-3PriR | SEQ ID NO: 6556 CACTTTGTCCCTGCTCGGTTC |
| | Nest PCR | 5'-end | OGL68-5nstPriF | SEQ ID NO: 6557 GAAACAAGCCATTGATTGTGCCCA |
| | | 3'-end | OGL68-3nstPriR | SEQ ID NO: 6558 GTCGACTCACAACGCTTCCC |
| OGL69 | First PCR | 5'-end | OGL69-5PriF | SEQ ID NO: 6559 AGTACAACACTGAGACGTGGGC |
| | | 3'-end | OGL69-3PriR | SEQ ID NO: 6560 ACTAGGATTGCTAGGGAGCACGAA |
| | Nest PCR | 5'-end | OGL69-5nstPriF | SEQ ID NO: 6561 AGATTGCAGGGCACTTGAGGT |
| | | 3'-end | OGL69-3nstPriR | SEQ ID NO: 6562 ACAGGATTACAAGCCCAAACCCA |

TABLE 9-continued

List of all "Out" primers for nested In-Out
PCR analysis of optimal genomic loci.

| | | | | | |
|---|---|---|---|---|---|
| OGL70 | First PCR | 5'-end | OGL70-5PriF | SEQ ID NO: 6563 | TTCTTCAGGCGGCATCGCATA |
| | | | Spec-PriR1 | SEQ ID NO: 6564 | CCACGATCGACATTGATCTGGCTA |
| | | 3'-end | OGL70-3PriR | SEQ ID NO: 6565 | TAGTAGCCGACAATGTGGCCC |
| | | | UnivDonor-3PriF1 | SEQ ID NO: 6566 | GTTTCATCAAGCCTTACGGTCACC |
| | Nest PCR | 5'-end | OGL70-5nstPriF | SEQ ID NO: 6567 | CGCTCAGGAAATCCTTGATGCC |
| | | | Spec-nstPriR2 | SEQ ID NO: 6568 | GCTGGCGATGAGCGAAATGTAG |
| | | 3'-end | OGL70-3nstPriR | SEQ ID NO: 6569 | GTGAACGACGGCAACAAGCT |
| | | | UnivDonor-3PriF2 | SEQ ID NO: 6570 | CAGCAACGTCGGTTCGAGATG |
| OGL71 | First PCR | 5'-end | OGL71-5PriF | SEQ ID NO: 6571 | GAGGTCCCTTACGGGTCATCG |
| | | 3'-end | OGL71-3PriR | SEQ ID NO: 6572 | ACCAGGTCTATCTTGCGCAGAC |
| | Nest PCR | 5'-end | OGL71-5nstPriF | SEQ ID NO: 6573 | AATAGCGTGGTCGGGTCCTAG |
| | | 3'-end | OGL71-3nstPriR | SEQ ID NO: 6574 | ACGAACGATCCAAGGTGCAGT |
| OGL72 | First PCR | 5'-end | OGL72-5PriF | SEQ ID NO: 6575 | CCAATGGACGACAGCGGTTAG |
| | | 3'-end | OGL72-3PriR | SEQ ID NO: 6576 | ACGAGAACAAGCCACTCTTGCT |
| | Nest PCR | 5'-end | OGL72-5nstPriF | SEQ ID NO: 6577 | CAACCGGAGAACGGATAGCCT |
| | | 3'-end | OGL72-3nstPriR | SEQ ID NO: 6578 | TGAAGATTTCCCTACCGTCGCC |
| OGL73 | First PCR | 5'-end | OGL73-5PriF1 | SEQ ID NO: 6579 | AGTACTGGGGACGTTCACCG |
| | | 3'-end | OGL73-3PriR1 | SEQ ID NO: 6580 | CGACAAGAACCCGGTACATGC |
| | Nest PCR | 5'-end | OGL73-5PriF2 | SEQ ID NO: 6581 | AGAGCTGAAACTGATCGCGGT |
| | | 3'-end | OGL73-3PriR2 | SEQ ID NO: 6582 | GACAGAGTCCGATCCCTGCT |
| OGL74 | First PCR | 5'-end | OGL74-5PriF | SEQ ID NO: 6583 | GCCACACGGATTTTGCGTATCA |
| | | 3'-end | OGL74-3PriR | SEQ ID NO: 6584 | CTTTTGTCGGTCCTGCCACTG |
| | Nest PCR | 5'-end | OGL74-5nstPriF | SEQ ID NO: 6585 | AGCAACGTAGGGTCACGGAC |
| | | 3'-end | OGL74-3nstPriR | SEQ ID NO: 6586 | GAGGAGTCTTCGATGCCACGA |
| OGL75 | First PCR | 5'-end | OGL75-5PriF | SEQ ID NO: 6587 | GAAAGCACCAGGTCGTATCTTGC |
| | | 3'-end | OGL75-3PriR | SEQ ID NO: 6588 | CGCACAATCTTCGCTTCAAACCA |
| | Nest PCR | 5'-end | OGL75-5nstPriF | SEQ ID NO: 6589 | GCATTGCTCTTCAGGAGGTACGT |
| | | 3'-end | OGL75-3nstPriR | SEQ ID NO: 6590 | CAGCTGTGCAAGTCCGACTG |
| OGL76 | First PCR | 5'-end | OGL76-5PriF | SEQ ID NO: 6591 | TCTCCATACCTGCACTGGGTG |
| | | 3'-end | OGL76-3PriR | SEQ ID NO: 6592 | ACGTGCTCTCAGCAACATCCA |
| | Nest PCR | 5'-end | OGL76-5nstPriF | SEQ ID NO: 6593 | CGTCCAAACAGGCTAGACAGC |
| | | 3'-end | OGL76-3nstPriR | SEQ ID NO: 6594 | TGCCTTTTGCGTCAACGGTG |

TABLE 9-continued

List of all "Out" primers for nested In-Out
PCR analysis of optimal genomic loci.

| | | | | | |
|---|---|---|---|---|---|
| OGL77 | First PCR | 5'-end | OGL77-5PriF | SEQ ID NO: 6595 | CCATCCAGATCGCGGTTGTC |
| | | 3'-end | OGL77-3PriR | SEQ ID NO: 6596 | TACGAGTTCACGCCATTGCGT |
| | Nest PCR | 5'-end | OGL77-5nstPriF | SEQ ID NO: 6597 | GTCTCCTCTTTGACGGTTGCG |
| | | 3'-end | OGL77-3nstPriR | SEQ ID NO: 6598 | TCGATCCACACTCGCATGCA |
| OGL78 | First PCR | 5'-end | OGL78-5PriF | SEQ ID NO: 6599 | GTGGACCAGTGTAAAGCCCG |
| | | 3'-end | OGL78-3PriR | SEQ ID NO: 6600 | TCCCTAGTGCCAGGACCTGA |
| | Nest PCR | 5'-end | OGL78-5nstPriF | SEQ ID NO: 6601 | ACACCAAATGTCCGGTAGCGA |
| | | 3'-end | OGL78-3nstPriR | SEQ ID NO: 6602 | CGACGATTCTCCATTGGCCG |
| OGL79 | First PCR | 5'-end | OGL79-5PriF | SEQ ID NO: 6603 | GCTAGAAACGCTGAACAGCAGC |
| | | 3'-end | OGL79-3PriR | SEQ ID NO: 6604 | CGGGTTTAGAATCCACAAGCCG |
| | Nest PCR | 5'-end | OGL79-5nstPriF | SEQ ID NO: 6605 | GACAAAAGCTGCCATCAACGCT |
| | | 3'-end | OGL79-3nstPriR | SEQ ID NO: 6606 | CCCGATATGGACAGGTCAGCT |
| OGL80 | First PCR | 5'-end | OGL80-5PriF | SEQ ID NO: 6607 | AAAGGCGACACACACCTTTGC |
| | | 3'-end | OGL80-3PriR | SEQ ID NO: 6608 | AGACAGCCATCCTCACTCGC |
| | Nest PCR | 5'-end | OGL80-5nstPriF | SEQ ID NO: 6609 | TTTGGTGCAGAGGCCGAGAA |
| | | 3'-end | OGL80-3nstPriR | SEQ ID NO: 6610 | AAGTAGCCAGGCAGACAACCA |
| OGL81 | First PCR | 5'-end | OGL81-5PriF | SEQ ID NO: 6611 | CTAGGCAGGGTGGCATGAAAG |
| | | | Spec-PriR1 | SEQ ID NO: 6612 | CCACGATCGACATTGATCTGGCTA |
| | | 3'-end | OGL81-3PriR | SEQ ID NO: 6613 | ACCATCAGAGGTTGTGAAGGCA |
| | | | UnivDonor-3PriF | SEQ ID NO: 6614 | CAAATTCCCACTAAGCGCTCGG |
| | Nest PCR | 5'-end | OGL81-5nstPriF | SEQ ID NO: 6615 | AAGGGCAACTTCATGGTTCAACC |
| | | | Spec-nstPriR1 | SEQ ID NO: 6616 | GTTGCCTTGGTAGGTCCAGC |
| | | 3'-end | OGL81-3nstPriR | SEQ ID NO: 6617 | ACCAGTAAATCCACAACCCATGGT |
| | | | UnivDonor-3nstPriF | SEQ ID NO: 6618 | GTAAAGGTGAGCAGAGGCACG |
| OGL03 | First PCR | 5'-end | OGL03-5PriF | SEQ ID NO: 6691 | TATATGGTGGCCAATGGACGATGG |
| | | 3'-end | OGL03-3PriR | SEQ ID NO: 6692 | CCACAGGAGCAAGCAGTGAC |
| | Nest PCR | 5'-end | OGL03-5nstPriF | SEQ ID NO: 6693 | CGCATCTTTGGGGGTAGTGG |
| | | 3'-end | OGL03-3nstPriR | SEQ ID NO: 6694 | AGTACCCAGTTGGTCTCGCC |

TABLE 10

List of all "In" primers for nested In-Out PCR analysis of optimal genomic loci.

| All Reactions | First PCR | 5'-end | Spec-PriR1 | SEQ ID NO: 5473 CCACGATCGACATTGATCTGGCTA |
|---|---|---|---|---|
| | | 3'-end | Uzi-PriF1 | SEQ ID NO: 5474 GGGATATGTGTCCTACCGTATCAGG |
| | Nest PCR | 5'-end | Spec-nstPriR1 | SEQ ID NO: 5475 GTTGCCTTGGTAGGTCCAGC |
| | | 3'-end | Uzi-nstPriF1 | SEQ ID NO: 5476 GAGCCATCAGTCCAACACTGC |

TABLE 11

Primers for ZFN cleavage activity.

| OGL 1 | Control/ZFN 111879 | SEQ ID NO: 5477 TGGCACTAATCTCACCGGCT |
| | | SEQ ID NO: 5478 AGTCTTAGAAGTACGCTACCGT |
| OGL 2 | Control/ZFN 111885 | SEQ ID NO: 5479 TACTTGGCTTCGGCGGCGA |
| | | SEQ ID NO: 5480 GGGTGACTTTTACGCGTCTCG |
| OGL 11 | Control/ZFN 117402 | SEQ ID NO: 5481 GGTCACGACGCATGGCCTAA |
| | | SEQ ID NO: 5482 AGGATGCATGGATCACCGTC |
| OGL 12 | Control/ZFN 117404 | SEQ ID NO: 5483 GCTCTGTTGTGCAGCCGTAC |
| | | SEQ ID NO: 5484 CGTTGCAGATACCACAGTGTAC |
| OGL 13 | Control/ZFN 117429 | SEQ ID NO: 5485 GCTAGTAGCTGTTTACACGGCGTCT |
| | | SEQ ID NO: 5486 AGGTCGAGACAACCAAGTAGAG |
| OGL 14 | Control/ZFN 117406 | SEQ ID NO: 5487 ACAGGACATCGAGCTTGCAT |
| | | SEQ ID NO: 5488 CAGAAGAAAGGCATCAACTCATG |
| OGL 15 | Control/ZFN 117408 | SEQ ID NO: 5489 CTCTTTCACCTCTACTTTTACTTCAG |
| | | SEQ ID NO: 5490 ATTGAACCGTTGTCAAAGCCA |
| OGL 16 | Control/ZFN 117411 | SEQ ID NO: 5491 CACAGCGTCAGGGCGGTAAC |
| | | SEQ ID NO: 5492 GGCACGCACCTGTCACTGAC |
| OGL 17 | Control/ZFN 117413 | SEQ ID NO: 5493 GTACGCGCCCGGGAACTCCT |
| | | SEQ ID NO: 5494 CCTGCGGCCCACGTGCATCT |

Deployment of the In-Out PCR assay in a protoplast targeting system was particularly challenging as large amounts of the plasmid DNA was used for transfection, and the large amount of DNA remains in the protoplast targeting system and was subsequently extracted along with cellular genomic DNA. The residual plasmid DNA may dilute the relative concentration of the genomic DNA and reduce the overall sensitivity of detection and can also be a significant cause of non-specific, aberrant PCR reactions. ZFN induced NHEJ-based donor insertion typically occurs in either a forward or a reverse orientation. In-Out PCR analysis of DNA for the forward orientation insertion often exhibited false positive bands, possibly due to shared regions of homology around the ZFN binding site in the target and donor that could result in priming and extension of unintegrated donor DNA during the amplification process. False positives were not seen in analyses that probed for reverse orientation insertion products and therefore all targeted donor integration analysis was carried out to interrogate reverse donor insertion in the RTA. In order to further increase specificity and reduce background, a nested PCR strategy was also employed. The nested PCR strategy used a second PCR amplification reaction that amplified a shorter region within the first amplification product of the first PCR reaction. Use of asymmetric amounts of "in" and "out" primers optimized the junctional PCR further for rapid targeting analysis at selected genomic loci.

The In-Out PCR analysis results were visualized on an agarose gel. For all Zea mays selected genomic loci of Table 12, "ZFN+ donor treatments" produced a near expected sized band at the 5' and 3' ends. Control ZFN or donor alone treatments were negative in the PCR suggesting that the method was specifically scoring for donor integration at the target site of at least 72 of the optimal nongenic maize genomic loci. All treatments were conducted in replicates of 3-6 and presence of the anticipated PCR product in multiple replicates (≥2 at both ends) was used to confirm targeting. Donor insertion through NHEJ often produces lower intensity side products that were generated due to processing of linearized ends at the target and/or donor ZFN sites. In addition, it was observed that different ZFNs resulted in different levels of efficiency for targeted integration, with some of the ZFNs producing consistently high levels of donor integration, some ZFNs producing less consistent levels of donor integration, and other ZFNs resulting in no integration. Overall, for each of the Zea mays selected genomic loci targets that were tested, targeted integration was demonstrated within the Zea mays representative genomic loci targets by one or more ZFNs, which confirms that each of these loci were targetable. Furthermore, each of the Zea mays selected genomic loci targets was suitable for precision gene transformation. The validation of these Zea mays selected genomic loci targets was repeated multiple times with similar results every time, thus confirming the reproducibility of the validation process which includes plasmid design and construct, protoplast transformation, sample processing, and sample analysis.

Conclusion

The donor plasmid and one ZFN designed to specifically cleave a Zea mays selected genomic loci targets were transfected into Zea mays c.v. Hi-II protoplasts and cells were harvested 24 hours later. Analysis of the genomic DNA isolated from control, ZFN treated and ZFN with donor treated protoplasts by in-out junctional PCR showed targeted insertion of the universal donor polynucleotide as a result of genomic DNA cleavage by the ZFNs (Table 12). These studies show that the universal donor polynucleotide system can be used to assess targeting at endogenous sites and for screening candidate ZFNs. Finally, the protoplast based Rapid Targeting Analysis and the novel universal donor polynucleotide sequence systems provide a rapid avenue for screening genomic targets and ZFNs for precision genome engineering efforts in plants. The methods can be extended to assess site specific cleavage and donor insertion at genomic targets in any system of interest using any nuclease that introduces DNA double or single strand breaks.

TABLE 12

Illustrates the results of the integration of a universal donor polynucleotide sequence within the *Zea mays* selected genomic loci targets. As indicated by the * below, donor insertion within OGL73 was only confirmed by a PCR reaction of the 5' junction sequence.

| Name | ID | Location | Cluster Assignment | ZFN (pDAB#) | Donor (pDAB#) | Targetable Locus (Y/N) |
|---|---|---|---|---|---|---|
| OGL01 | optimal_loci_204637_G1 | chr5: 200298202 ... 200301414 | 16 | 111879 | 111845 | Y |
| OGL02 | optimal_loci_204726_G1 | chr5: 200665730 ... 200670667 | 03 | 111885 | 111846 | Y |
| OGL08 | optimal_loci_31710 | chr1: 194939396 ... 194943360 | 23 | 117400 | 117415 | Y |
| OGL11 | optimal_loci_64542 | chr2: 72203716 ... 72205045 | 14 | 117402 | 117416 | Y |
| OGL12 | optimal_loci_156393 | chr4: 154313884 ... 154315253 | 10 | 117404 | 117417 | Y |
| OGL15 | preffered_loci_198387 | chr5: 164712378 ... 164713567 | 25 | 117408 | 117419 | Y |
| OGL13 | optimal_loci_157315 | chr4: 158710709 ... 158711983 | 30 | 117429 | 117434 | Y |
| OGL14 | optimal_loci_197372 | chr5: 158680601 ... 158681681 | 26 | 117406 | 117418 | Y |
| OGL16 | optimal_loci_232228 | chr6: 144719567 ... 144723469 | 28 | 117411 | 117420 | Y |
| OGL17 | optimal_loci_285621 | chr8: 118321357 ... 118322528 | 06 | 117413 | 117421 | Y |
| OGL04 | optimal_loci_43577 | chr1: 256469704 ... 256472666 | 20 | 124802 | 124812 | Y |
| OGL05 | optimal_loci_301774 | chr9: 23468085 ... 23470278 | 15 | 121900 | 121926 | Y |
| OGL06 | optimal_loci_232222 | chr6: 144700575 ... 144702126 | 20 | 124810 | 124813 | Y |
| OGL07 | optimal_loci_203704 | chr5: 194836270 ... 194840217 | 12 | 121902 | 121930 | Y |
| OGL09 | optimal_loci_59517 | chr2: 43352132 ... 43353146 | 1 | 118643 | 118697 | Y |
| OGL10 | optimal_loci_25001 | chr1: 151371224 ... 151372260 | 1 | 118648 | 118686 | Y |
| OGL18 | optimal_loci_112632 | chr3: 128098856 ... 128100257 | 2 | 123802 | 123810 | Y |
| OGL19 | optimal_loci_28905 | chr1: 177037718 ... 177038919 | 2 | 123805 | 123809 | Y |
| OGL20 | optimal_loci_129164 | chr3: 221246027 ... 221247542 | 3 | 121992 | 123808 | Y |
| OGL21 | optimal_loci_2425 | chr1: 12810845 ... 12814490 | 3 | 118650 | 118697 | Y |
| OGL22 | optimal_loci_122036 | chr3: 184608166 ... 184609697 | 4 | 118654 | 118688 | Y |
| OGL23 | optimal_loci_5735 | chr1: 29190279 ... 29192844 | 4 | 118656 | 118689 | Y |
| OGL24 | optimal_loci_178978 | chr5: 35776311 ... 35777560 | 5 | 118659 | 118690 | Y |
| OGL25 | optimal_loci_288888 | chr8: 133290442 ... 133291481 | 5 | 118660 | 118697 | Y |
| OGL26 | optimal_loci_60310 | chr2: 47967092 ... 47968271 | 5 | 118767 | 118787 | Y |
| OGL27 | optimal_loci_243330 | chr7: 34630402 ... 34631577 | 6 | 118769 | 118787 | Y |
| OGL28 | optimal_loci_127038 | chr3: 210603611 ... 210605198 | 7 | 118663 | 118697 | Y |
| OGL29 | optimal_loci_262784 | chr7: 155767046 ... 155769049 | 7 | 118668 | 118691 | Y |
| OGL30 | optimal_loci_344662 | chr10: 119131667 ... 119133955 | 7 | 118669 | 118692 | Y |
| OGL31 | optimal_loci_153894 | chr4: 139979597 ... 139981225 | 8 | 118670 | 118693 | Y |
| OGL32 | optimal_loci_28771 | chr1: 176062139 ... 176063611 | 8 | 118673 | 118694 | Y |
| OGL33 | optimal_loci_1098 | chr1: 5582601 ... 5583834 | 9 | 118674 | 118695 | Y |
| OGL34 | optimal_loci_97772 | chr3: 30209253 ... 30210607 | 9 | 118676 | 118696 | Y |
| OGL35 | optimal_loci_236662 | chr6: 165975716 ... 165977010 | 10 | 118677 | 118697 | Y |
| OGL36 | optimal_loci_139485 | chr4: 42804231 ... 42805751 | 11 | 118680 | 118697 | Y |
| OGL37 | optimal_loci_301175 | chr9: 20325171 ... 20326621 | 11 | 118683 | 118764 | Y |
| OGL38 | optimal_loci_152337 | chr4: 130033092 ... 130035481 | 12 | 118685 | 118765 | Y |
| OGL39 | optimal_loci_202616 | chr5: 188822901 ... 188824814 | 12 | 123833 | 123809 | Y |
| OGL40 | optimal_loci_282323 | chr8: 100763204 ... 100764398 | 13 | 118771 | 118787 | Y |
| OGL41 | optimal_loci_262782 | chr7: 155759080 ... 155760097 | 13 | 121943 | 121983 | Y |
| OGL42 | optimal_loci_236455 | chr6: 164795991 ... 164797027 | 14 | 121946 | 121984 | Y |
| OGL43 | optimal_loci_162531 | chr4: 189896984 ... 189899332 | 15 | 121949 | 121985 | Y |
| OGL44 | optimal_loci_344663 | chr10: 119143167 ... 119144795 | 15 | 121952 | 121986 | Y |
| OGL45 | optimal_loci_337001 | chr10: 77188319 ... 77190007 | 16 | 121959 | 121987 | Y |
| OGL46 | optimal_loci_238100 | chr7: 4899227 ... 4900708 | 16 | 121963 | 121988 | Y |
| OGL48 | optimal_loci_264359 | chr7: 163504241 ... 163505487 | 17 | 121971 | 121990 | Y |
| OGL49 | optimal_loci_282653 | chr8: 102704765 ... 102705924 | 18 | 121972 | 121991 | Y |
| OGL50 | optimal_loci_80282 | chr2: 173420834 ... 173421870 | 18 | 124097 | 124295 | Y |
| OGL51 | optimal_loci_291068 | chr8: 148277606 ... 148279985 | 19 | 123818 | 123831 | Y |
| OGL52 | optimal_loci_56395 | chr2: 24801482 ... 24803132 | 19 | 118705 | 121201 | Y |
| OGL54 | optimal_loci_114664 | chr3: 140106950 ... 140108061 | 21 | 118711 | 118792 | Y |
| OGL57 | optimal_loci_53137 | chr2: 7304197 ... 7305496 | 22 | 118718 | 118794 | Y |
| OGL58 | optimal_loci_344664 | chr10: 119144946 ... 119146850 | 23 | 118722 | 121208 | Y |
| OGL59 | optimal_loci_81941 | chr2: 181418576 ... 181421181 | 24 | 118726 | 121209 | Y |
| OGL60 | optimal_loci_321514 | chr9: 140776147 ... 140777584 | 24 | 118728 | 121210 | Y |
| OGL61 | optimal_loci_301180 | chr9: 20328932 ... 20330129 | 25 | 118732 | 121211 | Y |
| OGL62 | optimal_loci_348776 | chr10: 142097590 ... 142098803 | 26 | 118733 | 121212 | Y |
| OGL63 | optimal_loci_244439 | chr7: 41068791 ... 41070248 | 27 | 118735 | 118795 | Y |
| OGL64 | optimal_loci_348258 | chr10: 139297032 ... 139298517 | 27 | 118739 | 121214 | Y |
| OGL65 | optimal_loci_322501 | chr9: 146078534 ... 146080201 | 28 | 118742 | 121215 | Y |
| OGL66 | optimal_loci_244324 | chr7: 40299412 ... 40300584 | 29 | 118745 | 121216 | Y |
| OGL67 | optimal_loci_97232 | chr3: 27463016 ... 27464143 | 29 | 124081 | 124866 | Y |
| OGL68 | optimal_loci_282499 | chr8: 101771408 ... 101772767 | 30 | 125361 | 125366 | Y |
| OGL69 | optimal_loci_155031 | chr4: 146991391 ... 146993137 | 31 | 118753 | 121218 | Y |
| OGL70 | optimal_loci_301773 | chr9: 23465509 ... 23467762 | 31 | 124878 | 123880 | Y |
| OGL71 | optimal_loci_283161 | chr8: 105321958 ... 105323571 | 32 | 123829 | 123832 | Y |
| OGL72 | optimal_loci_55524 | chr2: 20099003 ... 20100485 | 32 | 118761 | 121221 | Y |
| OGL73 | optimal_loci_127268 | chr3: 211767898 ... 211770046 | 16 | 124086 | 124298 | Y* |
| OGL74 | optimal_loci_137693 | chr4: 31118968 ... 31122359 | 3 | 121904 | 121927 | Y |
| OGL75 | optimal_loci_265551 | chr7: 170127188 ... 170130734 | 3 | 121905 | 121927 | Y |
| OGL76 | optimal_loci_128078 | chr3: 215482594 ... 215485640 | 4 | 121917 | 121927 | Y |

TABLE 12-continued

Illustrates the results of the integration of a universal donor polynucleotide sequence within the Zea mays selected genomic loci targets. As indicated by the * below, donor insertion within OGL73 was only confirmed by a PCR reaction of the 5' junction sequence.

| Name | ID | Location | Cluster Assignment | ZFN (pDAB#) | Donor (pDAB#) | Targetable Locus (Y/N) |
|---|---|---|---|---|---|---|
| OGL77 | optimal_loci_168286 | chr4: 219987223 . . . 219990695 | 4 | 121918 | 121928 | Y |
| OGL78 | optimal_loci_3733 | chr1: 19232372 . . . 19235997 | 11 | 121909 | 121930 | Y |
| OGL79 | optimal_loci_203075 | chr5: 191370802 . . . 191374627 | 12 | 121912 | 121929 | Y |
| OGL80 | optimal_loci_232484 | chr6: 146122164 . . . 146125580 | 12 | 121981 | 121936 | Y |
| OGL81 | optimal_loci_136086 | chr4: 22531506 . . . 22534989 | 27 | 124091 | 124298 | Y |

Figure 14:
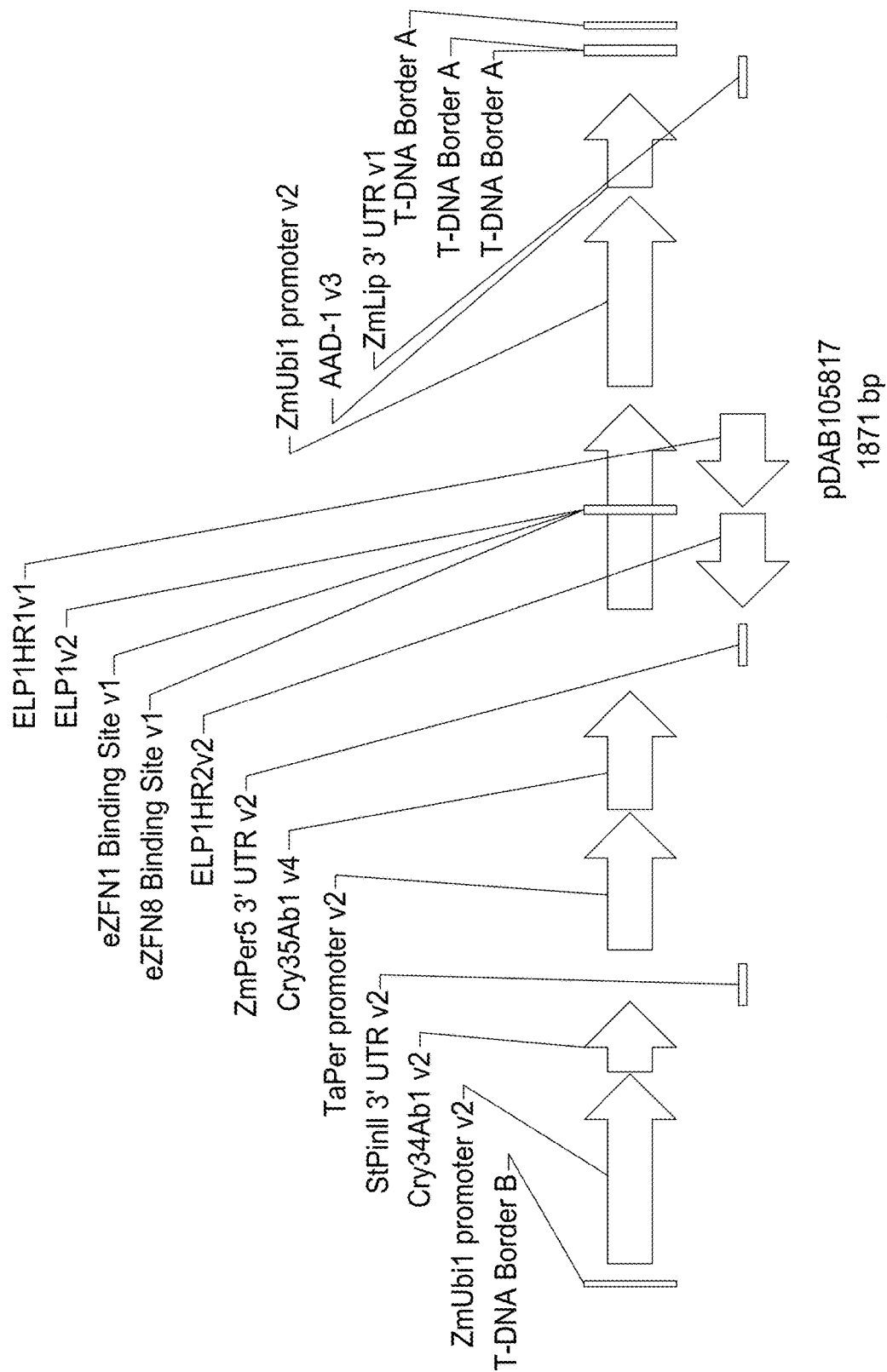
FIG. 14. Plasmid constructs transformed into *Zea mays* via random integration that comprise the events used for flanking sequence analysis and transgene expression studies.
Figure 14B:
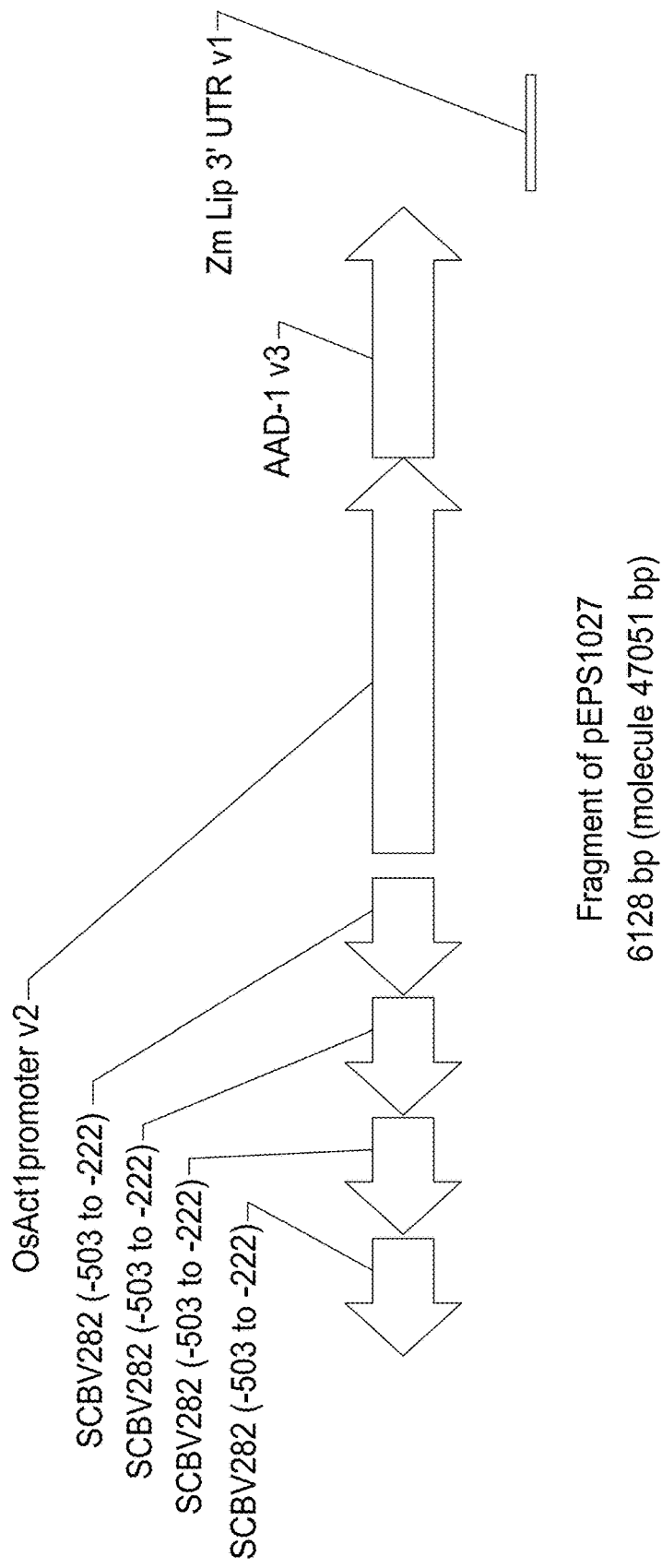

Example 7: Expression of Polynucleotide Donor Sequence within the Genomic Loci of Zea mays Randomly integrated maize transformation events were generated by transformation with the pDAB105817 and pEPS 1027 plasmids containing the aad-1 transgene, described in U.S. Pat. No. 7,838,733. (FIG. 14). Large numbers of events were produced and 1,027 stable events were analyzed to determine if any of the events contained a randomly integrated transgene within the Zea mays selected genomic loci targets via a genome flanking analysis method as described in U.S. Patent Application No. 2012/0258867. As such, the chromosomal location of the integrated transgene in 223 events was mapped within the Zea mays genome. The data, Table 13, indicated that the chromosomal location of the integrated transgenes demonstrated integration within hypomethylated regions (45-73%) and in transcriptional units (promoter/gene/3'UTR) downstream of at least 1 Kb areas (60%).

TABLE 13

Genomic and epigenomic context of the 1027 mapped events.

| | No. events mapped with high confidence | No. events mapped with low confidence | No. of total number of events |
|---|---|---|---|
| Count | 107 | 116 | 223 |
| 100 bp hypomethylated regions | 102 | 61 | 163 |
| 2 kb hypomethylated regions | 68 | 27 | 95 |
| Gene body | 45 | 26 | 71 |
| Upstream 2 kb | 32 | 11 | 43 |
| Downstream 1 kb | 16 | 3 | 19 |
| Repeat | 9 | 62 | 71 |
| Total genic/repeat | 88 | 98 | 186 |

The mapped events were further analyzed using the optimal locus predictive criteria described in Examples 1 and 2 (hypomethylated regions, unique regions, nongenic, non-repeat, proximal to genes in a 40 Kb neighborhood, evidence of active expression in roots/shoots, evidence of recombination) and several randomly integrated events were identified within the Zea mays selected genomic loci targets (Table 14). For example, targeting within the Zea mays selected genomic loci targets optimal_loci_232222 and optimal_loci_127268 have been demonstrated using Rapid Testing Analysis and by in planta targeting, respectively.

The average length of the experimental Zea mays selected genomic loci targets were approximately 1 Kb and varying degrees of aad-1 expression was observed at each of the Zea mays selected genomic loci targets (Table 14). The average aad-1 expression analysis was conducted at the $T_1$ plant transformation stage via a real-time PCR analysis of isolated transgenic leaf material. As such, random integration events within the Zea mays genome were capable of expressing a transgene within the experimental Zea mays selected genomic loci targets.

TABLE 14

Expression of the aad-1 transgene in randomly integrated within the optimal genomic loci. The Location, Length and RNA expression for the aad-1 marker gene at the locus are shown.

| Event ID | Optimal Genomic Loci Name | SEQ ID NO: | Location | Length | AAD1 RNA Expression Avg T/R |
|---|---|---|---|---|---|
| G3_PL2863_1027-nstPri3 | optimal_loci_43565 | 655 | chr1: 256293759 . . . 256295777 | 2018 | 22.687 |
| H4_PL2783_1027-nstPri3 | optimal_loci_164397 | 4552 | chr4: 199185401 . . . 199186813 | 1413 | 32.825 |
| B6_PL2955_1027-nstPri3 | optimal_loci_232222 | 3357 | chr6: 144700575 . . . 144702126 | 1553 | 3.1805 |
| E7_PL3018_1027-nstPri3 | optimal_loci_125749 | 19 | chr3: 204456962 . . . 204458140 | 1179 | 0.5185 |
| E4_PL2955_1027-nstPri3 | optimal_loci_7953 | 1777 | chr1: 41279823 . . . 41280909 | 1087 | 4.0805 |
| A7_PL2746_1027-nstPri3 | optimal_loci_205643 | 2037 | chr5: 205773760 . . . 205775465 | 1705 | 1.3761 |
| F4_PL2978_1027-nstPri3 | optimal_loci_201819 | 2726 | chr5: 184470152 . . . 184471958 | 1807 | 0.56075 |
| B8_PL2955_1027-nstPri3 | optimal_loci_42519 | 1929 | chr1: 250905847 . . . 250908881 | 3035 | 0.4591 |
| B104/pDAB 105817{1}0 15.001-1 | optimal_loci_127268 | 2709 | chr3: 211,767,898 . . . 211,770,046 | 2149 | 1.54 |

Example 8: Optimal Nongenic Maize Genomic Loci for Transgene Integration

A suite of optimal nongenic maize genomic loci were identified from the 5,286 optimal nongenic maize genomic loci to select multiple loci for site specific targeting of gene expression cassettes and to generate stacks of gene expression cassettes. The following criteria were used to filter the pool of optimal nongenic maize genomic loci and select a suite of optimal nongenic maize genomic loci:

1) Greater than 3 Kb in length. The optimal nongenic maize genomic loci can be targeted with the integration of at least two sets of gene expression cassettes.
2) Recombination frequency of 0.5 to 1.0, which is less than the average recombination frequency of the identified 5,286 optimal nongenic maize genomic loci (average recombination frequency is about 2.0).
3) Greater than average expression of endogenous genes within 40 Kb of the identified 5,286 optimal nongenic maize genomic loci. Average expression of genes within a 40 Kb region in root and shoot tissues is greater than 6.30, which is the 48th percentile of all optimal nongenic maize genomic loci.
4) Sequence coverage and sequence identity of greater than 90% between Zea mays c.v. B104 and Zea mays c.v. Hi-II.

Figure 24A:
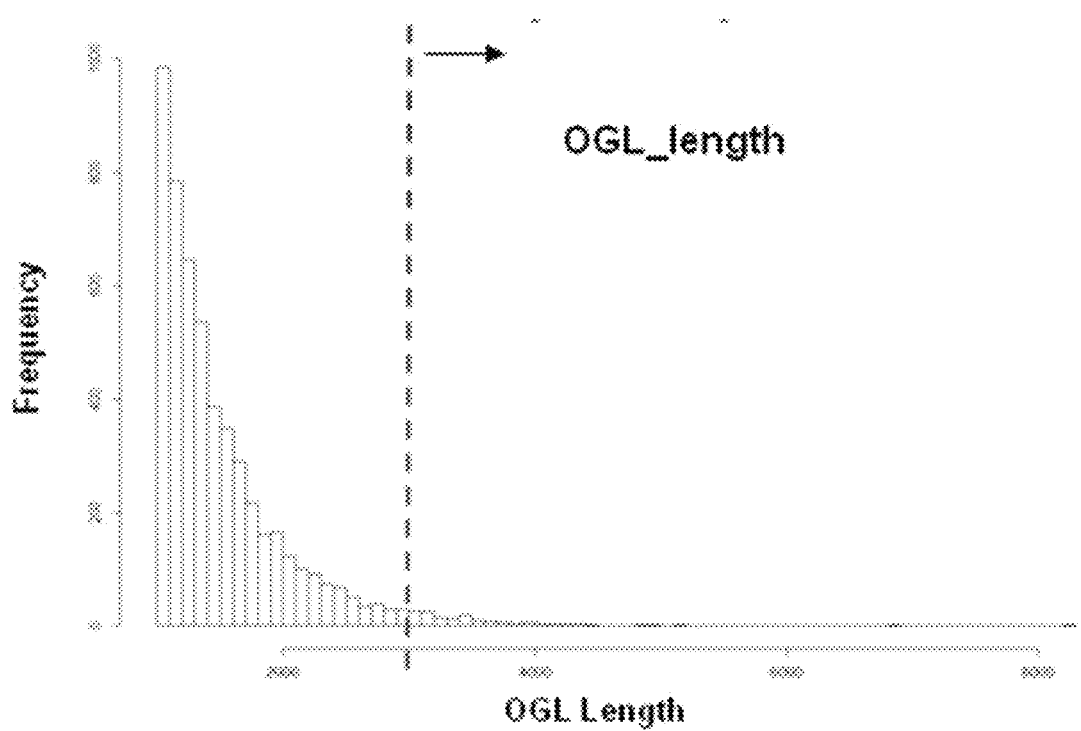
FIGS. 24A-24C. Histrogram of characteristics (length, expression of coding region within 40 Kb of loci, and recombination frequency) for the identified optimal non-genic maize loci.
Figure 24B:
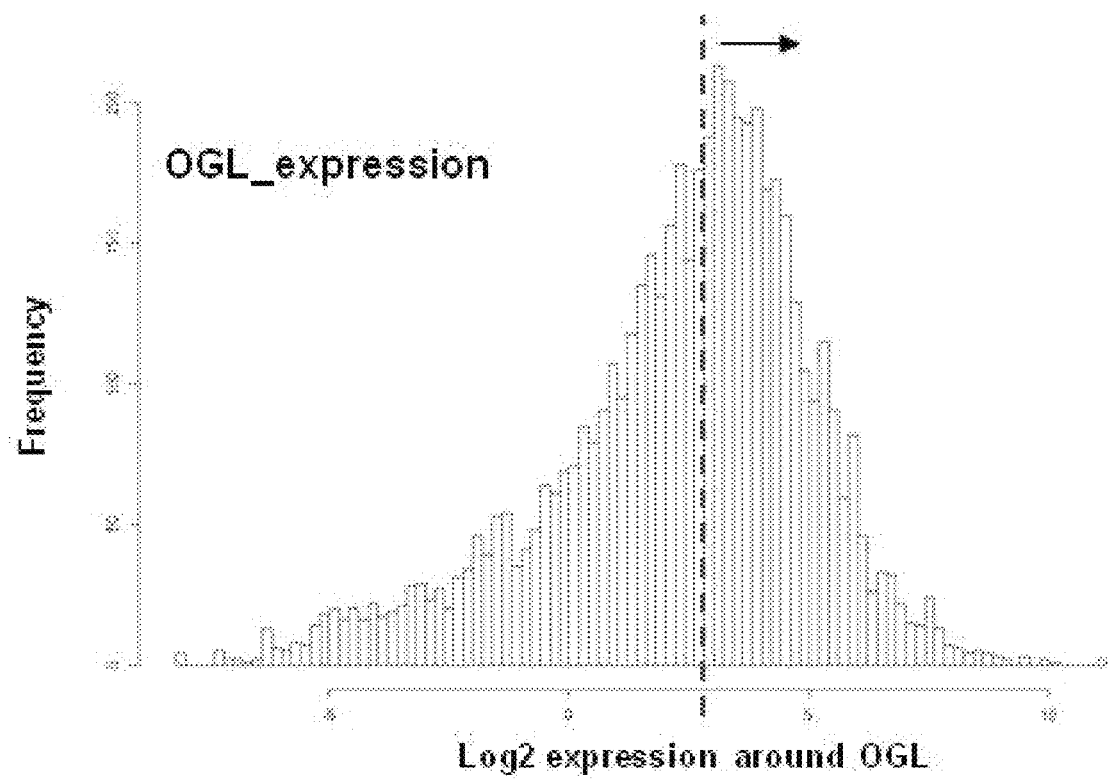
Figure 24C:
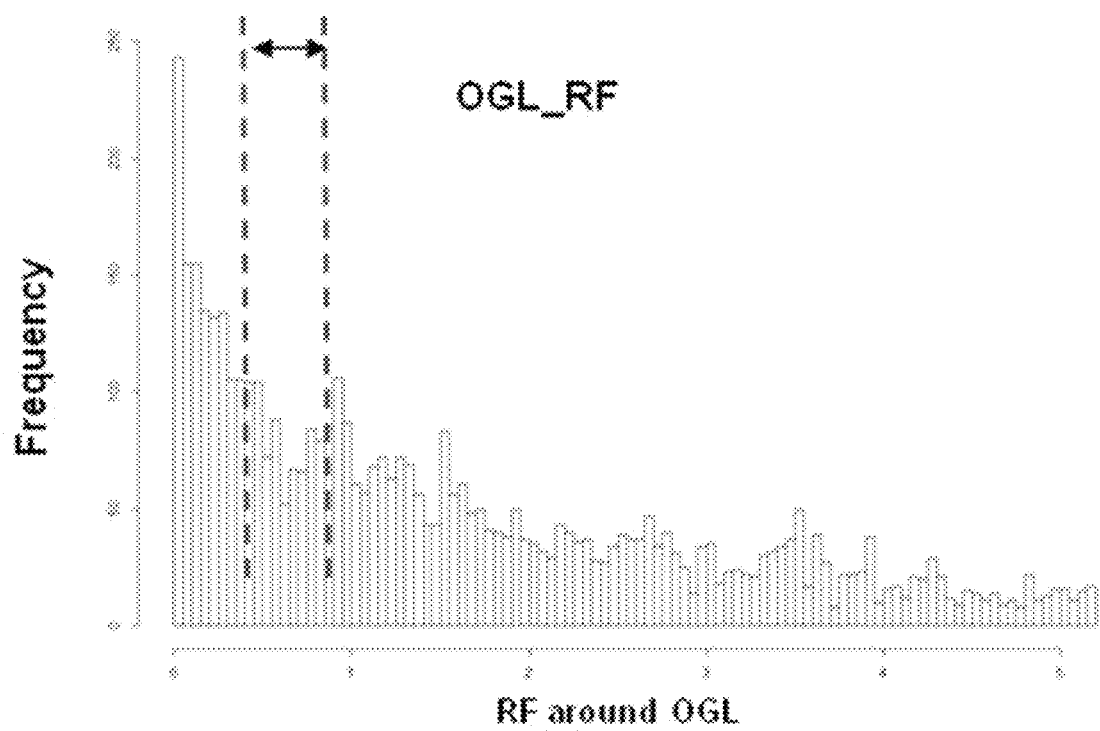

Each of the above described criteria were applied to select a suite of optimal nongenic maize genomic loci. FIG. 24 provides three illustrative diagrams of the criteria, and how the selected optimal nongenic maize genomic loci compared in relation to other loci. Nine optimal nongenic maize genomic loci (optimal_loci_137693_G1, optimal_loci_265551_G1, optimal_loci_128078_G1, optimal_loci_168286_G1, optimal_loci_3733_G1, optimal_loci_203075_G1, optimal_loci_232484_G1, optimal_loci_136086_G1, and optimal_loci_203704_G1) that were at least 3 Kb in length were identified using this criteria. See Table 15. Additional optimal nongenic maize genomic loci were identified by reducing the size limitation to ≥2 Kb (optimal_loci_291068_G1, and optimal_loci_43577_G1), these loci were added to the suite of optimal nongenic maize genomic loci. Another set of optimal nongenic maize genomic loci were added to the suite of optimal nongenic maize genomic loci as there was evidence of expression of a randomly integrated transgene via *Agrobacterium* transformation at these sites (optimal_loci_232222_G1 and optimal_loci_127268_G1). The optimal_loci_204637_G1 and optimal_loci_204726_G1 genomic loci were added to the suite for their meiotic recombination unit features. In addition, optimal_loci_204637_G1 and optimal_loci_204726_G1 have been successfully targeted for integration of a donor polynucleotide. Likewise, optimal_loci_232228 was included in the suite as this optimal nongenic maize genomic loci has been successfully targeted for integration of a donor polynucleotide, and the length of the sequence is 3.9 Kb.

Figure 25A:
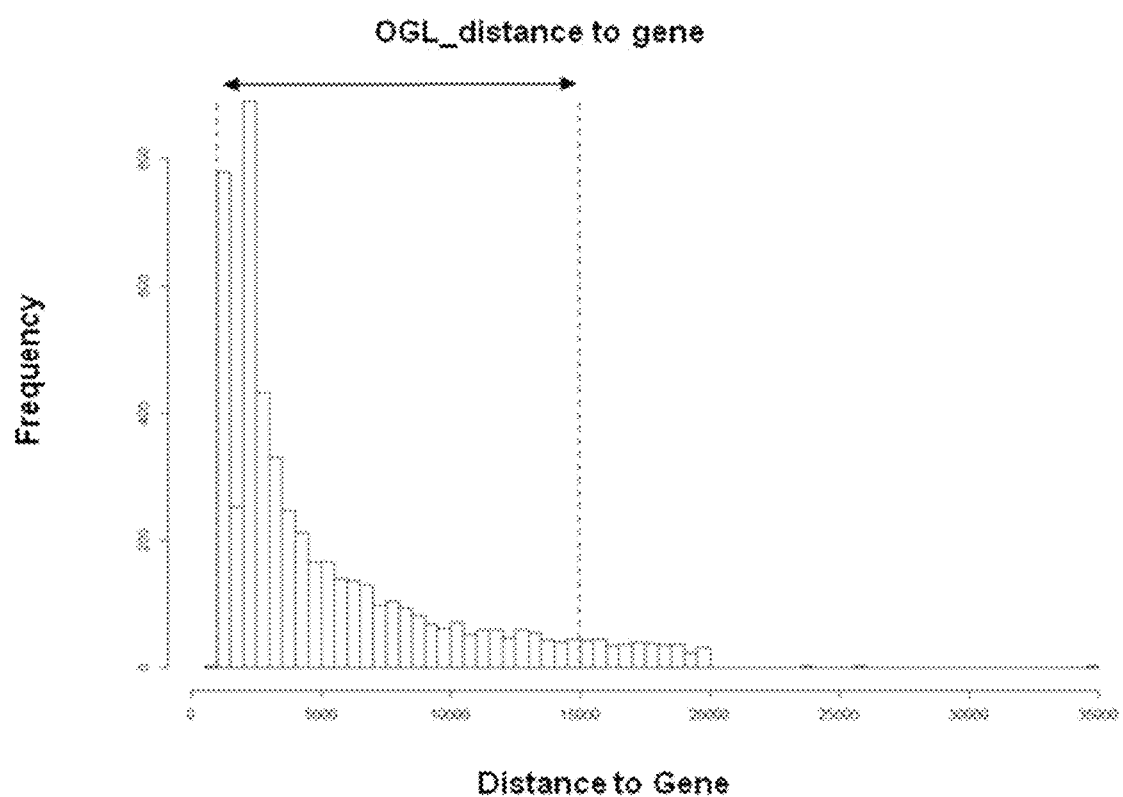
FIGS. 25A-25B are histograms of characteristics (distance to actively transcribed endogenous gene and distance from centromere) for the identified optimal nongenic maize loci.
Figure 25B:
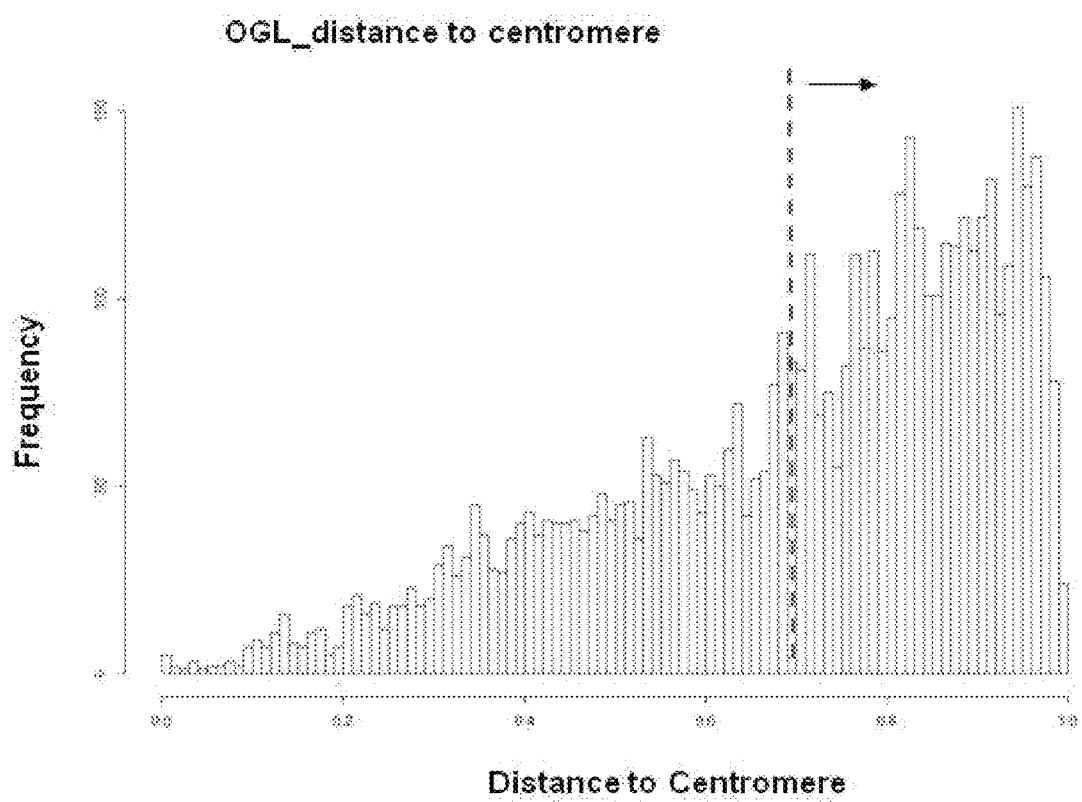

Next, all of the optimal nongenic maize genomic loci were characterized for distance to proximal genes and distance from centromere (FIG. 25). The suite of select optimal nongenic loci are about 1-15 Kb away from proximal genes and are located towards the end of chromosomes (distance >0.70 from centromeres) (Table 16, FIG. 25). Finally, interference by quantitative trait loci was probed to fully characterize the suite of optimal nongenic maize genomic loci.

TABLE 15

Suite of optimal nongenic maize genomic loci.

| OGL_ID | Location | Length | SEQ ID NO: |
|---|---|---|---|
| optimal_loci_203704_G1 | chr5: 194836270 . . . 194840217 | 3948 | 2033 |

TABLE 15-continued

Suite of optimal nongenic maize genomic loci.

| OGL_ID | Location | Length | SEQ ID NO: |
|---|---|---|---|
| optimal_loci_291068_G1 | chr8: 148277606 . . . 148279985 | 2380 | 3230 |
| optimal_loci_43577_G1 | chr1: 256469704 . . . 256472666 | 2963 | 3428 |
| optimal_loci_232222_G1 | chr6: 144700575 . . . 144702126 | 1552 | 3357 |
| optimal_loci_204637_G1 | chr5: 200298202 . . . 200301414 | 3213 | 2731 |
| optimal_loci_204726_G1 | chr5: 200665730 . . . 200670667 | 4938 | 424 |
| optimal_loci_232228_G1 | chr6: 144719567 . . . 144723469 | 3902 | 4529 |
| optimal_loci_127268_G1 | chr3: 211767898 . . . 211770046 | 2149 | 2709 |
| optimal_loci_136086_G1 | chr4: 22531506 . . . 22534989 | 3484 | 4425 |
| optimal_loci_232484_G1 | chr6: 146122164 . . . 146125580 | 3417 | 2053 |
| optimal_loci_203075_G1 | chr5: 191370802 . . . 191374627 | 3826 | 2030 |
| optimal_loci_3733_G1 | chr1: 19232372 . . . 19235997 | 3626 | 1923 |
| optimal_loci_168286_G1 | chr4: 219987223 . . . 219990695 | 3473 | 573 |
| optimal_loci_128078_G1 | chr3: 215482594 . . . 215485640 | 3047 | 560 |
| optimal_loci_265551_G1 | chr7: 170127188 . . . 170130734 | 3547 | 463 |
| optimal_loci_137693_G1 | chr4: 31118968 . . . 31122359 | 3392 | 387 |

TABLE 16

Optimal nongenic maize genomic loci characteristics.

| OGL ID | Distance to closest gene | Distance to centromere |
|---|---|---|
| optimal_loci_137693_G1 | 4070 | .70444101 |
| optimal_loci_265551_G1 | 9252 | .94191056 |
| optimal_loci_128078_G1 | 2491 | .87326872 |
| optimal_loci_168286_G1 | 1710 | .84128147 |
| optimal_loci_3733_G1 | 14910 | .856875 |
| optimal_loci_203075_G1 | 1001 | .75612998 |
| optimal_loci_232484_G1 | 1001 | .80656755 |
| optimal_loci_136086_G1 | 4381 | .7859925 |
| optimal_loci_203704_G1 | 2001 | .788019 |
| optimal_loci_127268_G1 | 2758 | .84500724 |
| optimal_loci_204637_G1 | 2874 | .83827931 |
| optimal_loci_291068_G1 | 4243 | .77879798 |
| optimal_loci_232222_G1 | 2832 | .79463887 |
| optimal_loci_43577_G1 | 2001 | .73018748 |
| optimal_loci_204726_G1 | 11370 | .84166127 |

The optimal nongenic maize genomic loci that are selected using the above described criteria are validated by integrating a gene expression construct that contains selectable/reportable markers. This gene expression cassette is stably integrated into maize plants via genomic targeting using a site specific nuclease. The targeted optimal nongenic maize genomic loci that are produced and contain an expressible transgene are analyzed to identify single copy events that contain a full length integrated gene expression cassette. The expression profiles of the optimal nongenic maize genomic loci are analyzed via qRT-PCR, Western blot, ELISA, LC-MS MS, and other known RNA or protein detection methods over multiple plant generations (e.g., $T_1$ and $T_2$ generations). In addition, the effect of the transgene

SEQUENCE LISTING (6694 sequences)

SEQ ID NO: 1 - DNA, 1015 bp, Zea mays
  misc_feature (1)..(1015): optimal_loci_59517_G1, chr2:43352132..43353146, Cluster 1
actaagggttcaaacaggaaattaataaaaaaatacgactctgctggggatcgaacccagaatctctggttccgtagaccagcgccttatccattgggccacagagtctttgatgtaaacgtcttgcctaaaaacatactaaggcttaataaaaatgttactgtaagaactgagccctcttaggcacgtgttggtcatcagggtcctcgccggcccgtcaacggtagtattggccgtcggctgcacgaaccgtctccatagtaccagtggcctcgagcggcatccccagatagttggtctccggtagtaacgccaccacgaaggcggtctcgcgctcagtcgatctcatcagccttccttctcgctagatcgtcgttcggatcgaagaacgcagcggataaccaagaccttttgcatccttcaccgcggtgactcgatcgtcagctacgcaatcgtctctagctatttgtatactagtatgcatgtcttgtctttttgtttgttggttcagttattcgtcgagtcgctacaaataaaacgacttagctatgcaaatggtagacaacgggttgaggaaccaggatgcatgagcagatagtagctaggagggagaccctgttgccagacaatggggtgtcgagaaagaagattgccctgggctagctggccgggccacggcttccgatcctgccatcatatatattcatatcggtgattcgattcgatggccgatcttcgcagctccgatccgttgcctttgaggacccaggttacagtgggcagcacatactgcaagagtgttggcatgttcacgtcgacctggtgtttccatgcgctggcgtgcgccgtgtcgggcgggttcagctgggcgtggcgtggggggcgcgcgcgcgctgttctgggcggtgcggtgccgggcgagagggcatccggtccgtggggcgcggcgctcggctttgcgcagatgcagagcttcctgctgacgctgcgctgcgccagctcaagcaccccatgc

SEQ ID NO: 2 - DNA, 1052 bp, Zea mays
  misc_feature (1)..(1052): optimal_loci_106888_G1, chr3:89417633..89418684, Cluster 1
caaaagtccgatttagctcaaaattcgtggagatcttagaaacatatttggctaggtgtgtgtaaaattttatttaaatcagagttcttttggttcaatttcgcatccgagaatagaatttagtgttgctgaaatcagtacttgttcgctacacggttttagactgatttagatttttttttttgtgttcgatttgtgatccgttcattttgctagtttcgtgtgagtattatgaactttttgaaatcatgagatcgctaatttgatgatatgattttagtttgaacgcttttttgatctcaattaaagtgaagtgctcaatttcagtttttagcagcaaaatttgattagctctcatttaaccctctctgatcgcctcaccggttaggctctacttcacatttatatctaatattctaactaactagcaaagaacagacgcatggtaacacgcaagtgcacatgacaaacatgttacaacaaaaaggttaccatctcacgcaattgtcggtatagtcggatagctactccacggtgaatatagatgccgtcctagagcagaacagatgcatgtgaaatgaatacaccagcacatcgtccacaagtacatgatgggcacatgattgtagaagaaaatgtcatgaagaatggcagctgtaggatccggataggccagctaggaatctatcgtaatgccgtttcgtcaaatccaagagctggactggactggactggacaagatcaggccgtggtccatcggtcgcacatgacaagaggatcgagctagctagatagggttgttgcacgatagtcttgtgaagatcagttgccgtatgcggggacgggacgcgtcaaagtctgccatgggtgttccttcccgccaacaacctttccaattccggctccaagctaggacaagaagtcaattctatgaacgtgttacattgcatctgttgtaactctcaaaggagatttgatcagcattgtcatccaccacatcgtgattaaaccgcaaccacacaagactcatcttgacaggaacaatacatact

SEQ ID NO: 3 - DNA, 1281 bp, Zea mays
  misc_feature (1)..(1281): optimal_loci_10883_G1, chr1:58456639..58457919, Cluster 1
tagtctatatactcaaccaaaaccgaccatctccttaataaccgctgatcattttttaacaccatagacgtatatcaaccatgcatgtacttgcattcagaaataccaccagtacgtgtcggtgtctccaatttccaagtgtttctacaggaataggcgaatagccacatgtttaggcatgagtaaaagctagccgtgaaaaaaaaatgtggaatcctaaacaccagagaagcgacgcagtatatacccacgcaataacaatatcatcagtcagcatcgctttaaattctctggaactcgtacacagagcgaggcgtaagcagcactcttcttttttttttgttggtagtgtccaacctgctttaaatcgactgggaaattcagccaaaccattcaccaaaaggctccaaaaaaatcttgtcttaaaccgcaggggtccccaaaaatgacgcaaaaattcacagtcacccattgtgaacgcctcatcggcctgacaactacgttcatatcatggactgtactgcgctctcagcatctcacatgtagctccgaaagcaaggaaacaatggagcacactatgcgcggatcacgcaattatttgccgaacagtaaagggcacgaacaagtccagagtttgcgaggcggccgtggctcgcgactggactccacgagcttatttgaggcgacggtgggcgactgtgatgttttttttttagcctggagaaatttgaaaccacttgatttagttcgtacagaaaagggattttttctgatgggtacatgcatgtctgtatagctgatactttggtaggggccaaatgggttgagtattttacaaataatcattgtggccattatattatgtcgtccttgcgcttgcgcactaatctttcttcctcttgttgttgtcgtttttgattgatggagtggagattatcagtttggtcagctgtatattgaggccagctttgagtgctctgtggatgtgccaggggggaggagataaccctagctctttatgaaaagaagaagaagaagaaaaatcatgaaaggtgaacgtggttcgaggtgtctctagagtaagattttgctttatagtgggaaatcacggattaaatggagtagtttcgtctggcttgaaatttactacaaaaatggagcattctgggatttattttttgataaaaacaaagacacgatgcaaagtgtttgcgcgtaatagaacgtgtggttttaagagccatggtgctgctaaaactgttggtttttttgtttcgagat

SEQ ID NO: 4 - DNA, 1125 bp, Zea mays
  misc_feature (1)..(1125): optimal_loci_109890_G1, chr3:110685301..110686425, Cluster 1
aacatgtattgtaagcttgttctcttttgtttttaaaaaatattatcatcttgttcttaagagcacataaagagtgttattgcatcctttaaactatggtatattgaacatggtgttgtacttgtgatccgaagatccgacgagtataacttattttatccatattatattcaaagtctctctgaacaacccattgctaaaacagatttacatcctactggagacaatgctggctgagaaattgaggctggcacaggaaaactcaacaaatgtttgtgaataaagcattggttgagaacgacacggaagatagtgaactagaagacgacaacaacctcatctaagctaaaaatgtgttgcccgtggttgaagaaaatctagaaggtgaacaacacactaccctctgtgtcctctctagacatgaaactctaatggtgagcctaggcattgcacaaatccaacaattttcatagtgcctcaaagatagatgcatcatcatctgacttgatgtgtgtgactttaccacctgtgtgtttcgttgtcagcaaacatttttcaaagaaccttctaaagaggtgtatcctatttatgtggtgaaataaatccacacaccttacctgccatatgtcattgttgagctgatcagcaattggagtcatgtgataagcttaattgaccttctatttgtcatgatcttcacaatgaacaaggtaatcagctcggctacattatatttgcagcatggtctagccaaaggcttgattaccatatgccatcattctgaaacaaaagaaaatgttgcattaaaccatgtttattcctttcagtgagaagcctttgcatgttgcatgagatcaagcaaaccattcagtttgttggtgaggtgtgaatcactagccatgttggccaccatgcagatggagcaaaacatgcaggtggagcggatggatacatgatcgatcatgagttggtgcagacaacaggccagaggacatactacacttaatccactccatggttccatgataggcaacagaatattcaagacaatagaaatatattatatacaagcaacaaacaacttttgggttttattattctatgcctcctattttcagtccaaaa

SEQ ID NO: 5 - DNA, 1333 bp, Zea mays
  misc_feature (1)..(1333): optimal_loci_11269_G1, chr1:60774088..60775420, Cluster 1
acaaatttggtgggatgatctcattcctcgtattagtattaactaactaactatgatgaatgatgtggtgatgaatcaactcattctattccacgaaccaaataaaaaagcaagagtcaattctctatcggccactgacaaaaattgaaattccatatataccattaaaaaacttgtgacgcctaacataccactaacaaaattttcccatgccctttatgccattaccgttagattttgggttgacggcaactcaccaaagcttgaaaagaccatattgcccttggttcatgtggcgttagaatttttgatttccttctataccattccaagcgtttatttagcattgtacatagagttattaaacgagacgatctagcagcagttgggtgctcacgtacggaggcgtaaaccagcatgcacgctatcatgacaaatcaccaacgtgacgtgcgtgcgttctatcatgcacgacagctagatttttctaaataaccgaggaaagattataaaataatacgtacaaaatacggagcgagaaatgttaattcattcatggaccaatggaatattgcatgcagtgtagcctacaggcaccgaccgacgagaggagctcggctcgaagcgggacggcgacggctcggcgacgtgcggcagtagctcggcgaacggccaccacacctcgaccatagatgcgtcttgctagctgccgagacgagatggacgactcgattggtggtgggccgaccacgtgcatgcgtgcgctgctgccgtcgtcgcacctcgcatgcacgtcacctttgccctacatgcacctcgcgtacccgatagccgcagctggctgtgtgcgcggccgctgtgcgcccacgccggcgccccactgctggtacccgccaagcacacacatgacacgacactgtcgtctccaagctcgccgtacgtgccattgccacgcccaagcacacacgtgaaattccataacacgaatatgaatatccatgtttgttcacctttcttcttgagaacacgtgttatcaaaccatcaaaatttagagcatttttgggtttattatatatattatataaactcgcgcatagcagtgatcggatgccgtcaaccatacggggagatcaagtccaaaagaactttttaaaaagatttaatacttagccaatacgactgagtggcatggaaggaacttacgcaaattttcaatgtgaactaagcaaagggcgatgtggtctttttcatccttcagtcagaaactgtcaccttcaaatttgactgcagtggcacaaaagtccccgaaaattttcaccgatgccatgttag

SEQ ID NO: 6 - DNA, 1022 bp, Zea mays
  misc_feature (1)..(1022): optimal_loci_113659_G1, chr3:133910055..133911076, Cluster 1
taaaaaaatccaagataaagacatgcattttcagtagatagaagatatagttgattagtgcattgaatactttgactaaagacgcatattgtagatatatccactatatcacaatgtgtcctagtggtgtcttgtgtttagagtaccgtgagttcaggattgtacaggccctataaacatcttatatgggtgcttctaccccatgctcttacagtcatagaatcagctttgtcacattgtgcacctgaatctataaagaacatgttcctttggacaaaaaccagctcccaacaaaaaggaaaaacccttctctcatctcaaactcctggatagaagagacgacaacacatcccaacgatcggttgggattaggcctaggcatctggttcttcagttcagtttggtttcttagttttatagaaaattcgattactaggagaggcagaatcgaggatttcagtttcggttctatcttaaccaactaaggtttagcaaaaataggaaagcaacacaattttagatttagcagaagtgcatagatgactagatggaggattgggaatggggatggattgttttttaggagttgtgtgcttatatacttagggtttgggaaggctatattgagctaagcctaaagttttattggtctattgggcttctattatattttggttttctcgatcaattcaattttctcaagtctagaaccgaaattactttggttatttcggttttctaaaacatggaaccgaatttactagcgattaattcagtttcggttaattcggttttggttttggttgattcagttcggttcttcatttttggtttattttgcctaggcctagttaagatgaggaagatattagataactttttctttatggaccctatttatggatccatcgttagttctatttataataacagttttaacgaataacatcgactcattgtatagaaccccagttgaacccataagttgtggattatccaacagttgcaataccaaccatcac

SEQ ID NO: 7 - DNA, 1009 bp, Zea mays
  misc_feature (1)..(1009): optimal_loci_11590_G1, chr1:63203504..63204512, Cluster 1
tttattttcctgtctaccaaatcagccctaagagattaacgacgatctcatatcatcagagatataaaggtatgtttttatttagtccagcaacccccgaccaacatgctaattgtagctcctgtggcagctagctagccacaacagattttaggcttaacgtaaagatgcatctccccctctgatgagtcgacgtcgaatctcggaacaaaaagggagatgggagagcaagctagccatgcatgcaacgccctcgccatcatttgctgctgcagtgcagtagtgctgcgatcattatttacccagcacactccggcctgcagtgtgatgttctttgttttctgattaattaaacagcagtcttgtcgtgcggccggcagctgtcgtcggccagcaacgctatatatgctgctattgctatgatatactatattgcttgcgatggaagacacgggcggcgcggcggatgacatgcatgatgcgtgccctgactaatgaactacctccaatggacgatccatgttaagcagcggccggcaactaatcaatcaatcaatcgaccactggaggagctagcgcaccggccgaccggttaacgtagggttcccccggccgccgtgtggtggtcgtctcttgtttagagtggagcgtctatcatgcagctctgaggatatgtttggtgggatgtacaaggagggatagaagcatgaatgagtcggtaaatttagaggtccttattaaacttcaaaaaagatcctattttatagaaaaatataatcgaaattacattttaatagaattcatgtattctgaatttcaaaaggtttactagataacactttatattaaatctatctgtttttacgaaattatattgtaacagaatacataaataacaaacgtattaatagatgtgtttgaagagcagcaatctagctgctaactgagttcagcttatatggtgtaatgttagtttactcactgatgcatattgtttaggcttactatt

SEQ ID NO: 8 - DNA, 1151 bp, Zea mays
  misc_feature (1)..(1151): optimal_loci_11664_G1, chr1:63638540..63639690, Cluster 1
tataaaaaaaatatgacgcggcacgtccgttgaaactgatgatttaatatagtagagatagagatagagactattattatcacatatattatattatccgaggcgcatcccccttgcattctcttgtgcaagatataggaggtaataagcagaggatgtaagccttcgaactgccacagtgccactcatatatacacgtcatggtaactttggcacgcagccaccagcccaccaggcaggcacttccccggccaagtcacacacatcccaatcggttttggtcaaagactacacgccggagtggagcgtggccattggccagctcatgcacctccatccgatccctgacgttttccatgctaaaattacgtttcaccggccacagacacacacagacacagagcaggccattggctcgatcgctcgctagctgtttattagtagattatttattgcgtcgttgcgtatagaacgcaccctgctagctgcaccttgattaattaattaattagtgtatatataagtatggttgttgtggaactaccttttcgttaatcctagaataagatactgtctacggcaagcttagctcctgcaacgatccttctcggtagtagtcgagagacctcccaactaacggcctgctagagctagctgcatccccatcgtcgtcgctggcaactggcctcagctggtgacttgttaatgtatagttgaatcaggaaatgcgcgcgtaagagaaaaccaaaccaaacacggatatggggcagagacatcactagccacgcatgcactatagctgatataagtaaaaaaaatatatctaataatgtaaatgaccacacacagatcagatgatcatgcatatgcgctgaaccgtccaagtcagcgacgacggctcaagcgtacaagccaaaggtagtaggtagttgctgcaggccggcttatagggccttgagccagaagattatactactgcaagtgccatcatattttagggcaatatatataggagggggatgctaattaactggcattatatattggtattcttcttcttttttgtatagattgcttgagaataatataacgtttttggtttgaaactttccaaaccatacgataaataattacattttaagggcgaattc

SEQ ID NO: 9 - DNA, 1018 bp, Zea mays
  misc_feature (1)..(1018): optimal_loci_117229_G1, chr3:155966899..155967916, Cluster 1
aagcaagatttggcctgctgttgggctgaaaatcgactgtgggccggatcaaatgaagtactgggccgaacacgaactgctacggcatgaaactctttaatgttctctctctctctctctcattttttctccctatgactatgatggtccaaacgcgaatgttgcggtacaaatacttccaagagaaaaacaaaacggaatgtatatactcaattgccacggcaggattgctttggccggccgactgccagtgcgccagatgcttggttagatgtggtcgagccgctctactcaaatgactgcaacaagacactccggtgcgttactcttacattccatcatatagccatgcgtttagcaactgtctcagcatggatgccaacatctaaccagctggtgcatctttgatgcagccgtacaccaaatgccttaagttgggctcctataacttgcattgggttcccataaggacatggagacattggtgaattaaggaaactaaccttttggttttggcagtaacttgtactggacgtctggaccttgagcccttgactgaataagccggtatacatgtcaagagaggatagagtggaccagaccagccactgaaatgttactatactatatcatcaggaggcatgatagagaagttgcactgacattgtgctaggagtgcacaagcatgatattcaattcaactgtttgtcttgttatgccttggttggtagtattatgatcagaaagagagagagagagagagagagagatgtggtgtgttgtgaatgtgaagctgggggcatgaccagaccagaggctcgagcatgagaggagaggcagcagctgtggtcatgcatgttatgatgccaaatgcctgatgcagtgtactgctctctgctccctgctttgcatggcctcgttatttctctgtctagtcaaacaggagcctgtgccagtacaaaaagaaaacttagtcctggtattatatatgcaggtggatggattcaggcattcagca

SEQ ID NO: 10 - DNA, 1356 bp, Zea mays
  misc_feature (1)..(1356): optimal_loci_118758_G1, chr3:165703776..165705131, Cluster 1
cagacgtcgctgccgaattaggttcattcatattaaattttgtggtgtccaactggcgccacttcaaagggtttgcacctcatagctcttgtatgtaacactataggtatgtaatgtaacgacctggctgaagaagtgaaatgttccatatttgctgagacggcctcttttgttcgtgtgctggttcatctcatcgacttggttccttgttctgccttattattgagcaatagaatacaataccattgcatcatgacatttcttttgcaagaggtcaaacgcgtgaagcctgacatcgccctacaatcattatttattcttcaatactcggtttctttatgacgttgagagtaaacttcaaacttctcttgcaatacagcacatttaattcgattcctctctgggaaagcctgggagtatttaatctgataatatatactagccattgaacaaatgtctgaaagttgacatgtactcactattgcatcatagagttccatgccctcgacctcgatgcagcaagattctacttttgctgtttgtattaagaatggcgacttggcgagcatcatgctgctttccagtttccaggtcgctcctcattagaaacaaccgctgccccgtcacccatgtccgaaggcatttctcaactcgaaagtccctgtcgaactgacctgtcaaacccgtcctatggtgagagcgagaccaccaggccagttgccggcatccgtttttccaaggctgcgtgtgttagtgctcgccgatgtgacccatggaagacctaaaaagtatattccacacggtcggggccagtcacctacggcggctggcacctaaaataccgcctttccggcgcacgcatcgcacacttggatttttaaacagagctacagctctggaagcggaagctgccatggctagcttccgtctccgttcaaaagggaaagccgcgacggcgaccggcgaaccgcatccccggtatgtgtcgcgccacgtgaagccgtggcccgggcaccggatgccgtgtcgcacttgcgggtcaaggtccggcggtccggtctcgtccggccgcacaggcacagcgatgccgccagagaccgtgacccgcgccgctgaaccgtgtacgtacgtgggtggacgggaggaaggcgctgccgcccgcgcagccgtcgccccccgacaaggacgacaacgagccgggctcgcgagggaatgagcacgtgggcgcggtggaacgggagctggaaagctcgaggctatgactctttgagaacgggacggcaaagggtttgggtggtgcagcagagggatcagatcacgggagacgaaaccggggcgcagccgcagccgcagccg

SEQ ID NO: 11 - DNA, 1108 bp, Zea mays
  misc_feature (1)..(1108): optimal_loci_120345_G1, chr3:175890489..175891596, Cluster 1
atggtagaccaatagcgctcattacttgtttctttcttagataattcttatgaacattggattatctcaactagcttctgtgcactatttgtcccgcattttccccttgtcttgcttttctgaacttacgtgtctgctctgtctttttattatcacaaaaccgaaagagcttgaaaactatatattgtatattgtaagagagaataaatattgggacaatttttttgatgttctaacttttaataacattgcatatgggaaaacaaattttctactgcaacagcatataaagcgtgcaatactgtactgggtctaggcaagatatggcggggatgttcagttgtccacagatgccatacttgttaccgtagcattacctttttatagtttcagtttcaggttgctcatatagtttgcttatgcttgagttattcacattgttccttacttggattcattcgctggattcatcatttctacatatgtttatttaagttttctttgttacactcaacatgaacaatgcctcatgttcttgtagccattgtgattcatgttatcctcacactgcactgctaaccatttaagtattttttgtgcatcgatagttttacctttataccagcatagaagagagataatttgggcagtgtaacaccaccgaatgtttgttttgtattaagattaacacctcaggcatgccatcatcctactttgacctcataccaaacacatccataatcttttagtattgacaacataataaggccacatgactgagaaagattgaagttaagctctgcaaccattgtttatccatttactgcatcaaaataatggaaatatttattaaaagggaagtatgtccaaacaatttcacaagagactaaattatgggcatatttgggatttaggaggtgttatgctgaccttgggtaagaatcattagtggttcacttgttcttgagctttatcatttgtactccgttctgtttataatatatgggacccacatgaaaaattcagattatcgatcaaacactacttatctcaattgtgaaatttattaggagatctataataacggtgggagatctataatattata

SEQ ID NO: 12 - DNA, 1249 bp, Zea mays
  misc_feature (1)..(1249): optimal_loci_1214_G1, chr1:6185788..6187036, Cluster 1
gtgagctcaaagaccccgccagaaatatccatccattctgtacgcgtgatttccggttcggtcgctggcttgttgctgactcggtggcgtggcgacagggaaggaagcctgtgtgggctgtggcaagtcgaacaaggctacaagccgccagcctgcactgcaccgtgcggttcgaatgggtttttttatcggtttaattacatagaaagtcgtctaataagtaaatcacatcggtttaagatctggtctagttctaatagtaagctacgccatgacgtgccgtgcggagagctcccgattccgtcttttttagagagataaacacgatattctttttttttatatatatagattcggtggacggtgggtaacttctttcttcggataagtaatcgtgcgcccgaatttaaggcaggcaatgcctagtgggagtggagcactgaccacgagcatctgctactactacaacgtccgttccttcaccgttgatatccagataagcgtatcgttatcataagaacaaaaatatatgctactccatatacatatatataaaaaagaaaagggcaataagcgtatcgtttatgcacatactgacgtgcagtcagttgctcaaaaaaaaaatcgtgcggagccgcacgtgtacatcgtgtacagagactgagagacatgtacacgtggaggccagaaagcgattcgagacgtacgcgtacggtgctccgtgctcccattctcgataggcgatagccgatacaccttccttttcctttcgggacgtcgttggctccgcaaagcaacgccgcagctgctggtccgatcgaccgcgccgtgaaggcgacgcggcccgggccctgtatagcgcactatgctacgactcacgcgacatgactcgtactgcgtgcttgtctacttcacacttcacgtgtgccatcgacgtacggggctgtaagggtgaaaacggaatcgtacgctagtgtatttaaaacgtattcgatatcggatatgaatagttataaacgggacggttacagatacagagatcgaatatgtattcgggcagataagtgacagatacatttatgatttggtcggatctcgaatacttgatggataatacattaattgtttatcataaaatatccttgttcgaccctaaaattgcaaataaattatcttgaataataaacattttataagaagataatctcaaattcctccataaaaatggtaaagtaaaatattaattatg

SEQ ID NO: 13 - DNA, 1227 bp, Zea mays
  misc_feature (1)..(1227): optimal_loci_121863_G1, chr3:183876231..183877457, Cluster 1
catctatatagataatccgctgtagtaaatgccgttgaaagaacaaaacactcttataagatgtttgaaataaccaaatttgattaccttttatagcgtagtttttataatatgctcacgcaatttattttgtcaggttgactagatttaagcttgaatttgtacttattttgttcaatttatttttatcgctaagatatattgaaaaggaaataaaattgacagacatccctatggtaaaaattaaaaaaaacagcacattcttccatatcaaacgtaatctagtatttccaagtactttctagagaaatctccctctttaatgcggactctttctgatctgataggctgatagctctttgtgaaatttgttatttaaacaaaatttgatagctctttgtgaaatgcggactctttctagcgaagggtgcaagtttttttttattagatcttagagataaaaataaaaaagatatcttcataaagataataccaagataaacttaaatttagttaatccggcaaaataaactgtctaaacgcactatcaaattcaggctataaagagtgatttaatttaatcgtcaacggtgctcacgaagttaaccctgtataacgaaaactttataatgatgtttgttttgttctctcaatggtatttaagagaataaattatgtataaatatagatagcaacagagggaataagatttgtctatacaccggcaatgacgataagaatataaaaatctaaatgaataatggtgatataattataaatttagacgacattgaatggatcaatgccaacgaggggaattctctctattttgatagcgtaagcggaaatgatggatggatttgatttgtatactgtactactactcctgtctactcctatatatcctgacgcagatgacgaggcggtcggtggccgtacggtggcagttggatgcacccccaaggctccaactccatgcccgagcccgcacgaagcttcgttgcggttgcggcttccagttggctcaccggcagggtgtatggcagggcagcaatctccggcacgcttcgagctatttggagctgccgcgtgcacgtggagacggcgcactgctcgcgatgggtccatctgccagtgttcctcacaggcttcgcctggcctgacagggtagcatgtacttacgtgtacggtcgcagagtcctagcctcgccggtttgcacgcggtga

SEQ ID NO: 14 - DNA, 1116 bp, Zea mays
  misc_feature (1)..(1116): optimal_loci_124208_G1, chr3:196055877..196056992, Cluster 1
agtgacactagttagggtttgcagtgcgtcgtctttttactcttcttgtaagtcgtcgtctacggatgacgttctataaacacgccatatatagtgaatgtttcgaatggctgttgttcgtggtttttctcttcgtattgaaaaggttttccatgtaaatttgtgtgtcgtgctcatctacaacatcatggcgtggctatctataatatataatgaagatttcgtctagttccgtggctcggaggcggaagctagtctcgatggagatggagattatgcatggcgcgatgggcgatgcgagagaaaatgatacattgattatccatatcgtttcttagatcggcagactatcaacaaacagtatagtaaatagtgcagaaacttgagcagtgcagtatgttgtgtactcttcgtcgatcacaaaaaggcataaacaatacggtaatcacctttttattaatatagatcagaataatgttgtcttcagtagaatgtatatagacacatggtcgagactatattgttcacggtgtgagtttataatctctaatcaataagtattgtcattgtatactctcggttgggccaccatcggcagggctcgggagatgcagagctcgcttcgcgaaggcccgcaggcgcctgctgacgcaggagacgatgcacaacgccttgagtcgaagttgatccatcgtaacaccagcgtcagcccgttctgctcgaggatgtaaaaaatgaatattttgttaattgcataaaagtgaaggggtgtcaacacattcaaataacattttttcgaagaagaggtttgaaggagctaaaattcttttaatccccttctactaaacaaacatagaaaatatatatttcttcaccgttagataattgtttttttttctctgaactagcatatagctcgtgcaaacactacaatctcaaagatgagagagatcgacggcagcggcgtgagtgaggggatgggcagcatggtcgtgtgggaggctggcgacagagtcacgaggaagggagagagatgaagaatgatccaaataattttgtccattagatttgtataaggaatgagctatttagcaatctgaactgtcggtttttacg

SEQ ID NO: 15 - DNA, 1039 bp, Zea mays
  misc_feature (1)..(1039): optimal_loci_124897_G1, chr3:200284517..200285555, Cluster 1
tcccacacacatgaagttgtggtaccggatgacctttcgagtaaaggaagggattttgcaagctagaatacaaacattctttctttggtaccttgtttctactaaaagtagctagtgcagcacgtaagggcttgtttgggaggaagagtaatggagaggattgaaggggctagaataccccactattcaattttaaatagtgagggattctagcaccctcaatccccttcattccacttgctcccaaacaaaccctaagtgttcaaacattatgtatataactttgtagagctcaattttccttttaatgtattaaagaacaaaagttcatacaagaaaatcaagcttctgcccacatgtcacctgcgccccgtggaccacccacatcgcccgcatgttgctcgtatgtcgcccacgctcgtggagtcaggtggatatgtgcttttatgaactttcctaaccctagaccctattctttcctacatgtgtcatggcctaggccatggtccagtggcttgcggcccaaatccctccctgagtaggatcaaacgaataagttgttgttgtgctacaacaaaataatggcattctaacattaggaccttgactagcatctgcctgtttgttctccattgtgtccaagagcgcccccaccttcaccagcaaagggctatcctggtggtaggtccatgcctatttttctaatggggacgatcacatcccaacttctccaccattggccttggcttcgatagcttcattagtgctttgagatgggcaaccgcctaggttcttagtgcttcacaaatgcctaggattgagctatctgacaacgctctacctaatttggatataacagtgtggcctatgttaatggcctagaaaccaaaaccagaaaagacaaagccttctagagtctttaattaatacctagttgaaagatagagacatcctcaacaataatgttgtgatagagataatgtacccatgaagccaacgacaagaacttatatcgccaatgcatgagctatgcctcgat

SEQ ID NO: 16 - DNA, 1363 bp, Zea mays
  misc_feature (1)..(1363): optimal_loci_125104_G1, chr3:201367736..201369098, Cluster 1
gatatacattcacaaaatctaaatttatcaaattgataaatctatagaccacattcattgttttggtaaaacttctcaaggagtgctccaccaattaaattggtggggtctgagaaaattactcaccactaatactagttacacatgtaggtaccaattcgtttttgcggcctatttggatccatggtgctaaagtttagctctatacttttagttaaactttagcacttgaagatccaaacaggagtgctaaatgtactaaaagtgaagtgttaaactttagcactaattagcaatttagacctttcaagtgctgctacatgagttaagagtggttcggaataaggaaaatacatcatctaccctcctcacctctctctctctcaccccacatttattagtggtatggatgtctttctatatccatattctaaaacttagtacttgcatctaaacactactcatgtgcaaaacttatgctctatatttgagaggtctaaactttagcatcctactaaaatttagtacataggatccaagaaaggaggcccacgatttctatatccacctttattcttcttacgccatatttgcttcctctcgtgtgaacactgccccccttagcctttgcccacgctgatcggctaggggcggatctaggaccgctataggcccggtcgagtagctcaatatcacttagtaccctacatgaattttagcacgatcacagaaaggaggcccacgattataagatgcatgtatattacaataggctgcagaccaatcaggtcatcacctatacatatgatatgtagcaacttacacacatttgtaaatcatacatcctctctatggcaacttcgttcattcgcaatattgcgaccatcttcaacattttcaatccataattcaaccctatttgatatgtttttggatccgccactatgattgatcatgctccagccacgccaaccgcgacgatctctcccgcccaccctgtgcctacaactatcgatcgctccatgactggctgtcgaccgcgcctggccgagctatgaccaacccactagccttgaccagacatacctggcgtgccgccgcctgtgccgccgcctcccctgactacgcacgagcacccacatctaccccgttggcgtctcccaccctatccatgcatgcacactactctgatcatgcatggccttgcacgcctagctatgaacctcggtcgcgtcatggccacacctgctctagggctaagaaagtaaattgtacaaatattatccatctgtatttgaatttgatccatctaagaggctaaggtctgatctgtatccaagtccgggtatcgagtatatgatca

SEQ ID NO: 17 - DNA, 1075 bp, Zea mays
  misc_feature (1)..(1075): optimal_loci_125184_G1, chr3:201670074..201671148, Cluster 1
atccccacgattcaccatttggagtgagttcacgctagcattcttgtcgaatacaaattctattgtcctcctgttcccgaaaccacgtcactacctatctctatgttcatacgaggtcacgagcctcgccgaagtcgcaaactcgcaacctcacctactccgttccatgggccatagcggccatccccgcctgagcccgcggccatcccttctatggtcatatgcgtcctacgtacctcaagtgaccgtggctatagatcgccagcgtttgccctacctcactccacatgccgcgtcgaggatcactgcccctctcatgtcgtcgtggcctgattggcgcctaggataggatcggtgcccaccgtacctctcttcaagccacacctatgggatttggaagggagcaacgggaggggagatggaacggtgcagacagagagcgacgccacgtgtgcctcgtgagattattcagcgagcagtgaaccgtttctccaacagtatctggactccaaattctgtttgagagtggagcacacgacgcaattttggtcaagtttctgtacgctgcttgcctgcctgcctgcctataccggactataaaaattattgctcatagagaattcgatagaatagtaaaaagtaccccgttagcttcccggaagcgaggttcacctgcggctgcctcacggcgttcgaattgggttggtagagacgaagatagccaagcgggcaaggactggctacactgacgagtctacgtcgtgctccagttcttctctcgtgctgactgagagtctgagactgaccgcggaggttccacgtgccggccagtacctatcggcattttttttcacgcgaagattatgcacagcacagcgacagtacaaaagaagttgtacgattcgccacggcccacgaaaccagcagcagaaaaacgaggcaaaccacatcgacgatctagctacttgcgccggaattgtccgtcctcttggattgcacgtcagctgctacgtccaggagctcgaagacgcagtagtccccttcctcgaggcagttgccgcgcgcgaaggcgcac

SEQ ID NO: 18 - DNA, 1112 bp, Zea mays
  misc_feature (1)..(1112): optimal_loci_125236_G1, chr3:201996852..201997963, Cluster 1
tgaaaagggattgcaccgcaagatcgagcttgagcctgtcttttcttgccagagccagactactagtagtgaataccaccaatctgcgtaaagttgctctgctttttttttcttcctagtacacagtaggaggagaataaacagccgttggacagtttcctttctgcctgctgcgtgcccttttgacggcatgcatggccttctgctttgctgatacgactatcagccagccagtcaagcctctaaaggcaaccaaccactatagtaccattttttcaacattgcatgggaaattaagcgttcaggttagtcacaggttaggtgcgacaatacactaactaacagcggactctagaaattccgacatgtaggcatattcatcagtgactaattaagcaccggggtaaacaaaatggacttctagaaactcgccgacgaaccagcaccgacaactcagtatgtatcgcccactgtgacggggagggtcgtccgtaagggtctgttcgtttggcatgtaatgaagggataaaataaatatggtttagatttcttcaataattaatataaattttggagatttggaattaatcctactctgttccagcagaaacgaaccgacactaaaccagcatccggtccgggctctacgatccccagtggcgttcagaattttaacaccgtgtattctctactacacggttcggatgcgagatagagggcagcgaatcatggattccggcatgtgattagattacccagaaggtggcggattccacttgctcttctctcccgcatcaagtactccatacctttactagctgagactcccacccaagcttcgcttcacccgacccgagggaggcatcattcggccgccgggggtggcgaataatgagccgcactccactatgtacgcaaatggatgatggatgcagatgccggattttcaactctctttatgcgatggtttaatttgggagagcgatgatgagtcaggcctgaggaaagtgctgcggctgttactagtagttgaaaatggcctgttcttcgttgaacaacaagggcaaccatggatcgatcgatgcccatgcatgttttcagatccccaatta

SEQ ID NO: 19 - DNA, 1179 bp, Zea mays
  misc_feature (1)..(1179): optimal_loci_125749_G1, chr3:204456962..204458140, Cluster 1
cttaagtatatagttaagtgtagtacttagttatttaatttgtctaaacagtgtttgtttggttgatccaattgtccaatgctagcggacagttcagcctataatatcttacttacgtaacataagccaaaagcagctgttggtctgctcacgtaaaccagtttcaagtcaatactcggaacagaaaacataattctcctcaaggtgctctgctaccatgttgccaaaggactagagagggtttttttttctagcggaagcagatgatgacgattgaggagagggccttcattcagctcgatctggttccggccttccgtcgtcccagcctcaaccccaagacgcgagagccgtggtagagtatgcaatgacgcaggccctccctcctcgacgctgacggaggcgccggccacttgcagaaactaaacgagaaaaaatggcgcagccggtcgatgccgagagagagcacgggtggttggacctacatctctgttagttactacaaatgcgatttgctcacgtcgactttattcagggagaggatatttattaaccaactctcactgaatttcttttctttcccttctgcttacacctctttttttttatacatatatcaaagaaaactacagcacgtctgcaggtatagacacgacgacagtgccgcgcgcatttgctcgctcgtcagacttgtcgttagagctgctggcgtgctcagagcttcgagcagtccatgcatgtgaggaggccgggcactgctcacagctggctggtgtgttctattatatatttaatcataaggacctgattgcacgttattgatgattaaatgtatggcaaagtgttttgcagcaaatgcatggatctatctacctacggaaatgaaaacaagataagcaccacgggatacgatgaaaggtctaatcacggaattgaaatactggtgtatgcgtatcattaatttgatggtttcaagcacatactattattattgtattctttcttttgcatacgatcgagtgtggcgacataattaaagtggttctacctgcagaacactttgtctctcttcaacgacgacgtccaatcagaactatacaagttcccacaaaaaagaacaggtatttgatatatccaaatccctgcagaacagataaaagcgtatgacgagatgcatgg

SEQ ID NO: 20 - DNA, 1023 bp, Zea mays
  misc_feature (1)..(1023): optimal_loci_126748_G1, chr3:209112097..209113119, Cluster 1
aaacttgcagctctaaatttggataaaccattacagagatccatgcatttcacggactattctcctgtctaccacactaaaacctgactaaatgaccatgatgtgaccaaaaacaagaaccttgaataactaaataacaaaaaaaaatcctatctacttttcacttcagttacccaaattgacaactctagcggcaggtaagccaatcacttcaattgtgcttcctaaaaccctatagaaactggaagtccaatagtccaaatcctcaagggaaaccggctcattatgcaaatatgtcgaaccggttttataataataaagattgggcaggagcagcgagcacagccggccataatgagccggtttccccttgtcccttgtccagcgcccgcgcgtgtcccctgtctcctctcgggcctcggccgcctgcctctgcccagtgcccagtgcgcactggctccaccagtccgtccaggtccagcaccactggcccaagcgcaccaaacaaacacacgaaaagggcggtaaagcccagaagacctgaagccattgcttgtctgttcctcgtcgtgggggcagctgctgccgcctgcgactgcaaagccgtgaactggctcaggcgcccagcctcgcccgtacgtgcgtgctgcgtgcgtgcgtgcgagcgagtacgacgaaaaggcgcccccacaccccatgcatgcactgatgccttctggtcgctgcatgagcagtgaccagtgagcactggcgctgtagctcttgttcgatgcacgcacatcctgcgccacgccgtgcaagcgtgctacggggtcggtgtgctcaactgcaactgcaagcgcgactgcgcgagccactcaactgcaagtcaactcgtcgtgtccatctgctgccacgggccaagtggtttgtttggtcacaagtagtagcagtatagcggcagccggcagggcagcagcgctggtctggtctccaaactgcgtttgcctgctcctctgctttcagcatgtccctctctgcctt

SEQ ID NO: 21 - DNA, 1038 bp, Zea mays
  misc_feature (1)..(1038): optimal_loci_127828_G1, chr3:214485797..214486834, Cluster 1
gtcttgctctgaatccgatttgtcaggaccgccactggttataaatctcagagtgcgggcagcgaaatggtttccgttgccgaaagagcacagaacgaaagcgatagactgcaatggactcgacaaagtggtttcatcccccctccccctcttttcccgtccaatcgttgtgtattattctgaattatgaacatagtgacaggaatgcatcattacagaacattatcttaacagagcagcgtagagaataaactccgatgacagaagccagcatgcgcggcgatggaaactgattcgcggctcgattaatcaatgggggtaatgaagctgcgttgttttgtgttgtggtgaaagacagaaagaggcccaatcagatttggaacgtgcatgatgatgtcagaaaaaggcccaccgcgccaaattgattggaggggcgagctctcgcaaaaggttgcgttgtaattttcaggtccagttcagttcagtccacgcatgttgctccgagcactgtgcactaatattcacaaaagcggtttgccggtggccgaacttgcacagccggcctagtaatatattacagtacttacagattagtggattagggtgtggacatgcatcagatccatcgctgaagtgtaatgcaaagcgttcagctcaaagcgcatgtgggatcttgctgcacgattggccgctttaggtcttgtctcagcgtgaaaaatcagaagctaaaataaacagctaccttttttttggtttagctcttagaaagcgaggagctcagcaaagtttagcttatgtgaaaaaccggaaacactgattttatgagctctctataatttttcgagtttagtaaactaataacatcattggcttctcagaagaagaaaaaaaaacctacaataccttttcgaaaaagctccaaaagctacgactcaaacaaacactgaccttagttttgtttaagcctagcccggatggaccattatatttatttagcctttttttttaaatgctgtcaaggtgcgttgtgccaagagg

SEQ ID NO: 22 - DNA, 1304 bp, Zea mays
  misc_feature (1)..(1304): optimal_loci_129846_G1, chr3:224662918..224664221, Cluster 1
taggggtcgttcggttactggggaatggagtcctggaacaattcatatccaaattgtttctctaattaatgtaagttttgattatctgaaataatttctggtgtatttctgtgcaaacgaacatggccttaaagttaagcgaaaaattacttttgtaatagttaaagaagacaaaataaacctttgttttttttttttttttgttttcacgacgacagatggcatcagtttgaagcggactaggcccggatcgcagatcgccttctgtccgaactccagacagcccagcccatgggtgctctcgggctcctttcccgcttggactccggaccggtggtcagcattttacactccaccaccatgactacctgagccatggccgatggaactatgggagatggaccttcttctgttcttcttccttcggctgttcccgggcccggcttcccgctacggtcccggccagataccctgtgtttttattcgctcatcaagctagtgtacagtgtggtgtacatggccttggcaatttggcattcgaccacggtttgcgcggtccatgcggggcggagagggtgacaggggaaaggggtccctgcaggacgaagcgacagcactcgtacacaaaactataggtacgcgcatccgtccgcacacaacagctggaagaacatcatgagtgatggtcactctcgacgcgcacggaccacagtagcctcggcgcggataccacggcaactcgcgctctggtggccgggcgtgaccgcagacgacgccggtgcggctcctatcctctcccgtcggcgcactcgctccgatcatatctccaggccatccggaaacgtgtccgtcgatagaagaagtcgaccacggcaggctggcagatggctgggcccccgcgggttcatgcacatgcatatggcgggcggaagagctcgcggctgcgccacgacggcgacggcgacggcacagatcgatcgatgccgtgtcgtgtcgcggcgcgcgcgctcgtgtcggtcgctgcgcgtcgccctcaccgctagcgcaagcgcgggcaggggctcacatggccgtgtcgctcccgggcccgggcccgatcggccccgtctgccagcggaaccgacgtctgcaatgagaggaggccagcagcccagcaccgggacagctgcatgctccatctccatcctcgcggggcccggaaccgccggagtgctgccccacaactgcaggcacagagagacagagagttgatggattggccatcgtatcactcatccgtcttcatcgtgaaatgctcgtacgtc

SEQ ID NO: 23 - DNA, 1109 bp, Zea mays
  misc_feature (1)..(1109): optimal_loci_130014_G1, chr3:225459603..225460711, Cluster 1
cattctctaattaaccctcgtcatatgtagatatgatcactgcatgatttacgtgtatgtgtgtgtcgcgatcgatcatatagcgcggaagcatatcgtagcacggcgtacgtatacagaagaggctttatcgccatcacagcggtgcttagcgcaagatcgacgggcacgcacgaggccggccggcaagtgcgcgcgcacgcgtcgacgtccccgatgacccgtcaggtcctcggatccgaccagtcggccggtcacttctcggtggccggagattggtctactcgtcctgcccggccgagagacgagcgcggcaattaaaggcgagtacacgttatcatcggagcactcgatggatccgatccggccgccccgccagcatgtcgatcgtgcgtgcaacgtgcatgcgcgtgcggcggcgtgccgctagcacctagcgctggccgtcgtccgcggtccgcgctgctcgttcggcgagcggcgacaaggcaccttcggcgccacgtacggcacaccgcacaccggacgccgcgcgcggaaacagcagccactgatcgatcgacgccccacgcggggcgtacgcccgtacgtacgtacgtgtgtgcgcgtcactcgcgcacgcctcggtcgtatgtctagagcacgcacggcacacggccgggccgggggcaatgatgcgcgcgcggcgtgctcactcgctgacgacgcccagcgtgggccgccgcgcgcgcggcttgttgacgggggacggacgagacgatgcacatgcgtgtgtacgcgcacgtacccacgcccgaccgcctgtgccagcgccaaactgccagtgcatcgagatcgttcacgcaggcacggtctcgccttcctttgcgcctcttcatttgttgttcacatcgtaacaaaaatccaaataattagtgtatgttactgtttaccgtacctctcagtttgcattattatttttctacgtagtcatgccatgtcctagaccacacacggcatatataccaaaaggttcggccaagttaaaacccattgatcaattttgcaagctctctcggtgttatatccagtgcattgccaggacacagtaaaaatgttggtgctatgtt

SEQ ID NO: 24 - DNA, 1009 bp, Zea mays
  misc_feature (1)..(1009): optimal_loci_130404_G1, chr3:227272697..227273705, Cluster 1
aatgtcatgtatagttttgattctagattgatttattgtcttcaactgttaccgttgaattgatttatttagatcattgttagaacatctatttagtggtatgcagagtttggaatactaatcttttatggttcttgattgatcgatcttgaagctatatcttaattaattttcaaagttggcaaagtttgtaatactaatatttagtggattgcaaaggcatactttcttaagaaagtcttggccattattcaccagcatcggaatggaccaaacgttatatgagacagggctgtattcgaatcgaaacaagtagttcgagctagtggctaagtagcagatgatcaggctggtaagctaaggtcctcgtccactgaggttattggaaaaaaaaatcccatgattgctgaagaaatcttcaccattatagattcatactgagaaaagaaacaagttatgagcttatatatggctcaagaggctgaaccatttggtctatattctgtacaactgatgaaatgatgacgatgaggttttcgagaagcgccatgggaaagaagcaggcagttttgatccttttgtattcgggtgattctgattggaacaaaaggattcacattacatggtaaagttaatgacgccggtctgaagacctggaggatgacagacaatggctcatgacgtggaagctgatgatctgtgaaactgcatcctagcctctccccattcgttcccgttccagattcagacactgctagcagcactttccctccctcgcaatctcaaatcctgctggtgcaggctagcgcagggcggtggtgccgcactacggcagcgcagcgctataggcggtgcaggtctacagcgcatatgaccaggacattaggtggttgcgtggtgctactgctgcagtatctacatcactaaaaggacagacaccacaaattttagttgatggctcaatattgactgctctcatgttatagtgacttcaaccaatgcttagttt

SEQ ID NO: 25 - DNA, 1174 bp, Zea mays
  misc_feature (1)..(1174): optimal_loci_132677_G1, chr4:5950705..5951878, Cluster 1
taatctcttttagtcccctcttatcgttgtgcaactctttctattcaattttaactggtaggtcgtgtttggttgtggtggattgaaggggttgagggaattaaatccttcctattaaaaattgagatttaatctcctctaatctatctcaatttaccccctgacccaacaagctctaaaagatttaatactctctctctctggcctcttcaacattctgctaatcgaacaagcagcctaataagcccataatgggttctcgatggatgaagcaaaatatatcaaagaaaaaggcgttacggaataatataggaggagcgatggaaaagcacacttaacgtgatgaatggttcacaaaatataatgtaaatagcagtgttaatgattcacactcaatacgggtggtaataagtttgaataggtcgatatcaatttctagtgtgatgcctgattatggttggactaacacaaaaatgatttaacgttatcagttatccttcacattacaaatatatgaaacaacatctttagtgttgtttcgttcacaaattgtaacgtagatagcaacgataacgattcacactcgagtgacagcggtaataagtttgaataggccgtattcattttcagtgtggtatctgactacggtttaatttaaacaaacatgatttaacgttatttattatccatcacgttacaattatatgaaccaaacaccaccttaatggcttctagatgcatgtgatgtggcatgcaagtggtgggatcaaatggaatctatctatagctggattgaactagtttttataaattggttgggcgtactttggtagccaccggccgggctagcgttcatctattagttcatctattaatacgatggatacaaggatggcgtgagcagttgagcacacagactttgaggatcgaggaacaggaacagccacgatgagtagtacttggcagtgcatgtcgtcgactgcttcactccatcaggtaacagaagcaaattttctccggctggtgacagaggcaaggcgtctacgacccttcatcaggttcaggtgtccaggtgcgtgacgtacgatcctctagtgttgtatgtatgtttcttcgtctacgcaatagttttcgccggtcacaataggaatacagagcacttccaacagccaga

SEQ ID NO: 26 - DNA, 1165 bp, Zea mays
  misc_feature (1)..(1165): optimal_loci_134830_G1, chr4:15960819..15961983, Cluster 1
ccagaccacgacgtcatctacgcccccctctgcatcacgccacgccgtcatttcgatcccccgccagggcagcaggcaagcaggtgcccttttcttccattgcccatgcaaagtcacttgcagttttaccttttctcattcaagttccgatcttgcgatcttcatttgcttaatgactttactgccacctgttgatgacatcaagcgtagtgttggttaaccattgaatgcttctgttttctacagaaaaattcctggcctagaatttcatttcgtataaacaaaataactgaaacgaaaagaagtggttgacttaggttccgttttttttatatatttctatgcttaataaatcggctccaatttacctccccagctcaaggcctcaagtgtcaggtatgaatgtatgatacattgaggtgctgattggtttgacaatttagggaagtaatcagtttacattgatatctgttaccataactttaagtttggttgtaataggctgcaatcgatcacggcggtatcatgcttgttaaaattcattaacgctcccttagcttccggtcgtgatccaatgccccgctatttcagtgctcacgtgggcattgtaacagataccaggagcatatattcccattaatgttgcctcttttatggctgaaacaaacagcacctgagattcacgttttcatcacattatttggtactattggatcgtttgttagactgcatgatgttgttggttatcagtatgatactatgattgttcccatacctgtgtccatgatatatcaaagggtgaccatggcttgcctttttctgtacgcagggccgggccagcataaatcagggccctgtaccgattttttttctttgttaagaatcgatgatataggttaatctcctctattaacatacattaacatgtgaaggagtgtaagtttttccaaatagactcaaacatgttttccttcctttgcgtcattactttaaactatgtgtgttagtacttgatttcaattctcctaaaagtatcgaagatcaaggcaagacaagttagatataaagaccttcgtcctctcatataacacttctttggagtcctctcatataacacttctttggagtgttagaataaaggatgaagttttttagagagaaacac

SEQ ID NO: 27 - DNA, 1224 bp, Zea mays
  misc_feature (1)..(1224): optimal_loci_135280_G1, chr4:18005289..18006512, Cluster 1
tacatatcaacgatgattaattagttcggtggccgctttataatgattaatgaacgagtgaatgaatgaggagtccgtgggtacgagcagcgtgtcaacagcaacctctctgtccgcggtcacttcactttcagatcagcaagcaggtgtgtggaaccagtactccccccacctttctgcatgctttcgtcggattcgtcatttattattaacagaaataataaagctattggttactagtagctacggagtaccgtacgtgcttgcagattcaatttgattcagccgtacagaaaaaaaaaacctttatgcagcatgaacaacaactgcatcaagcaaggatggtaccggtcgatcgatcgatcagccatccaatccaataaaaaggaacatgtcgctaacttgacggatctgtgcgtatggccagatatgtcgcaacaaaaaaactagcaggagaattgccgctcagcgatttctgcagcaaccaggaaggctggcttacagcttgttccgccctgcagccgctgtaggtgttcaaattgttgcagctgcgatccataaagataaaatattttagaagttttactgtcttagccatattcagattaaaaccgcagcaaatcacagcgaacaaagcctccaagatccggcagcgaatggtgtcaaaagttcgtgcgatcacttccaaagccctttaaagctactttgagaacctcagatcctcttcgagattgaaggagattaaaatgtaaatgaactaattttctctttaattctctttaattccgaagaggatttgagttttaaaactagcctattacgcaaccacttccttgtccttgctcgcattcgaacgcaccaggaccagaagcgatcttgttgctgcgcaagcactagcagcgccccaaggccaatggaacgcgagctagctagaagtgcttcgctttgtttggcgcatatgcatgcatgccttcgaaatcccagcggcctggactggaggcaccaacaaacaaacagtgcacgatacgctaagcttgagcagacgacgtacgtcggaggtatccaagagggcaaagaatatccttcacccaagtccaagaagcggatatatgtatgacccacgcattgccgtcgaacctccgactccgaggccaaagacgaatgatgcaatgctctgcatacagccaccatgagtccagtgttcaaccagaacagggcgggcct

SEQ ID NO: 28 - DNA, 1173 bp, Zea mays
  misc_feature (1)..(1173): optimal_loci_136318_G1, chr4:23657350..23658522, Cluster 1
tatacttgttaaaactgatcgatctaatggtgcatcattgtcaaactaccacctaccgtccttgtggacgttcgtgctgcctcctcgtggtcgtccacacggcatccgcttcgcgctcggcgttctttgtctacgtcgtgttcctctctgcctgggcaagcctgtgcctgccgctacggtacctggactgtggtgactaccgccaccaacggcattggctacgccgttgccttttgcctcgccgcgtccaggctcgggtttgtcctcgtcaactgcaaccaggagaagctggccatcatcaccactgacgcggtcgaagctagccgtcgtcgtagccatcagagtagggcacgtactacaccctcacggtgtcatggtggccctctgtgtctgcctcagcgcccgggaacttgcggagcacgaacacggccatggagaaggtggccaacgccctccccgccataagtcaacatactggtgtgagtgtcaggacacccatccacacttgtagtagcgcattgccatataccagcagtgctagcaattgtataaagagaaaaatacaaagtagctggtttttgatttttctaaatatatagctacacagaaacttttgcaacattaagctgtcatatttactggcgtgagtgtcagcacaccacccatccacacatgcagtagcacattgccatataccagtcgtgctagcaatcatataaagagaacaaacgaagtagagggtttaatttttctaaatatatagctacatagaaacatcaaacttgcaacattagatcgtcatatttcatgattgtagatcctattcgataaacacttgagcagatttgcaagatctaaagagacaaatggcatggctagctaatcatatgttttgtgcaccaactttttttagaagaacgaagctccatattgaagggcacagatcctttcagtgtaacctaatcatcctcagatacaacctttgtatgatctttttacattactctttgctttacacatcaacctatttaactccctggcacttaatcaactagagcgaaaattataatgtttgggatcaatggcccttcgccttgcatttgtcctccgccactccaccgtggctgctagagaattggagcagctagaggcgctccttgctggtgtatcctt

SEQ ID NO: 29 - DNA, 1219 bp, Zea mays
  misc_feature (1)..(1219): optimal_loci_136871_G1, chr4:26512455..26513673, Cluster 1
taacgaaaagtttttgtggcgtgtcggacacacctacacggccgtagatggtagaaacaagcagtaaaacagcagcattgtccaaaagaaagccgctgaggtcaatgctgatgagaacgagaacccaatccgagcacacaaggagggtcaccgattaggttagcaccccaaaagcgagcggaaggcaagtgaggcaatcaatctatcggccacaataagaactgattggggggatctcgtccgaggaagggcgacttttttgggtgggtgggtgtggggggtttgattcaatttctcaaccccaatcgaggatgagggaggggagagttgaaaatcgggccggagcttaccggatttcctccgcgcgacattaattccgcggcccgaccaggtagcaatgaggcgggcaggaatcgaaagctgcggcacgggtgggaggaggaagggcaggcggcgggcgtgctcagcagcggtgatggtcccccctcgggagtttggagatgatgccgtattgccgtggcccgtggtggtgcgctatgcttttgagacacgaggggaggggggcgtgggagtctggttctggtagaggagagctgcggtagcagagtcagaccgggaggaagcgtggaccaaagatggtggaggcccacagtcactaaaaaaatgtggcccaggctacacagcgggtgagaataactccgaggatcgagcgtataacggtactacgtcgagccacatgtcagctcagggattctttcccgttttctgcgcttctctatttttttttctctctaactaggacatcatgcgtccttacgactatcaggacaacacatttcagttaataaaagtactatgttcacgcgtttcaaacgaagagtaggaaacatagtttacctgataagatgtttcagtttaagatcatttagtgtagttagtgtagtgaaaagaatataaatatggtatacatctatttatatatgagaaaatataacatagtttaagaagtcagggagaagacaccgtatttttgtaaaagttgagtggtatatatacaattaatctatatctttactaaatcataagtttaaattaaccactcaacaaataatctatactgttctttgtgcaccccatttatatacataaaaaaaattccctctatcacattgaacagtccagatatttttcccattttttctctcattcactcacatct

SEQ ID NO: 30 - DNA, 1195 bp, Zea mays
  misc_feature (1)..(1195): optimal_loci_137250_G1, chr4:28811786..28812980, Cluster 1
gtttctagtgttttatagtagtagagagatagaaatagtagagatatagattgtacattagtcatcgtcgttagaaaaagaatttcttaggccatatcaagcagatctcttatcacatctcttatttcaaactttactctgcaaataacgttaaacagtgtcacgtctcttattttacacgatctaccgaagacggcattaaccatgtaaattggggccagcaggcctaactcaatattgaaaccctgtttatcttccacctctcagctcgtccaacccatccaaaatgtgacggccaatgtggccgttttcacttttattcaccaacgttgcactctttcacatatgggaccgagacccgcacttgccttaacgccgctcgtaatctgctggacgagagctagagttccttatttgcccctctggcttgagctttctgtctttgccggcgatcgctcctcctgctcctcttctctgccatgtcgtggtcgccgacagccacccagcgccacggatctgctgggctagatcaaggaacgctcctcgccgaggggcgacgcaaatgcagaggctagcgcactgcttcgccagggggctggaggcgcggctcgcgggcacgggcacggggcccagctcatggcgcgctctgccgtggagcgcctcagattctccaacctgggcatctgcaaggccatcgccggcgggaggaagaaggactacggcgaccattaccatagaggaaatgactgaaacggctgggattgacacgagggaagagtcacttgagtacaaaattgcattgtttttggcattagaaaatactatgatggatcaacatgggcatttgggattgttgattccaggctacgtcaattaaatctttgtgaagtattgctggcagaatatctctgtgtgcatggctatctttcttgctaatctgaatcctaaaatctcgttttatattcctactacatattctgtcttattgtttaatgctttgcagtttgaaacacaagaataaatgagtaaaggacttaatgaaacactcatttttggaagttagacgcagaaggtcatcttccgtttggattatgcaaaacaaatgccaatcaattccattaacaggtaatgttagaacagtttgtgcaataatttaagcaacatttgtatagggtcctacacttcttggtagaca

SEQ ID NO: 31 - DNA, 1196 bp, Zea mays
  misc_feature (1)..(1196): optimal_loci_158515_G1, chr4:165841455..165842650, Cluster 1
aggaggtcggtagaaaacgaagcagccatgaccagcaagcagttggtgtctttgggtaacagaccgaattaagtatggaagaaagcttagaacgtgttaaccacttgtgcaatatatatacacgaacacgagacagagagaggcagctctctttccctttcgtcttttcagacacgcacgcacgcacacgaaaactgaacaagagtagtggcagctttgcacattggttaatgtttacaaggttgttgatgcatcccccatccctctcaagtctcacactctcccatcccatcaggccggcttgccctggaacggacggccgctgcctgatgacgaggatgagaatttttagaccggggacctcgctcgccgtccggccgtccgggcatctatcggggcggctgcgatcaaccctgtcacgcaccgagagcagacaagttgtcatttctgaagaaggcaaaggcatgcattgcgttcaagtttaacaggtgaggctgagcgcgagcacctgccctcggcagatcagatcagaacaggtcgctcgtcgtctcggtcctcccggtgtgcctgccaggggcaggccggtaaatttagaggcccttactaaactttaaaagaggccctactttacagaaaacatataatcgaaattatattgtaaaagaattcatgtattctgaattacaaaaggtttattagataataactatttatattaaatctatccgtttttacgaaattatattgtaatagagcatataaataaacatacatattaatagatgtgtttgaagagcaaccgtctagctgctaactgagttcaacttacatgatataatgttagtctgtttattgatacataatattgagataagaagttttttagaccctcagaattttaggtcctgtacggtcgcacttgtcgcacgtgcatgggccccggccctggtgcctgcctgccatcgtgttggctgcttcggcaccaaccgctccgagggccttcgcttttcgcggtcgtcgggcaaccaccgtcttggcgtcttgccagccgcgcgcgctcgaaaatagctgtcgtgccgttcgatagctcgctcctccgaaattttgggtggtggtggaggcagggacacactgccacactgcctggtgcctgccagtctgctacgttgtccagcaggagcagagcagacacggtg

SEQ ID NO: 32 - DNA, 1134 bp, Zea mays
  misc_feature (1)..(1134): optimal_loci_158740_G1, chr4:167021604..167022737, Cluster 1
ttcgagaaacacaaggataatgaagttgttcaagtaaaatttatgtaaccaagagtttaataggtatactttttataaaatccatttctatgttgtattataatatttatgttattatactgttagtttttagtgattttgtaaaaaatggcctctattcgataattttgtacagggcctcgctttttcccggcacggtcctgtatcgtcgtaagagagagagagagggcgtgcgtgcagtaactacgacaccgtacccacaacagaccacgagggccagtgtcgccgtccatggatcgatccgatccttgtcgagcttgctggttttacagccacgtacggcttcctgcattgctctgttctgccatcagggacggagccgtgtcgctctggtttacagccacatgtgtggctgcgggggctccgatccgccgcttatcggcgaccatatatatctacagcctcgatggttgttatctacagctacagctgggattttccacgcagctacgtagtacagctgtgtttgtgtttatgttggcaaatgaggtagcggcgattgtgtcaaaacagtctcgccgaaggccatgcatgcgccgatcgatccatagcagggccaacccagcctcatacataaaatctgagattcgtcagtgcacgaggctcaccagttaggctctggaacacacctgctactactccctgctgcacgccagtgaatatcagtgatgagacattcagagatgcacacctagaaatgcgtctctctctctctctctctctctgtttccagattggtgtgaaacagaacggtcaagatctgcacagtttgcgtctcaatatactcaaccactccatcagctaggcgcatatgttatgcatgacgttggtgccgtatgtacaaatacaatatatacagccgcagctcaatgtgcttactataagctaaggaatatatacacatacaatcaggccgtcgtcaccttccaagtaactcacatgggggtcgctaaactgctaattaattattggatccgagacgactgtgtgatatctgattatcagggactcctagacgatcggctgcagctcatgcatggtactcgactactactcgcaaagacatacaatatg

SEQ ID NO: 33 - DNA, 1019 bp, Zea mays
  misc_feature (1)..(1019): optimal_loci_159805_G1, chr4:173838421..173839439, Cluster 1
gtatgggcatgattactttacctaacaatacatgataaaaaacaattcagctgatttatggtcggaaaaaaaccaaggattacagagttcacgcaccttaagtggggaaatcaaccagaactgtgtgctccaatatgttatctgtaacatagacattatcaccactttttgagaccgacagaacacccgaacatgcatgaaaatatgaacaagaatgacagaacaagaaacttacaacttcatcactgaacaagaaactggggattattttcatggcaacttcagtttcttgttcatatattttcatggcaatatgtatatttaaaaaagacgtggttgattgtgtgttgtttataagtttattatatgtttactacataccatttatatgtttaattgtgaatctgtagaagcagaagctagtgtgagaacagccacactaccagcaccaccagtcttacaaactcagaattaaacaagtccgatctgcagtagatcattgacctttgtttcccacagaaaccacacagaggaaccatgatcctagacagtattagagaaattccactcgttgttcagtgctagtaccaaatccaccttctggtaccccgttcagcagctcgatccagtggatttcgtaccaacatatgtaccccattcagcagcttgatctatctaatcctagaagacgagtcaaaacttgcagcaaacataaatagacgagtcactggctgatattgcttggtgagaggcttggagtactcttaggggagataggcgttcgcttcatactgctacagggtgtgctgaactttgattctatccatcttaatcaaaaaggggaaaaaggtgatgtctactctttctctacagatacaataaggggcagaaaagcatggcagctgaataaatattcagacttgcattagcaaccatcaatagcttttctctagaggaagcagtgctgaacgtattatactgcagctaagtacatcgacgcctacgtgtgaaaataaggg

SEQ ID NO: 34 - DNA, 1183 bp, Zea mays
  misc_feature (1)..(1183): optimal_loci_160713_G1, chr4:179618574..179619756, Cluster 1
atctttaactctgatttttgcactagatgttgtatgatctaaagtcatagaggatccgttgctttctggtgtacgtgatcatgtagatttgcaacaggcatggtgacacagaagatcctacccttgtcatacgcacagataatgaaggtgggctgcgttctgtgcacgtgagagggtgagagtagagaactcccttattagtcccggcaaggcaaatggccttggctctcttgcccagcactgtatagcttcgcttggcaagaccagctatttggtggcaaaagaaaagcttgctttgcctggcaaacttgcttggctcggcaaggattttttttgcctggtgaggcgagccagattggctctccagtacagtcaagcttgctggctgcatccatctcaccatctgccaggctgaacccctctggtgatgctgctgcaggagcaagcaaatcgaacaccggggaaaaaacatcgctcttcctttgctaagctagttttatcctatctgtgccagctaggtaaaccagtaaaaagagccctctgaaatcccccggctaatcaaatgactggagtgatccgggctgtgctcaccgtttgactggagaaggtactcaccgtttgactgccgctaggcagcgtgaggagagacgcgtgacggcgtcaaccctgttcggcacttcggctgcggctgcagcctgcagccgcctttctccatttacagactgcagccggccgtgcttgctgcggctctgcagcagagccgcaggctcagccagaaccgtttgtactccgtttgcggcgccgttaagcgttaatactatttgcttttgcgggaccgcgctgccggttggacgaatgaggacctttcgtacgtgtactggttatgccgattttccaacagggaggggggggtgtttgctttcgcgactaaaatttaattcgtatcacaacaattgtttaaatatcaattataaatatttaatgtagatttaattaggtttattaaatttgtattgtcttctagtctttatctatataattagttttataattaaactatatttatatacccataattatcatgtaaatatttgatgtgatagatactaaacctcttaatgtaggctaaccatgtcgtgttatatgatgctgcaaaatactattttacacatcagattatatt

SEQ ID NO: 35 - DNA, 1177 bp, Zea mays
  misc_feature (1)..(1177): optimal_loci_161570_G1, chr4:185431751..185432927, Cluster 1
gttggagatagtctcacgcgaaacataatgatagcattattcagttttctttttctctgcgctggcaatagctcaaaggacagtcgtgcaatttgtttgttttttaaacttaaagaaaaaaagaaaagaaaaggacaatcgtgcgtgcgtgcgtgcgtgcagggtcctgcggtgatgatggatggcatggcccatcggccatgcatgggtctgagtctgactctgctgtgctgctgcgcgtggggacccgagtacgtacgtacctacgtggcacgtcagtccgctgcactcgtcacatgcacacaccacagaccacgcgcctcgcctccgggtccctgcccccgcttgtgcatagtcactgacaggccggcctcgctgccactgctctgctaccgtcgaaagtaaggcccacagacagaaagaggtactccctgttacctttgacaagtgggcccacggtcacggtccgacctgtcgattgccgacgtccactatcccatgccagaccggatgggtcctaccgggcagtgtctgcggtgggcagggacgacaggagatgctgcttcctcctgtgggggagcagagcagagtagaggttgacaccaagaagcaggcctcatcattttgggcttggtccaggccggcggcccgtattgcaagacacagacctatagttttcgctggagcccatcttacttcaatctaccggccggcctgctcagatcaggttttcagcctagacagaaaataaggcatttcaggtgtccgagcatttctttgttgattcacggatcttgagatgatcctacgtaataagtaaccaccgaaaaatatatatagatcgctagtgcatttacatagatcgcgtctttataagaacatatatatgtcatgtcacaaggtgatcacatgttccacgtataaagtcagattattcccgagatgccaatactggtgattgcacgagtagtctgtttcacttgtcatttcagaggtgggctagaccgctagagtgtctcacatatgtatattgttcattgactgatttgattgagacaactagagaagatcagacattatattatcatgcatggtgacacacctctatctatttatcatcagacattgtcgccttcatgaattgagtgctactaaccgagcggtggaggccatgcgt

SEQ ID NO: 36 - DNA, 1139 bp, Zea mays
  misc_feature (1)..(1139): optimal_loci_162350_G1, chr4:189173600..189174738, Cluster 1
agcgaaaggatggagacggtggtcgagtcccatcttggtagtggatgggcaaagttgtatcgttgtagctctaggtgttaggagtatgtcctaactcaggtatgaccaggccttgagtcaacttgtacttatcccggatcgaccattgagtcacattggtgcacgcgcacaccatagcatatgacatcattatctagatcttctttaatctttcgagggcatgtgggttgcctttgcggtaggagtggagtaatcccatctaacaagagtttggtcatcatgatgttttgtgtcagagtggtatagattgattgtcgttggaactcgaccatatagatctagcagtggacctctcgaccactccagtgtaggtcttcttgtgtccaccaagtcttatttgtccaccaatgataggtgctcttcttgctcgatgtccaccatgaacatgaaccgagaccctgaaaatttggagtatgaatctgagtcatcatagttttccaagacggtgtgatgcctgagactttgtaattgatacctttttcatttaaagacattttggtgctaaaatatttgattcacaagattatatagggtgtgtttgggtgcagggccaaaggtgccatgccaaatattggccttgccaagttattttggctagtatttggttgtaggctaaattttggccatgcccataaaaatttggcaatgccaatacaaatctatgacaatttttggccaaaaccaaggccaacaaatcagctgccaaaatttggcttggccccaacgtattttagccacaaaccaaacaccaaaacttgagccaaaatttggcttagcccagctttggtaagttgccaaattttggtcgggcttctttgatccacaaccaaacagacccgtagagctaatacacggatttcatgttctatatagccacacataagtgtgtagtggtaggaaaggatctcagatagagaaagaacttgaatagttatgcaactttattgtttacgaccttttttttggcgtcatcttaattctaaaatatctgatcacaagattttataaagtttataccaaaagattccatatgctctacggtcactattgactatacaagtggatgcgtagtgatagag

SEQ ID NO: 37 - DNA, 1376 bp, Zea mays
  misc_feature (1)..(1376): optimal_loci_16479_G1, chr1:91482902..91484277, Cluster 1
ataagactattgctgacatatccaaggaaataactagctgattcagcattgttggtcacgccccgaacatcctgtggatcaccaccaccgatgatgccagaatcttgccgttaaacgccgtaccagtcatcgccgcagatttggcagccggtcctgaaaaccgaagaggaacagtcataattccagcaacagtgtaaaacctgtcttgcgacgagtgcgttacggaatcatccatggctttgactgccgtcggaaccagcaacctgaacggaactcacgccgtgaatgctggagtcaaaccatgcatcgcccctctccactctccagtcacttccaatgaccgcagcagtcaagatgcgaatgctgaaggcgttttacagggttcaaatgaagtcgtcaccaagttcaagttgatccatgatgctaaatgcatcttcctccctaacccgcacgatgcgtccatccgccgcgcatgtgccggcgaggggcgtcggatgacgacgcctgcgcggggctggcgtgctgcgctgcatatccgcatgtgaggtgccgggtcaggtcacgtaccccgaaggcaacggcgcagacgggtccaggatgtctaacgaactagtggctcgtaatctggcacgcagaggatgccagtgagctcaatcaacatcagccgagcgtgcttggtcgccctcgcaccagatttccagggccagggcgtcgtggcactcgcacacccaccatcttgcggcaacgggatgccggccgggcgacctgtggagccatggcattgtatgggagatgtttccggttgcgcccgcacggcggcatgggctgctctgcttgcaacgtcagggttgtgggctactgggttgcgttgtgccatgcgcgtacgctcacatccctcgtccagctagcagagcagctcttcatgccgtgtcctacgtgtactgtttgatgattagcgataattgattgattccttataacacttgatctgacgctacttctgctaaaaaaaaggatgcaatttcatgtgcatctgcagcaagttttacaaaccaccgggcgacgagattgacgtggttggacggctggcgtgcgctcgaagttaaactccattctttagaagaaaaaaaagggaaaaacacaacgttgaactcgttctccgtccggtaaaatttcaaatatcgttcgaaaagttgttggaacagtgaataatattctaagcccagattttaaatcgaggcaaatttcatagatattcaaaacatatatgcgcactacgcatagcaatatatagatcaacacagtaaacaaccgaattaacatatttactcacgtcgggtcgggttttgtcagtgcttagtttgatcaagcataaa

SEQ ID NO: 38 - DNA, 1286 bp, Zea mays
  misc_feature (1)..(1286): optimal_loci_165190_G1, chr4:203222850..203224135, Cluster 1
tctagttaaagagagctcagggcttctaatatatatatatatatatataagggaaatttggaaattcagttcttagattaaggagccctgtcataaagacactaaattaagcagcagaagggagccagaaagtaggtgatggaaatctgaaagagattatacacaagatataagtttgaacatcaatacatacacacaaaaataactccactacctcagaaatacaaaaggaatgaacagataagaacaagcacttgatttttaatactaataatcaaatcaccagagcgcatcctaatcagggttgttcctgaaagcaaccgttggtaggaatggtaggacccggttccacccacaaggcatcgaatatcattggccgccccctgcaaatgcacagaaaaatgtgccgatgtcgactgcgcgtctgcgccagcaccggttggtctggtccgcagactttgcgaggtctccctaaacaattcatgatttttttttgagcttacgaaatgggagttgggtgcagaagacttggcccagaaataaaaaaaaagaagctgtgtgttggtgctgtcctatatgcatgtcccaatcccatctccatgtaatggtcttcttcccttcccatccatcgtccgtgagctccgagcgtgagggcgagaggcgtcgctagctggctctcacggccggcaaatctgcgatcaactgcaggtgtgtacttgcctgcaactcatggagattcagcatgcatcgcacagtttgcttgtttattcttctctaaaaattggtcgtcatgggcctggtcaactcgtcctgcagactctgctctagcactctgcaggctctgaaactctgcgtctcatggccaagattagttcaccgtatcgatcactgctgacctttcgaccttgaatgcagacgctagctgtcgtgcaagtaagtaggttgacttgccagaggttcaggttctggctctccagtcgagcctaacctttctgtttacttgattctgtagtgtgtgcgtgtatctccaataaatcctaaacttcgcgtgaacttcgactccgccctgatggaatattaggtactcagcagctatcgcgttctctatctcatttttatttgaaactttataaatctactactttatatatgacctgctacgaacagttttacaatcatcggcggaccaaattcaaccgaggtagtcacatctctcatgagtcatcctccaaccattcctccaactccttatgtatattttctaatctattttactatatctaata

SEQ ID NO: 39 - DNA, 1090 bp, Zea mays
  misc_feature (1)..(1090): optimal_loci_167691_G1, chr4:216656325..216657414, Cluster 1
aggcaatcaacataccattgctaaattcgtacgtccgaatttgtcgtttctttttcgtactgtacacaatatatttcatgatgtacttatgtatatatgcctgataaagcgcccgatagggcgctgtctttttctagttacaatgcatttgtccacgcgttccaagccatccccgattttacacacctaaaccgccccccccccccccccccccaacccaaaaaaaacaggttaggtattcgtacgtcccatggacgagaagtgcatgtgttagcaaaaggaaaaaaaagttggtgcgcgcggtgaactggcgtccgtgtgtcgatcacagtgtcagatcctcctcttgcacggactaaacgtgtgccttggttcgcttgccgtccttgacctgccttctactagcttcctaatgcaagagactacctacatgcctgtaggtggtttaattaaaaactagagccgatatggagagtcaacgcacaaacgtgacgtacgggatattaattactccatcgaagcagaagcagctgctgttgtctgccagctagcatatctcgccggcgccgccagttttcaggtttgtccacgcaggcacgggcgggtgtttggagtggtcggactcggacactcgccgggtcggtgaactccagcgtcgtcatctcgcaggggggacgttgctgccttcgtcgcacgtgttcgggggtgtcgttggtgcacccaccccggcccggaccaactcccgcatgcgcgatccagttagtttacggtggacggaacaataatccgtcgatcggatctcacgcgcacggcactggtttgtattattattggccgcgttaactcccttttcggtggtttttggtggcatcatgtgttagccacaagaacacaacggcaacgagcagacgacggcatcggtggttgagatggagcagcagcagagtgacaacagcgaccaaaggcggggtcgtggttcgaagcgtccaaaggtgtgtttctcaggtcaagaatgggtcttgtaaatgtcttgggctgaaataggagaacgtgtgggctgagcccgtcagagaggataacaggagaaatc

SEQ ID NO: 40 - DNA, 1245 bp, Zea mays
  misc_feature (1)..(1245): optimal_loci_170410_G1, chr4:229946156..229947400, Cluster 1
tgtctgttagttggtgtgtcagttctcaattgatgtttagtgtccatgatcgagctcaatccgggttgatgcccagactgtatctcaacgcttagccatagattagccaaatcttgagtctatctatggactcctacgcatactccacagttcatttcaggatctagttgtacggtaaggatgttaggtccaagacattgagaagatggaaaccattgtacaatgacgagatggaagggaagatggaggcatggagctactcatccatctggtgtagttggaagtgaactcgaccgcttggaatcagctgaattcaatgaagatcacaaatatcgatgtctcagctctcgacttggtctgctagcgcagtgattcggtagattcttcatctagtttgtcttctgtcattactaggcatattggtccttgttttgtgagttgtgacaggcgcacctttacgcttggaagttggaacttaatattgtaaacactttatgataaataaaacatgagaaaccttaacgttgtaaacacttcatatgatcgataaaacaagagaaacttgttttctaaaaatatgactcagcatcgtagatctgcaagatgaattgaatggatcacgagataggttcctttgtctcgccggtgtgagcaacgagatgtttgtgggatagctaagttggctctctcgaaatagcgagaaagaaaaagtttactgatgcaggaaccgatatagttagctaaacatttaagggcccgttcgtttcatctgaaaccagtggccggaataattctcgagtggaatgattcactaatttgtgtaactttaataggccagaacggttcttacctttaatcctgactaaccgaacacagactaaacatgttgctagttttgaattatagctcagtgagtgagatgatatgttactcatcaagagattcaaacatgtccaaaccttttcgagccaaatagagttggggtatctaaaaattgaattcccacgcttcatttgaaactaccgggcatgatcatttaccaacctaaggctagtggcaccagcggtcagtatcgaccgctaggatgacacttctggtggtcgttagtactgactagacagctgcaacagcggacgattgacccgatcagtcggctttggttgtcgtttagttgggacgggtggtgtcgtgggctttagagtgagagtcgttaccaatcgggcgtggtcagtaacgacagatggt

SEQ ID NO: 41 - DNA, 1309 bp, Zea mays
  misc_feature (1)..(1309): optimal_loci_170655_G1, chr4:231499346..231500654, Cluster 1
ttcagtatcttggaatacgtaaaatctcctatctatttgctcgttgctaattattcttgttttctccatattttctattcacgtaggaaagagagtgaatctagctggtgaaatagctcgccacatagtagacgccgtaactgcatacttggatggaaacgagataatcctgaaatgcttctgcaccttttccgtatatagttaggggcggccctgttgaagtcatccatcatgtggatgagagtgagactccgaaattggccggactactgctgacgacgggacgcgctagccaccctgggcggcagcggcaccaccagaaagcccagaacacaacggacacggccgggcgccatcgtggctactgttacccccacgcacctttcacgcacagttccattggtggagacgacggaggagcgagcacgagcagtgtgcatggcattggcatggcaccacggcggccacgaggaagccacgtgcgggagtgggacgcgggatcgttggccgcgcgggcgggcgcaggggggagcagtggagcacatggccggatagatgctgccaccactggctagtggctgctgagcagtgggctggacggacgctgctcgactcgatcggcccctgcttgccccgctgctgccggctgcggcccgacgacggatccatagcggtggggtggggagctgtcgatcgacgacggcgcggcggaaagcaagcggtcgagccgccgtgctacgcgccagtctaatatggggagggacaaggccaacagcgcctttggcccgttgcctgtccctgtccgggctctaggggtggggtttagtgtacgagagacacaacgaaagccggttcctggtggctacgcttttttttttcttttctttattagccgccgcggaacctagtgaaggcatgcatttggactttgttagcacatactttgctaatcctttggaaccatatactaccctacttcttattattaactaagaagaaaacaccatttggtacataggtttgagcttcctcctaatcatcattcaaagataatatatatactcctggaacgcatgttgcattgtatgcagtacgaaataaacaataagtaatatatccgctcagagctaagcgcctgataataagagcatggttgttcttttgtcatcgccacgttttttttttgttttttgtttttgcctcacccccaagtacaaaccgtacgtagtacctcaactcacacaccaccacacgcacacctaccttcatctacaaccagctacacacacacgtagctaagggatactga

SEQ ID NO: 42 - DNA, 1360 bp, Zea mays
  misc_feature (1)..(1360): optimal_loci_171036_G1, chr4:233634455..233635814, Cluster 1
tccagacatgtcactggtacgcactggtatggtgggggtttaaatgctaaaattagcaactacgattggatcacaatctaaaagccattgtctcaaggtaacgacggttacacaagcaaatcttaggtgcaagtatgtgagcctcctggattttaaatcatgatccaatcatccaaccaaagtcgtacgtacttaaacctcccatcataccagggcataccagtgtcatgtctggactaatagcgagctagtgaagggtttaagtgttaaatgtgtaactaaggttggtgagggtttaagtgctatatgtataactatggttggaatacgtgaagggccatgagacacgcacctaataaggcttgcttgctgcgtatatgaacaaaccagaaaagagcatccaaaatatcatccccacgcgagctcaggttactcttgtcccaaatagacgggcaaagaactcccgtaagtagtagtaactgtacgggtaaccgctaaccaagattgaaccagtttctccaggacaggatggcggggtttgttctagtcctttctccgttgataacaatggcggtgtctacctgtattccagtcgtccatggtagtcagagcgttgcatcacagcagctttgaccatcaccaattggcatgataagaaatgcagaaagaggtgcgacgacggttgagaactcgagatacttggagtgccatcgactatataaggcagcataagacccagaagaatagaggaagaacgggcattcatcaccgtgagatgcagctctcagttccaccctgactgactgatgaaaataatcaagctgagactttgataactgtaataacaagagcttaagaagaaataagaatcaccatccagtgacgtaccagtagaggacggctcaaaataaggtcgagttgttatgaaagagggatcctgagcatcaatctccaagtggcgtgttgtgctaatcttttgaagacctgttgattcgacaagctttactaatttgtccgttatgattgtcatgggcgggcggagatctggtgattgctgcattgtggaagaaatatcataagtaattgtaacttctgttaatgttttagttggtgaacatttacatcattagaattgctgcaagaatatattttttgttaaaggatagagatttcctccttgattacagggctacgtccttgattcttcccttgattttgataacagggctgcgcccctgccttattcttctccttgactatagggttgtgcccctgattcttctctgtaaccatctgtgatgtacaccattgatctatatattcacacgacagccactcctataggtgtggattatttcat

SEQ ID NO: 43 - DNA, 1081 bp, Zea mays
  misc_feature (1)..(1081): optimal_loci_171814_G1, chr4:237589019..237590099, Cluster 1
acaatatcttgccattttggcactaccgagatctctcaaaagcttaacaaatttgatcaatttgctcatgaccatggcatagatcaattacatttttctgtatatgtttttgcttctatttttgtctcctaaaaatggttgtggctggtcattcactcattctacttgtagaattcaagtttctatcttcaaatctaaattgaatttaaatgaaagtgacacgagaaccatggttcatgctttcttttatcttatttgtgatgtttctcacctaaagatatatgctcattcctaaaactaattgtgttgttgtgttcatgacaattaatatttttaaattttaatatatcttattataatgtgttcactccgtagcaacgcacgaatatttatgtagtatagtatataatgcatgaatacatgtcggattcccactccccccgtcccctcctcgtggcacgagactaccctccactcctctcccttcccgcccgcggttggaggtggtcgcagcgaccggaggctacatatgggttgaggttaattgcatgcttgggattaagaccactcacaccctctcttttctctgtacgtgtttgcttgtcgaaacaatgttgttgttcagcaagcgcgctgtttattttcacttggtactttctgctacgcctggcttgtgcgtccttccaaggttggaattccatcggtcttccgtacgtgctcctttttctgaactgaatcgatgcgcaacgacattttcacgagtaatgttaaacatgcgcagttggttccgtttaatcagacatgtgctgcgttacttcattaattggcagtaccaactgcaggatctgattatgatgttatgggcatcatatatagctgtatggtacacattgcggttttggcttagttcctaaatattctcacaagactagagtttgatcttaatgttcatttggaataaaaaaaacgaggatatattatttgccgtgcccttgaggtggatgccctctgtgctctcaattgagaagtttcggtttagagcatgttgtggacactctagataactgtgagactgcactgg

SEQ ID NO: 44 - DNA, 1080 bp, Zea mays
  misc_feature (1)..(1080): optimal_loci_171855_G1, chr4:237934692..237935771, Cluster 1
gcttttttcaacgaatcgatactagttatggacgaaccttttaagtgcaagcaagcctaaaaaagtccacatgcaaatggatagcaaagttgaatttggtaccttgaaatatgaataccatacccactaacccaccaatttcacacctttttcatggtatacatggttgtaatggtgctatcatttgttgattggtctagactatggttcctcaagaatcaaacctataatgaagacaagttagaggacgcaacacgagatgtggttgaccatgtcgataaggtgagagaagtcacacatgaaagtacccaaagggatcatgatggttccacagatgaaacacacacttcctttgttggtgttttggtcctacacagagtccaatccaaaaaagagaaacacaagctttcaccacaacgggaagatttcacccccatgcgacactactatagtggtgagaatagtctatcaataacatcagtcgatcctaccttgttcgattgtcatgtgggttctagtgccactggtaatcgtgccttttggctatatgagacaaggcaaccctccccttcgaagtatctaagagacatctcccacccttagacacttcttcaatgtcgggatttatagtttctcccacgctcattattgtaacctcgactacatactttggtccctttgtgcttaggaacatgtttgaaacccctctagacatacaatgggttgtttgaatgaatttaaacctcacgcttttgagagataagtaatctaaacacatgtgtgacattaagttcactagttggtgatatgaaacaccaatatggggcattggcgactctcgtgcatgttggtggtatccctcttcctctagatgagggtcatcttcttcatgtcattctcatactaaggatctcttgctcccatggtgaagaattgcttttactgctttgggaattggagtgataaacacacaacaaacttggctagcataaacatctggtacactgaaaccacaaatttatcctagcaaaaacctcatgagagtgtgaacatggggtgtcatatttatgccacataggg

SEQ ID NO: 45 - DNA, 1386 bp, Zea mays
  misc_feature (1)..(1386): optimal_loci_172112_G1, chr4:239748993..239750378, Cluster 1
gaagtgttgcaattatgcattttttttcttcgagagactgccgggtgtcacgggcaatctggtatatagtctaaatagctataaatatttatcctctctctaggatcgcgaatatgtttagatcatagctagaggggattattaaagatttaaaattgttagcgctatcagcggcagcagcagtttgttcggccatttatttggtgacatagaaatgacattgtgtgtaaatgtaaacatgtgacaaattctttgcaggttcttcatctggctatttactggcttcattcctaggctgtgctatagaagcctatattctttcaggagttggttttaactacctattaacgtttggatcaagttgtcagagagtttttttttacctagactcataggtggcgatctagtttagaattgaccactactagcgaaggtgtccgtggttgacattagcctcataggttctgaaaacactccatattatagtgaagatgttcatggtttttctcttcgtattaaagagttttctatgtaaatctgtgtgtcatgctctgtgatttattgattgatttacttcgttttgcctgttgtttctgctaatagttagtagaagttgaatgtgtgcaaagacaaagcgtaagcagccaagcaatcacaagcagcgtgatgcaagcaagcgagcatcgctttatctgctgcctgagaactgcactgcaccccacttgtacctacccagccgctgggaacaagaacaacagtggtagctagctccatcacttgcaacccagtggttgacattctgtcttggcatcacactacacaccgatcatttcatacatgtgtatatatagcaaaaggacaaacctaaaagcctagcatatttagtgcttcttatactgatccatatatgatcggtaggagagccagacgagatcatgtatgtttatataaatgggtagctgtgactgcctaacagcacgtagttgaagcctgcatgcagaaaccgcatgctagctaacgatttgacttggcgcaaacaggtcagacgaggagatgtgaagatatctatatataatttgggctgattaaactccactagcagaaagcgtttttgcatatcttatctcctgatgttgatgctttacattacccattggaaatgataacttttcccttttttgttttctcttttgctcttttcgaacacaagttgccctcttgcggtttaggttttgtttggatactttaggtgtatactatattatctgaacaaaaccttagggatctcagaatcattaatatactcgcgtatatatatcaaacctaaaggttatatcagcatggtgcttggtatactgatccatggtcagcggggttctaaggcac

SEQ ID NO: 46 - DNA, 1186 bp, Zea mays
  misc_feature (1)..(1186): optimal_loci_172640_G1, chr5:1735952..1737137, Cluster 1
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
tgcagaaaactgagaagaagaaattggatgcagttggaaacacagaataatatgatatgtacctcatgcctatgtctagctgcttattatagctgctctggtttctgttggtaaaaaaggcccactttaaccaactaatttcatttcaacagctataaatatgagaaaactaaaagctttaattattacataatcctcatgggaaccagtgaacacaaaaacttactatgtctggcttgattacgtcattccactcctttgtcttcctcttcatctccttggaatttgaatcggcaagctgcagaaacaaatggagtagtttatatgcatctgatatatagaacaggtaatgcacgtctattgtatacacatgtttgagcgcataacacaaataggcttttgttttcagtcaaagcaatgacgaataccgtaggtacaaatggtaccattctttttatagtacattactacatatatctgctgtctgacgatttttatagtacattactacatatatctgctgtcacatgtgttcataatcttctctataaactgggtgaaaccttaaaagcttcgacttagaacaaagctaacatggcattatttttggggtcagaggtagtatatcattactgttctttctttaatgccagtaatctgtagcgattgatgtattcatgaactgctacaggctctgtcaaagaccttaacccgtagacgagcttttctacctgaaatcacagttttctctattgcaaccagacaggaatggatgcatcactcttgacatatcagaatggtttagcttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcagcttgaagcatgatagatggagcacatgcgagatctgctatgacatttgagaagagcactgagctattgtatagatgattagctcttacgtgatcttcctccctgtctctttctagcataccagtttggtggacctccaatattcctggcacattcgttattacatggtatggaatatttcattgtcaataaaatttacttgttctctcaggaattgggcctcagcccttcagtgccactgcatgtcgttctttgccaagttcggacac

SEQ ID NO: 47 - DNA, 1007 bp, Zea mays
  misc_feature (1)..(1007): optimal_loci_173679_G1, chr5:7622957..7623963, Cluster 1
ctctcttactttggtgcagtggaggccctgagggtggggcagagggaccgccgccccgagcccccaattatatagggccccgaactagttatacattcagtaattagactatcagacacaataacttaatagtgaaatgttaaataattagtagccacagagtgttcacaacccggtcgtatttaaaaatgttaaaagaacttttaagataatactataatatgtatctttttatttatttattgcttggtatgaatatttttagatatgtcttgagtttatatattggtactatttttatatagcaatagtttaatggacctctattttaaatttgctctgaacccctaaaacctcgggtccgccgctgctttggtgatcccttcctctgtccatggtcgccaaggggattccactttggtgatttctgcctctatggctgtctgagccttgcgaaaagaacggcgtcgaaatctgcaacccccaccccccggcccggagaaagccacgccgactgctagtttaaagtggtcttgtccgctttgagctgctggcctggcagcgctttctgtttgctgttgttttctccgcattggcttctcgctgaaggcgaaagggaggccagcgcgcgtgctgggcttgtttcactgacggtgtcgtcgaaggccacacacacacagagtcagaaacagcagctggttttacaaaaggagaggcccgcccggccgctgtccagtcactgcactgttgcagcatgtgcaggctgcaagccgtcatgctggccatcactgggtctgaggaatcagagaacgcgcctgttttcagagggaaacggtcttgaaacgcaagtcaggagggcaggaacatgcaggtcaggtatccctccctttcacccaccctctgtgcaacgtcaatggagaagaagaacaagtaaaggcgcacacctggattgccctctgaaatcctgcagaagacaaaggaaaaaaaaccttctgatctaaggctca

SEQ ID NO: 48 - DNA, 1008 bp, Zea mays
  misc_feature (1)..(1008): optimal_loci_174368_G1, chr5:11888055..11889062, Cluster 1
cagttaaaattagccatagagattctaaataatttagctaaagtcctagcttatttttagctagaccgtcaattagtaggttggggcagctaaaactttgaaattttctgcgaggcaaaatgctaccgacccagttgaagcgaaggaaatcaaagactatttctataacaaaattagacctcctatatgttaaccgctcgtacgtctaccctttagactataaatataaaactttagactatatgaagagagacaagatactacccttacaacgaacacaattgaacgtatcataaccagcaatccaacatgtctaactggacttagggtattaccctactaagttgcgccagtgagaaaattagaaaggcgcggcgtgggccccggccgaccgcacgcagccttttttttttccatagcaggtgaggcctacctagtacgcgtcaccggccaccggcgtgtgtcaggaacgcgatctccagcccgatctcgtcgcatgcaggccgggctcgcgagcgcccccggccccgcggcaaggcaacggaagcaaagctactgacgcgacgcctggaggctggaggagcggccggctggccggccattctcatctcgtcgcgaggctagcctctggccagttggctaaccggcgcggcgcggcggggcgctctgttaggagcgcaccggcctgacggccggccggcgcacgcgggtaagatattccccgagcgaataattggcaatgcatcccgtcatggtcgtgctacgcgatctgtctcttttgcggctttccccatggctgtactcgctccttgctttggggcaggatgacacacaactgtggctggagacgtgttgtacggagctctggttgtgcggcggatcggatggctccctatgcacagtccgtctgattggattgctgctccattggtacagttgcacccgcggagatttaaagcaacgtttgtttggttgttcggtacataaatgcagactcgtctcgtgcaa

SEQ ID NO: 49 - DNA, 1230 bp, Zea mays
  misc_feature (1)..(1230): optimal_loci_174369_G1, chr5:11889125..11890354, Cluster 1
aaaggaggagagttgtagcttgtttattttttgctatatctcttaattagaatatttaatcacagtactgattttatatttgtgtttctgttattttttaaacaaaactagaccacatatattgtataatatttaaagattttttgtacaatcttatctaatacacgttctgatacagacaaccaaacacgagctatatttgatctgaatgtactaatacaaacaatcaaacgcaaacatgtgcatggatctaggctgtatacaaagaacatggctcctcacatacggaccaggatatcaccgtgcagcaaccaaacagaccgagtatgcaggcagccagagacagccatcgcgattgcaaaagcttctcgcgaaagcgtgcggtggctttgccaaccctgcagtgtccattggacgcgatttggccctatggggtgcgtgggcgtgggcgtgccgtggcccagcgtgggacgtaatcaaatccaccgtgatctattctaaagctggtgtggtccgcgcgcgcggtcccgtttgcaagtttcaaggaaaaggtccctgggccccccgggacccaaggtagataaagccctaacgtcttaaacgattgtatctactactatctagtattagtatgcttagtattgtacaccttgccgttgtcagtgttggtggtcataagagttgttgagcttccagaccagagttccatgttaacctgttctctttacaccggatacgttgttcaaccgtggaaagatcagaaggatgatgccctacaggcggagtcacactccagcccatactcggtagtcggtaccatgcgcatacgtgcctagggtgccccatctctacctaccttcatgccttcagtggggtttcccggaagaaaaaaaaacattcctgttcatttgtctccaagaggtagccgataatatgcattattggatacgccgaatatatccgccaattttatgttcactgaaaaaaaaaggatatatccagttttatggacgctactgtatatgtatgaacacttgcaagaactagccgacgaactgtatcctactccaagtgtatgatctatctattgcgggtccgcttcggcgttgtcagtattttgttcctgtgcgcgccatacgagaccttattcgcctcttcccatcaaatatggattagatgactttagaaaggattttgacttgcttatagtttaatgtcagttaggtttca

SEQ ID NO: 50 - DNA, 1167 bp, Zea mays
  misc_feature (1)..(1167): optimal_loci_176656_G1, chr5:23883701..23884867, Cluster 1
aacagtgacttaacatcaaaagaatacgactttttttgggcgcacgtgactcgtaattttttccacgcggaacaaaagaaaggcgtggaaagaagtaaaagtcaaagcggtaggcgtggatttcttttgaacctttcatcgtcgcggctgcagtcatacagaggcagtagttgctgccagcccaacggtcacttttccaaccgtcacctggcgggtcccacccactttttcttcttcttctaccgcctgctgagcggggtactctctgcccccccccccccccccccccccacctcgatcttgacgtcttatgatttttctgcatctcatattatcgtgagtgttagtatttggaaaacgacgggtcaccgacagtacagtaaccccctcgcccccacctctttgacaaattctgacgatctgctgttggcggggtggttgccgagtatggattcgcaaacgttcttgtagaacagcacgaggagaagacagaaggggggagggggtgtcagggttttgtttgcaaacgcaagatgtctttatattcttaggattgttattttgacaccgcgagaagcaaggtgtttttcgttctttcttttttttcctttccggaagcagcagtggtcgtcagtactacatatccgccttcagaactgatgcaaactcaatgtctgaccaaaaccgaactaaattaaattaactttggccgagtccataaaagcaaaaaaaaaggttttgccatactagcgtcgtcggcgggcaaggcattgaagcggtcggtaagctggcacctagtagtagtaataataataatactagaaaaaaagcgccctgtcgggtgctctaccatctgaatcacgccgtcatctgaatcaccccaggtaaggccaaaaaaccaaccttagagtattcaaatacacttgaatgcatgagaaattatttagtgtcccaaacaatccagctaaagtaaaataaccacttttagatataataccttctattgcctgctaatcactttcctcaagttcattcatgttgtgatcatatatctccagaacattacacaaagaggactcaaatcctaagtaacaaacaacaacatgccaccaattgtggattaacttgtgagacaaaagaaatatctaaaaagctaagctcatagat

SEQ ID NO: 51 - DNA, 1048 bp, Zea mays
  misc_feature: optimal_loci_17718_G1, chr1:98754773..98755820, Cluster 1
tgatggtgcaggtgcgcaaccggaaccgacgaaccgtctgtatactagtgattgacagcagcagcaacaacaaacaaacaaacaaagacgaatactaggaggtaataacagttggagtagggcactagagtagctacaaatcaagtgattcgaggcatgacgtcaagattaattgcctagtttaaaacaactgtggaggcatcaggattaaatgattgattgtgttaataataactatctaggtcgtgtttaggaacaaagtttttttttgaaaaaacatagtttttaaaatactacagtacagtacactttagttatgacaatattatagtttaaaatactacggtttcttcgaaacaattatagtatttacttatgttttgaaaacagagattttaggtagcttaccaaacactattttacaatacttcaatacttcagttaaacaccattttataatacttcagttttgaaaacaaagattttgcaatgcttcagttttcaaaacaactagtattttgtatataccgttcagtttcgtggaacttagcttacgctattctagcttgcttggctcgcgcgtcctactctaaattcaattgtttcactagcgttaattcgctgtcaccggaaatacaatcatcccgccataagagatcgtgctggatgtagatggaggagtctgattctcgccctgccagtgacgaagctagcgggtatgcagatccctcttatttacaggagaatcaggctccccatatgcattaactataattcggctcatgtttggtacgttgtatcctgaaaactgagcaaacatacactggtgcaacctagtgttatttatctgcacatatagatacccaaaaaacttacgtatctaggcaacaaagctcacacaagcctagctgcgtgcatgcagggatccaaccacacggtatatgctctggcaaactctaccagtggtggttcccttcggcccctccaacgtggctacgtgctcagcctttgccattcctccttcccagcctgcatatgtcggtgggtt

SEQ ID NO: 52 - DNA, 1145 bp, Zea mays
  misc_feature (1)..(1145): optimal_loci_177648_G1, chr5:29065285..29066429, Cluster 1
attcttgagcacgtctttacgccaactggggatatggtctttctctagacattgacatacataaaatttataaaaataatttatttttataaaaaacacaggaaacaaaaaacactctattccaaagagacatgcgactttttaacataaaatcttttcaaattggctatacgagatatcccataagcaaaactagatccgaaggctaggtcaacctaataacatctaatatataagtattatatatatatatacatactcattattcatcaccggaactagaccaccccaccgatcaaatttgtgaactacccctgtgcgctagctagcccactgaaccgattctccacgagcctcgctcgccattgattactccaatgttggagccaccgctacatgtctacaattagtcaactatggtccgatctagtcctacccaccaccaagccgatccgcaccacttaacatccactttacaattagccattgaatatttctttcttctaaaatttaaaaacggcgaatgaatgaaataaaccttgaaatagttgaatatctgttcgtggtgtatgttaagtaaaacttaaatggctgaagtaaaccttgaatgacagaatatacgttgttgtgcgctacaagcggcaagcgtctgaacaccgttaagcatgccatgcacgcccgttataactccttatcggccggtgcggttggttctctggtgggctagtccattggaccttttaatctgggtgatggattatatatatggactctatcaccctagtttgtgaatagttcttaggtgtgtgtatatatataattacgtagaaatgggtagccaaagttttggacactgactactcttcgatcagctgatgctaatcacacactgaccggattccgaaacaacgtcatgctttgtgacagatctagcggagtattatactcccgtacgtaccaacagaggacaatgacaactttgctacagaccttcctaggcgaagataaaataaaatggtgatgaattattatttttttgtttaccacaagtcacgagtccactgcaccccccagtaccaatgcacaactagcattcagcgagatgttctgttctccaagagtgttctgttcgaggcccgctccag

SEQ ID NO: 53 - DNA, 1208 bp, Zea mays
  misc_feature (1)..(1208): optimal_loci_178129_G1, chr5:31628979..31630186, Cluster 1
acccactttggtaagcccctaggaaaaacataaggggaattttcttcccattcagtcgattccaaaaatctatctagcttaaccaagataggatgttcttgttttttcgtccaagtctattggaggccacccatgggaacctctctcaaattaagcatcactataaagcaatttaaaatgtccatcaacctccgatcgtagtgggaagaattattctcactcacatcccttatgagattgaaatcccctccaaggattacaagaagtttctcattcctaccaatttatgagagttcttccatgaatcaacctccgatcatgtttctttcatcatccttctacaaatcgatcttatgccttttatatattatgcatgtgattctgatcagtgacctgtgcttgctgcttatatcaattaaaactttcatatacaacagtgacacagggatatgggtggtaatgggctctaaaatttacacagtaaaattttaggatctagatctatttatattcatctttaaactaaaattaggtaaaaactcaaacgagtcgtgaaaaaacatttaaatggtgatccattgccatcgtacacggggagggtccaactacaatagctattggtttcgttcgcgttcgtgtgccagtaaaataaaaggatagagcagcgatgtgttggtagggtttgtcgtcgagtccaaccagaaggccatgccatgccatgtcaggcctaagtcgaggtcgcaaattgcgctggctaccccaagcaaaacgtgacattcccctttctctctcatgggcgaaaggcgcctttacgggctagtttgagagtccaaatgctgaaggggattgaaggagctaaaatctcattcttatttaaaattgtgactctaagtagttcatttccagctcaatttctctggttttgtgctccaaactaccccgtagggtccgggtgtatgctcgcccgtccgcctgtgcgggccgcgcgcggggtaacagggcgtcgccgtcgtcgtgtacgggacgccggacacggacacgacgggggacgctccaccggcgtctcgtccggagacgggcgcggagaactccaatctgctgacacgcgcgggctgtgtcatcaaatgctgggatggcgagctgtcctgcgcctgcctcgctcttccgaggaaattgatagcacgaccgccaaaaagtactcctccctt

SEQ ID NO: 54 - DNA, 1005 bp, Zea mays
  misc_feature (1)..(1005): optimal_loci_178172_G1, chr5:31835055..31836059, Cluster 1
ctttagcgagcaatacaataatgagccactcgatctgttactgtagtcctcaagaggacagacgaatagaccgttcacgattctgcacccgcattttccaatattcgccagagaaaaaaaagtactaccttattagctacctaggcgcaataggtagtgtagcactctacgtgaggacatcggaaggtcgctcttgccaagaataacatcacagtcacagcggggctgcttgttcttcttctcgaagttccaccaccttttagcgtaaagcgcttttctggctgctcatgaataaagtgtttttctggctgctcatgggacgtcaattgtttaaacacacagaggaagtcttcttcagataaagaacatggatttgccaacaaatatatattatttatatcccttgcggtcaacaagtaagcagtgttaagcctctgatatgatgaacatatttctatacgttgcacgtttgccacagcttgttgggcaggcttcagttgatacatggtgggtcctgctttagataattaacctttgcacattcattcagacatgcagctaatcgaaatggaacagtactcgtattcgattttaatctaaatactaaaaagtggatgtatccgtaccgtatacgatttctacaacatttctctatcttaatttcgtatttgaaaaataatgttaaatactcgctgttatccacatccgtaaataacgaagtactaagtatagaatcatctagaacgacttatatatctacgactaattggtattataaataatgccaccattaatataaaaaccggcacaatgttcgtacgttgccacgacacataaatattcaataaaattttagagcacaacagttacaattaaaacgaacaatatatattatcatcgaccaaaatacctcacaaattctttgctaacagggaatataaaactaaactcgagatcccgagcacctcctcctctccggctgttcggccatgcatcgtcgtcgaa

SEQ ID NO: 55 - DNA, 1260 bp, Zea mays
  misc_feature (1)..(1260): optimal_loci_179998_G1, chr5:41811098..41812357, Cluster 1
ttaaatgagtagattgccataatagcgagaggaaatggttacagttaatttatcggaaggtactttagattttgtatagcagataacgaacgtgaggaaacgtctctaacacgcgaccaacacattaaggggttgttcggttccttaggaacgatggtctggaactattcctgtctggattgtttaactattttatataagatttcatgaggtgaaataaatctaggtccaatcctgaacaatcgaacaggccgtaaagataaagttttatttcatcattttgatactggcgtgaattcttcctcctccaacttatgcaccgtaccaaatattttttacacggagtgaatagcgttgttttacagcgactggcagggatgaattatgcctgcagcgagccagcgagtgtgtgtggctgagaccagcttcattcactcgtgctgttgctgctgacgccagccgcacttgtcccgcttgtttctgtcaatgggaaaaaacctgtcgccccaataatcacaatcacattcacagcaccccacctacctctacccatttgaagaactccggccctgtcggtgaaggatgccgctccattgtgttttttttttgtcggtgcaaacatgccgcgccgatcggtcgctcactcgctgccgcttccagaagaagcaggcgaagccaaagaaaaacgtccccgacgcccggcgggaaagcgcgactgttgtctgttgattttcccctttcccggcggattgtgcagtgcagtgcatcctcgcgagttgttcgagcgaacaagcagcgtcaggacagggctggttgatcctatggtaaccttttgctttcgccggcggcttttctgctcgagtactgttcatggcgaccggaagaacgagggaccgggcggggatggctgcgtggggaactggcgatgagatcctggcggcgtgcccgcccacatggggctcacgccgttcctgctaccctgatctgtacgcgtgcgtacgcatggttctcgttgggttgcggttttggtagccacgggcttgcttgctctccacccaagcatctgaattgcaatgccagatgcagattggtaaagtttatattactaatattagtgtaataagaaactctaatagcaactactatatatatatatatatatatatataatctaatttactgtaaacacctacacaattatagtaaacaaacttctactaagactaataaaagcaaatagctagttactacttactaggc

SEQ ID NO: 56 - DNA, 1189 bp, Zea mays
  misc_feature (1)..(1189): optimal_loci_181590_G1, chr5:51860517..51861705, Cluster 1
attaacactacgatacatgcatacactacgtcacatatgttctgatctgtattacataaaataaactttatttatcatacaaaacaatttaactaataaataactgatacaatattttgaactaaaaacattatttcgagtaacaaataggtttaataattaaactcagaaactttaaattatcaaaggaccattccgcgaactaaaccaacctaattaaaatctataatattgttctatccgacagaagtaactaacactaaataatttataatatataattcaatgatatctacacaaattaactataaacaaacaaaacatataaaatttataagcaaaatggacttacataaatgggcgagacggcagtggtggactcaggcgcaaggaggttgacggaggcgtgggcgtcggccgtccctattgcgggcgtgggtcgagcacgggcgtcggaggcgcgatgtgagcgcagatgtcgttggaggcacgaccaggggcagacctacattgagctgagcgggggcagatcactcaaatttctggttttatagatactttatcttatttactgtatttacgaaggctaattagttagtaaacctctatttaggcccccactcatatatcaggcttccactcagatattggtctgagtccgtccctgggcacgaccatgggcgttggtggctaaaggagacggtggcggcgacgcgaggaggccagaggcagcgcgcgtgcaggtgctttggacggtggaggggtggagcgcaacgcggcggtggggtcgtgactcggtggcgacggttttgggtgcacggacgtcgtgcgaatatggtggccgaaacgacatctacgaggataatccgtcttattttcgatatcttatctgataatcgtaaaacgttattgttatgtatgacggtattgacggtcaatacgcgtcgtcgaaagtaatcttaaacttctacggttgctctctggaaaccatcgaaaattagacggtcgccgaatttgttgtggcttcctgttgtgagtattggttttgacgaattcagcgccaccatcacagctcttgttctattgcattcgtcgcatcctgtaaggctgtcatttcgaagttttcgatagccattcgtatccgactccgagaggcagggcaggtgcagggaccatgtgaaaacacaaa

SEQ ID NO: 57 - DNA, 1351 bp, Zea mays
  misc_feature (1)..(1351): optimal_loci_187512_G1, chr5:92790838..92792188, Cluster 1
cgacatagtcatgactaaaacgatgaccgcttagctatcaagtgttcgtctcggtccatactttttcaaggatcttccgcaagtgggcgctaggtaccgatgtagatatatacggcaacgaccagggaggagtactgcagcttggaacactagctaccagtcactgttgccgcctccggtttccagccacaccttgaccgtgtctagcagcatgaaagctgggacgccactcaaagacagaatggtcctgaaaagaaagatggaaacagcacggtgcatgcatcgacccccatgaattatgattttttttctcaatgttttacacaacgcaggtggtattgtattcggtggcacacgactgctatcacaaaagatttatatacgccatgcttatatctgttttaaatttgacccctttttacagtcttataagatactagtgctgttgaccatcaaatcaagtataatagcactgactaggagggctccaaacagcttcatatcgaaatcctagatgaaaggatgataatgcgtgagagagaagaaagtggatgcttcatgagagagctcggctctaacgtattctacgaggaacaagactatgcttttagcttgatgtaggagttaaggttggctctctttttttcagccaatctaaatgatttctctctccaacttagatttacctaagaataaggttactatatgtattagttttaatattgactctttgatgatgttggcaaaaacatagagcattcgatcagctggttcttctgttagcctttgctttcatctatgcatatgtgtactccagtcatatatacagttaagctatagtagtaatggctaaaacgaggaccgtagccaagagtgtccatctcagtcgtccatacttttttttcaagagtcttgtgcaagtgggcgctaggtgtaccgatgtagatgtataactacgaccagtagtactgaagcttggaacgctatataccacactagtaccggtcactgttgctgaggcctctggtttccagccacaccttgactaccgactgtggccctgcgcccagctagctagctagcagcttgaaagctgggccggcctgggagtttcttacgctacccagacgactcgtcgactcgaatggtcctaggaaaaaaaagatgcatggaaacagctactagcacggtgcacagacagccgacgacatggatcgatttaatgttacacagcgcatgcaggcaggtaggcaggtgttacggtgttactgcgttgtattcgatacactacatcagctacaatcattctacaatcatttttagaggccaaaaagcaccgaaaattaagtct

SEQ ID NO: 58 - DNA, 1213 bp, Zea mays
  misc_feature (1)..(1213): optimal_loci_201597_G1, chr5:183496058..183497270, Cluster 1
tgcctgctacgacctctgtgcatgcatgtgtatgtgaatgtgtgtgactgatctcgagagagggacgacgaaaacacagagggaggcctggggttgttcgagcgggcaatggcgcgccggccctacgcatgagagaggaggatcagtcatcagcgggtgcgtaaatgcaaggcagaagcatgccatgcagaagagagaaggcagagagagagagggtgctagcttgcagttgcatacagagaggagggcaggaggccgcgcggagggagagtagcactagcacgcattgaaggaggggctcagtgctctctgctctcatcatagctacccaatggcgcccccctgccctgccctatcgaacgatatcgcatttactttgcacgcaggcatgcagctcgctagctgcgtgtctttgcagctgcagcacagcgcgcgcggcagcatggtagtgcttgttgcatgcgtaaacttttgcaaaccctagctatagctatgctgccatccagaaaggtgcaagtcaaaccgcaggcgatccaccacgctcacacttcgtgtatctgcccccctgtccctgtccccaaacttggggcctctcttcaatacgagttgcatgtccgtgcatgcgttcgatcctcatctctcgctcggtctctcccatccatctacatacactgcagtcactggcatgcatgcatgcacgagacgacgatcacagagtagcggcccgctcctcctgcctgcctgcctgctgctgctctggttgctgtagttgcgtgagtttgtagcaaatagatgtgatgtgatgcaccagctagcatgtactgctactgcctagccagtgtagctacatgagaggggctgacgagaggccggcaggccgcagcatccccctccgactccgatcctggtggcctgatgtgtgaccatgcaggtagtaccggccggccggcctttacacggggccctgcaacgcctgttccaaccctgaagagtcacgagtcacagcagcttgcagctagcagcaaaaacgcttctttgcttcccgaccatccatcgctttgcagaattgcaggtcgtccgtttttctttcgcacaagaacacattaccatctcagctcacacctctgacctctcgttacagtagaccgatcaggcccggaacacacctttgaataaaatccttttttattcaattctaaataccaaatgattg

SEQ ID NO: 59 - DNA, 1315 bp, Zea mays
  misc_feature (1)..(1315): optimal_loci_201747_G1, chr5:184158500..184159814, Cluster 1
gtacagactattcaaagttgaccataaccagcacatgctggttgaagaacaagtgcagctcaggtggtaatgacagacaagaaattttttttactactaatctgccatagaaatttgtatgttcgcagtgttgtaagcagcaaggtccatagagttttgcgcagcattcaatcagatcagtttaaaataaggcaggactcgtttccaaaaaaactaggcatactatttggactactacctatccaaaaatcaatatgcaaaacacaggcaacggaaaattatatggcgccctctttagctagaatatcatgttgctatattcaaaaaatcaacttaaaaatcatttatgtagcacacttatagttaaacgtagccacgacaattcagtttggaattcatctttcatgttgatattaaaaaacagaagtattaaagttgtgtgtactaatcatttcaacttaaaattttaagctggtataaagacgtggacgattcatttatattatattcaaataataagtagcattgtggtattgtagtaccccgctatcttcgccgccagttcctacggcgaggaacggaggcaatgtcgccttgcaacaaggagtacttactgtaccaattccagcatccagtacaacaattagtgcacggcagataaaatctgttccgattaaaggttcatttagttccttgcgcagcttttgcgatctgtgcgccgacgcgcgcacatgtgcctactgctagttgtaattgccgtcagttagtacgtagtactgcaaagatgcgtggagcccggctgggatgtgagctgctgcggtgctgcaacaagtgcagcagcgactgatggaggaactgctctgctctcccaagtcccaagcccccgcgaccgcgatcgtgcgccccgagccctatcagccgtcgacaggtgcgccgtgcggcagtagcagtaatgcgcttgccgccgctctgtcctgctgtgaatccgcaaggcagctcggctagtagcttagcaaatcggcaccggatccggggcaagatttcgctgggatttgagggctgggcggcaacacatcgtgttcgcaggcacatcagggtccagccacagccaggcagccagccactcggcggcggggtaactggctagctgcacgatcagtcagtcagtcactcactcgccatcattcctgtaccccccgataccgaagaacaacctaggagcagagagcagccgaaaagcacagggcctggggccgctcatctcatcagtggcagtgatgaccagtgggtggcctctgccttttgggatatgcta

SEQ ID NO: 60 - DNA, 1030 bp, Zea mays
  misc_feature (1)..(1030): optimal_loci_202718_G1, chr5:189303627..189304656, Cluster 1
cgtgggggaacactaaagatagctacagcaagttagtgtcaccggccagctgttacgtttccatccaattagcatgacaaaaaatctggtaatgggagcatctcgatcagttatatgtgcaataatgaaatatgattcagcacgtctatatgcgcacacagattagagcatgtataatttagatactatatttcggttgtccaaacactagatacatatagttaactcgttcatacaatccaatgtatctaagtattgtatcttattcagtagaaccccttacaaatcatttatatgagttgtataagtttaactatatttaaacttagagaaccgtgctagagacgttacttcgtcaaaatacgtcttttgtgtttttacacttacccctttagatactccttaagatacgagagtcatttatgtgtgttgtacatgcatgcccttaggacatgttcgttttaatctcaattcatatgaattagaagggattaagtgagtttaaatctctaatagttaaaatctttcttaatttcttctatctagtctcctctaatacacatggaataataataatccaacaaagccttagtctgttctccaacccatcctgtttcttttttgttttgaaaaaggcaggagagacagtttttgcgcctagtacttctcgtgcaactaaccctaacgcaagcgagacctctttaatgatctttgatgatgaattgatgatgagttcgttgggagatggctatctagttcctcccgcgcgctgggatttgcagaacgtggcagaaggaagccagcactctaggcgcgcggcatgcacctccctgcaaaattgcagatttgtttttgacgcaataggttttctctgttgcattggggcatgcagcttgcagaaatgcagaacagatttgcagaccggctgcaaattaatacagaatggctagagagtaatcgcttcgcttctctctctctctctctgtctgcagccggccgggcgcatgcatgcatgtatgctcgcctctcc

SEQ ID NO: 61 - DNA, 1177 bp, Zea mays
  misc_feature (1)..(1177): optimal_loci_202720_G1, chr5:189305541..189306717, Cluster 1
ggattgagtgaaattgagtgggtttaaataccaaagaagacaaacttcttttttttttcaatcaataacggaacaaggctttaatacacgtgaaggcatgcatgattcgagaaatctaccggcacacaccgtatgtgcaaatctcgaaacaatctactacagctatatatctagctagttgcgcttgcaggaatcagctggaaggcatgcaagctgctttggctccgtgctgaccgcctgaccggaacggcggccggcgtaagcaggctagcagctgcaacacaagctgctacttgagctgtgccgctagctcagaacgcagaagcaagcaggccacagggctattcgagtaaacaaacgaaagattgcagtagtagtagtataggatctaggggatgcagaaaagcaaagatggccgtcgccccatgcatgcaaatatatgcagtagatagccgtacaatacaaggtactagctctcgcgcgcaaggtcaacttagctgcagcctgcgcatgcagcaggagctattcttagcttgggctcaatacttctataggagtatgtatatatagtctgtcaggtgtgccagaccgtagaagccacaaataatttttataataaggagcttctattcgttatgatcagatcggacaggtccagagcctgatcggaattcagaatggattgacggtggtggttcagtggtgttggtgcagaatctggtcggccgggttggccgttggcgattcaaatccgggtcgactccgcaacctagtcttcctaagcggaagacaattagatagcaataacctaccactagcttacaacctcacgtacatagattatgcatacagcacgagcatgcatcaatgcatgctttgttggccatttttttcatggatatagtaccttcgttacccctgcaggctgcagctacaacacgacatgtgtgaaaggcagaaagaacaggtaccaatcccagaggcagaagtggcgctagctagcgctccagctccgatccagcggtccagccaagcatgcatgtggactcgcaagtggcataactggtacaaaccttttgttcgcgcacacaaacacatccactagaacagatgatagggacaaaatttgtgttctttctattattctatattactttttcttgcttacattatgcga

SEQ ID NO: 62 - DNA, 1254 bp, Zea mays
  misc_feature (1)..(1254): optimal_loci_205276_G1, chr5:203995025..203996278, Cluster 1
atgcctactaacctggtgtcctttactggatccgcccataactgcatctcgattcataatttcgttcattagttcattgaaagattagcttaagaaaatgttcctgatacaaatctaaatatgaaattctgaatcctttatagcactgaagcaaataactgaatctgaatccgccatgatataaataactgatgtatgtctactaagtataattttgccatggtagtgtttcgttgaggaaagaatgatatacattgccagatgactcctagctaattttgccatggtagtatttcctcgaggaaagaatggtatgcattggtagatgactcttaccttacttgaagttagatctttatgatgcatgatagagtttctgtctgtacaacttctaacatggccaatcagcaactaagaagtgaatacccaagttcgaaatgagaccatttcccacttactaagcactaccttttccttctctattttcagttttttaattcagaccacaataataagtaaacacttgaagttgacaatcctagtatatatcttggttatttccttccaaaatattttgttagcacgatatgattaccctcccatctgactctcccctggtagcatccacctgctctgagtgtttgagtagtatcactagcagtaaaaatccattgattacaaacaacgagcagtgatcaggacacatctggtcgataatgctattttgatgaatgcacttagtttgtaatatgtaacagaatcacagaacaatgtcgatgaaagagcgacaactgagcatttgccatgcactttaattacttttatgatcaataatttaatacaaacatatgtctctaccaatgttaaaggatttttcacgtacattttttgttctacaaaagaaaccgaggaaacaactcagttcaattgtgtaggcacaattttttttctcgaaaacgcagcagaatgtaggcacaattttgaagccaagttaaggattttttaaatttcacttgtatgtttggttgataggacctgaacaatcagattgtattgtttcagggagttcagtaaagcgatgattagttttatatgatgacagtaggcatcatgtgtaaaagatgtcttgttttccatgaatccatagtgcatggttctcatttattttttggataagggttctcaaagtttgtgtttgggtttgccaattctgtgtttacagccataaaatctcatccttcctgtttcagatta

SEQ ID NO: 63 - DNA, 1113 bp, Zea mays
  misc_feature (1)..(1113): optimal_loci_206117_G1, chr5:208362948..208364060, Cluster 1
ctgctcgtctaagtccaactgaaagatgtttccttgcggacatgggtttctaactgtgccatatgatattatttcggtaaaccatctgccctggccacggtcgatctgttgatgcaatcagcaggttgatcaagtgcaggaacagatcaactgttgtttaattctgcccgctcatggtatcgaactcttttatttacagcatgagcttaatttggacctcgtttaattaggcatttacggtttcaaagatacgctgtggcgttaattaacctaaggatcattattaggttgcaaatggtcataagattaaggccctgctcataaaaatacttcaggttatgatgctgctctttgttagtaaagtctaaattgcaaaagaaagtaaggccaaatcgcactcatccatcagggatcaacaacgatcccactaattaaactactgtatgtccaacaactgtctaatgctataatatgcgccatggcttttatggccacgcaaatccaatgctaatttcatccgatctgcactgcttcaacgtcgacaataataggccaagttaggactgatttggtgattggggattccgaggggatccatgggggagggatccccttgcaattcaattttgaatagcaagaggatttcttcccctggggatccccgagcaccaaattagctcttaagggggagctttcctgcatgattagttcaactccagcttccttagtggttgtgacttgagccttcactgtcgaaatcactggttgagtcgtgagcacgagtccatcgcattactgacgacgagatctttttataagtgcttccgtaacctacgtgtactaaagggtccgtactagagacaactggaaaaggacgtagctccgtgtaaaaagaagtgaaaaagacacatctcccgtctgcggcgagcaaggcatgcgtatttgtttttttgaaactactctgtatatatatatttttttgggagagacttgtggtcgataaattgcaggatgactgaatgtctcctatgcagttagcaaaagctgaaaggactttatagccatttcagttaggcttgttaatgggttgggacgttgggttaaaatagattt

SEQ ID NO: 64 - DNA, 1112 bp, Zea mays
  misc_feature (1)..(1112): optimal_loci_206277_G1, chr5:209158929..209160040, Cluster 1
tgaacatgtatacggtacatcaatgacgcgcccccacaaacatacaacagcgtgatgaagacgatgatcgtgcaaatgggactaccagatgtcaacgtgatagaagtgatcgttaggttcgatgaggaaaggagcaccgtcatagataccaatcgtggcgttgtcgcctttcacgtctgcaatgcatggagtcacgaggcgagcaagaccctacagccaccatcgtcaccctctaatgcattaaccgtttggtcgatcccactatccaatattgtctgttcgatgtgtgttcgtttcagaccctttgccaattaaccctcaaacctctttcatcgacaaaccatctcgaactcggaccaagtttctcatcccatccaccttactacctgtcactgtgccatgaatgtaccagttaggggcgtagcacccggtatggtgaggtacatcctaagtatctacctaacattatttattttcagttgtcagttgtcttagctttttagtgagaccacgaggaagggaacaaatagttttggctattatttgggtctaaatgggtttctcttgaggccaggccactcgaaatacaacgagtgaccatggcactatcacgttaggtggtactccctaagtttcaatttataatttgtatggctttttaacctaattgatcgactcgttttattcaaataaattataataatcattaatttttactgtaatactgtttagcatataatatactttaagtatggctttgaaatttttattttttgaaaaaataagacaagtcagtcaaacttaacaaaaaaagtgaaataaattactatttgagatggagggagtataaaatagctcgtgtccattggccatcgcctaggctagcactattacaggagtagttagtcatgtagctaattagcatatggtgcacaacttttgcctgtttaatattttcattgttttttattcattagtgttaagtaaatggttcattaatttttaacactttgttgaagagaggccggataaaaaataatacactcgtgtgattaactcatcgcatcttgcatgtacatgcgtattgaaactatagttttgaatcgtactct

SEQ ID NO: 65 - DNA, 1236 bp, Zea mays
  misc_feature (1)..(1236): optimal_loci_206867_G1, chr5:212145489..212146724, Cluster 1
tcgtggcttcaacgaaaagagaagagaagggtgctactacttctacactagctctgcttacttaaaagaaaaataaatgcgcggggaattcttgagagctgcagcttgctcgatcgtggtgtagtggcggtttgtttcgctgtcgagtactgcacttggctcgcccgatcggcttcctcaccgtcagtccgtcctggacgggttcacaactttcttcagatgctttcaaagccacgcagttggctgtctgcctccttctggctagcttccagcaggtacggttatgccaaacacagcacaaaggacacatgcgtgcatgcatgcactttcccgtcactgaattattagtttagatcagcgatatgacgcgcgacttcttagtcaaagtgtcaaacaaaagaagcgctagctgattttgctagggcaatccatgcaatgcaacgaggtctcccccacaagaagggagaaggggtgtgtgtgtgcgcgcgcgcgcgtggtgaaacatgcatgcacacggccttcttgttgactacctgtacgtacggtacgtgtttctgttcataagccattccagatgagcagcacaatcacattgtgagcaagtaacacaggcgtcatattgcccaatctgtgcctgtgcacagaagttcgtctgagaccggactctgatttgcttgtctaataactggaccaccctcacgcggagacattcatatgcgtatccttgcatgatgcgtatgcgtcacacataccgtcaccaccgctaaaaaagccttttatcggatttaactgctaaaattctttagttgttccatttgcatggtccagtgctaaagattttttttcatattggttggtaacttcgttgaggtgttgtttggttcacggatggtaatgtaaatggcaacgttaattattcacagcggtaataagtttgaataagtcgatattcattttcattgtgttatctgattatggttgaacttaaacaaacataatttaacgttatgtattactcatcacgttacaattatgttaaccaaacaacatctaatagagaatccgaaagcatcaaaaaaaatcatggtctcacacacacgcacatcatgtcgtagatcacgagtcacacgagtgtgatgctaggattcaaactcaaggtctatggcttcaccgtgttccctacttactactattctacaagcccattgctactatgctataaatcatgtaaatatc

SEQ ID NO: 66 - DNA, 1256 bp, Zea mays
  misc_feature (1)..(1256): optimal_loci_206876_G1, chr5:212159615..212160870, Cluster 1
tgtccaaaacaacaatatgtgattatatttgaggtagtattaccctcacatcttccttgtcagtttgcttttgttaccatcacactcgagatgtctttgttgcaaaaaattgaatgctgaaacacacgcacaccttacaaatctagatgaagtatgtacatacatacatactcagtaagaagaagaattttttttacatgtataaaatctataattcatataacgagtggttaaagaaaattcaaacaacggaccactttagcaacagatcctagcgacaccactggcatgggatgggagcatattcatatgccccctatgagcaaatttaatatactcttactttaatagctacttgtataatgagattgttctcccaaaactatcgataaaaagatagaaactcctaaataaatcgagtagatatctaaacgtgaattcgaatatgatctgtccgtttcatatttgtatttgagaacattcaaatccttatcgcaacaaaaactcaatactctactaatagatatttgaattatatcggtatctattcccattttgacccatggagaggatggtatgtatgtgtcgttctgtggcgaggatgctctgggcggccggagcgatgaggcagcgctggtgccgcctggagagagcacaggggaaggccgaaggcaggatgggagggagggtagcggcgccggcgcggtcagagtattcagcgctgcgtccgtcggcgtcgcgggtgaccgggaaagcagcccgcaggagaaaagcacggcaggtcggaggagccgctgttgcttgcactttcccacgctgcgctgcagcggcgattcgccattgggcgcatcagaatcggcgacgtcaactcaaggcagtgagagatctgctgctgctgctgtgagtcagatgatcagatcagtatcagtagccgggtcaagacttttccctgtcgtggcactgtggattgtgggagcaggtcggtatggactggccagagcgaggctggtcgagtggagtgaacggctggaggagtcgaggagaggtgaggcgacgggatgcgacagtcaagggcggtcgaagggcggcttgaacgctgtggattgtgacacggaacgctcgggcccagtggtggccggctgcgtcgcgtgtgcgtgtgcgtggcggcgccaggagaagcctgtgttgcctgcctacgcagctggaggctttgacacgtcttatccggttgggccggccgcggctgtagaccgtag

SEQ ID NO: 67 - DNA, 1316 bp, Zea mays
  misc_feature (1)..(1316): optimal_loci_207074_G1, chr5:213021126..213022441, Cluster 1
agctagttcgttcgtgcatcatgccatttgttcggttggctgcggaaggcgtcgaagccgagttgctaactcaagatgggccatgcgcttttcagtttatctgtcctgtctcttataagtatatatatactgtcaaagcaggttgaggattcttgttgtctcactttactcccatgtgtgtggctgtctgtctggccatagatatataccatagcgctagctgtacgttgcatgctaattcgcacgatacagtaggggctgtaggcacatgccattccatatatccgtctccccaatacgccgcgcgtacttgtcacgtagccgaaaaggtgccctgtccgtccccgtccgttctatcgtcctgcatggcattgcatgcatcgaccgcgcgccttcgttctcccccccatccactgatgcaccctgtccctcgacggctggacgtacgtcgtcgtccactcacaatactatcatgtgcatcagtgcatgtgatgtgcccacgctaaagttgagagatacacaactgtttattgcaagcaagcaagcaagcacatccggccatcatgttttccatatagaaataactgtacgtacgtacgtggagacatccggtacggtcgtcactcgtcagctaagatacatacgtacgtagctgatgctgatcaatgatgagacgacggacataggagttccatcgatccgtccggcactccagtacagtactgcactgtatacacatctgcatgtacgttctcctcgtccacagtcatccagctgcaggcgcatgcacgtacgttctcctctgctggttgctttgttttggtcgtgagcacccatcacctgctactactcctcccgatcgatccagcagtgcactgtgcacaggggtctcgttgatcctacctgctactactcctcccgatcgatgctcaccgatccatagggttgaaaacggacggaccattttctacatttgatccgtatttacggaaaaatatgaaaaagggatggaaatgggagatggcttattccgtccgtttttgcgggatcacatttttccggattgaacccgtatttattctatatttgataaatatgcgacgagcctaatattcattattatataaactaaagcctcgtgtatttaggtgacaaattatagcataattggccattgtaatcaccgactcttttcaatgacaagtgatataaagtcttaaataacatcggatgtagctaaatgtacacatttagcaaccaaacaacaataaaatgttacctctctatatatatttgttttatgttattgttctgcc

SEQ ID NO: 68 - DNA, 1005 bp, Zea mays
  misc_feature (1)..(1005): optimal_loci_214256_G1, chr6:39647238..39648242, Cluster 1
gccagcaagaacttagcggtatgtttgtctattctgttcatatatatagttttcttcttcaaacttgtatcgtgttactcgtgtattgatacgaaacttgaattctatgtaacactgattttgtacgttattgcttgattgtgtccgtcttctttcttggcctcccatgaattttaatcctacgctcgccactgtatgcatgtgcgcatgtcattgttgacatagatattgcatatatagcattgcaatgtagctagggcagcatatgcagtaagaactaagaaatactgctatagtttcttttgtttaatttgaatgtctagtcaaactagtatagtaccctaagagaagcatttgtaagaggataagaggacaaggtcatccatccatccatttgattcgattttgctgattttattatcgacccagccagagaaagctgtgcaacaaccgggttcaggttggcggtgtgtgcatgcacatggccaaacggtagcaagggacgacccctgtccgctgatcccgggcacataccattaccatgcaatatgtaagcatggagcataaactaaacaagacagctagctctcttcacgcatttccatgctagctaaaaagccagtactattttatgcatcttgcttgcaggaacccggccgtatactgttttaaatttcatttttgcgtcgtttccgcccatgcatgcatgcatgcagccgctgtgcattttcgctcaaatttgaataaaaaagacgcggccatgattggcgcccggctaccagcaaacagatgcaggcaaatacagcagaacagaaaaagagaggaaaatgcgtcatttgggcccgatctctcaaaactccgcatttcatccaaaaccgtcggtgccaacgtggcatgtcacctatgagtaacttgagtcccctaactttttatgcgttatatgacatcggtatctggattgagcaaattcggttttggatgatcggttctgcacacttccaccca

SEQ ID NO: 69 - DNA, 1107 bp, Zea mays
  misc_feature (1)..(1107): optimal_loci_222843_G1, chr6:97921484..97922590, Cluster 1
gatttaggtaatttgtgaatccagtagatcttgtttttgaatgagattcatggtttgtgaacctgttttgaatgagattcaactatatacatatgtgtatgaactctcaaatacttattataggctaacaatgtgtctaacaatttccctttgttatggtattttgttgatattcacacctgtccatatgctgatataccagctctaaaatccattgttgaatgagattcatgggtctgcttgttccctatggtttacctttagtatccctttgtcattcatgttcaaattgttgctggatttctgaagttctgcatcttcatcatgagttacactgttttctgtaattcaacaatggattttagagctaaataacttaataatgtagttagaagtactaaccatagaaaaatgtgaagttattgcaaagtaagattattattgccaatgttatgttgcttcattaaggtccatatgaaccagaatacagcaggagaatattaatgataattctaccaccaccaccaagtgaaattggtagctaataaagtttatgagtgaaaaatgttctacaaaaaatgtatagtcgtagtcaagtataacctggtcagaaatgcttgctgctagaaaacaagttaaaagaacctgtccttatgattttttagtgaactcacaaattaatactatgcttctctcaatacttgttagctctgaatattatgcttctctgtattactatgcttctctgaataatattttctgttgtgcaggatggatggcacaaacaacagtaggggtgacagcacacacccacaaggtcagcctggtggctggtatccaccagcgaacccatcttcataccagcccctccctccccctggctggaacccatacatgtttccaatgcaaggtcagcctggtggctggtatccacaagcaatccagcttccccaacataatgttagcaactttcatcctccttgtggacctgatattgtatcagttgaccccgctcaatggaatgtgggactgggggctgaggtagaggtacttcctccagaggattcaacacattcaatcctgaaacggggaaggactaagttaggg

SEQ ID NO: 70 - DNA, 1033 bp, Zea mays
  misc_feature (1)..(1033): optimal_loci_226319_G1, chr6:115920979..115922011, Cluster 1
atatttatcgattcctttataaaactatataaattttgaatattataagatgataaaaccgaaaaagataaaactggtgccacttaaatcaatgttacgttatcaaaatcgacaacttaactgttaaggaggttatctatctagttttataaagatgagagagttaaacaacaagttttgaaggtgagggggtgaagtagaccacctgtctctaaagatgagaggttatgtagatttatttctaatattaggatcgatctatggacttaacctattaggcttgatcctgccacgataaaaagccattttttttgtaatagtcattgcagctgtcccttgagctacttgtacaaactatttgacataggtggtggattttgtgttttcaaatgattattatttgactacaaatgtggaacgcgatatgaattgacgctaataaaattcaatccctctactccactgcggcactgcctctgcttgcctcttctcggtccaaatcaaagcgtcatcgcattgaatctgtctcggccgccactgaattggctttctccttggatcggatatatagagtggggttttattcaaagaattatataaacaatgaactagagaatgaatttattgaatactactgtagacgcagcgtctgcccgttctgccgcatcgcaatcgcaagctacaaaaggcgaccgtcctccagcatttgccgtagggattttacacggcccggaccatgccatatcagacagacagtcgtcagaatccaggccgtccgagctcgtgctgtcttgctctatccttcctagatcctactcaacgctgcagctctggactgggaccatcgtagccacagccctgccgccgccgtcgtcttgcagcagcgaacaccagcccggggaggacaaaccggaccaccaccacacggccaggacaggcgtcgacaagtcccaatcatacacgctgccagtccttcattctgggctgccccctgcacagtgcgtgcacacacaccaacgttcagcagtagatc

SEQ ID NO: 71 - DNA, 1304 bp, Zea mays
  misc_feature (1)..(1304): optimal_loci_226520_G1, chr6:117109365..117110668, Cluster 1
ttgttggttatcgttattccatgagtttggccatcaactatccattagacgagagaaatttcaagaacaaagtaactaaccttgcaactaattgatttacataagttttgcaatatttgagtgtattatatgaaaacatctaaaaagggagtaaaatggccaattcttggaagcggaatgttggccaaccaacatctatggtcgactgaccaccccttagcccatttgatcatccccctagttgtttagacacctgatcgatccaaatacattccactttagtcttgcatgcatgccatgatgaactcaacacaacttcaaggtttagccacatggacgacacatcaaggacctaaagaccaccacgtcatcgatctggctaaggattggtgaagttagggatccaagggacatctatccaatggccaaggtataaaagcaaatccaattcaatggttgcagaagaaacataccaaataattatcaaaccaacttcaagaaggcttctaaaccgttggatgagcaatggaggggagggaatgttcgaacggccaagtggcttggccgcccggccaagttatggccactcggccacctaggaggtttcctagcctgccacttattcttcattgaattacttaccttccttaatcaaccaagggtgttatatataccctgcatgattagtgagtgtatagatagccccttggagctcacttgagaagaggataataaagttgagagtagatacaccatagagagcttactctcttcatcgtctccatgtagctatggttggtagctccaattgttgacaatgagagtgtgtcatcatgggaaaccttcgatcggtcgtccgagcatccgacacacaagaagttgggcaataagttatggttgtgatcatctctcctgaagcagctctaactacctttgagtgctagaggcagtcgggggttctaggagtgtcacctagcttgacctatcaaccatgtagtgtgtgttgtggttggtgaatcactccacaaatgtaaacaacaaattaaacatcaattctggctagttgtgtggatcgacctatgtcgactgcaccgaatggctctcattagccatttatcatcttttctgagtcggtaacaagtaaaaaatgaaagaaattgtgcattgaaatcgatcgagaggataaacaaaccttcataaagcatgatttataggattattagtcctagaggaacacatgtcacatgcacaaccaaaagcacagaaacgtcccaaaacctatcaatattacccacaccattaaa

SEQ ID NO: 72 - DNA, 1012 bp, Zea mays
  misc_feature (1)..(1012): optimal_loci_227153_G1, chr6:120674055..120675066, Cluster 1
tagttaactacgatgtcattgtgtataggtggagtaggggttcatgagttttctcaacatgcatgagaaggccttctgttgtcttacccttgacaagtcgagttctttaagcattttacaaaccatgattgtttaagtaacaaattatagtgttgatatcaggtgaaaaatgtagatgggcattgcggttatctttagttctctcacacaaatgctttattctatagtggtccactacatgaaccagtagcatcactacaccataaacattccacattcttatttaaccatttgctgcatgttttctaggcaatagttcttaggtatgcaccgagccaccgaaaaattcaacctaaaagattaatctgatggagaaagatgggcaattcacttgtattctaacactccccctcacgtcgaggatctctcaggcctcagacatggaataggaacgagcaaaatttattttattttattgcgctagccaagattcgaacttgagacctctagctctggtatcatactaagttgcatgcatcaactagttcgacccaaatacttaagcagatggagagaggtggacagttcacttgtattctaaccgtcctaacatatccttaacaacatataccatttttaaatcctctgaagacttctttgaaacaaattccaaaaatgcagtatagcaaaaacacatattttggctggaatcaaatgctaagcacatggaattacaattttgatacacaaaacaattgttccgtgagattgacttcatgataaaaggcctccaaaattcatatgaaactatccactcgtttctaggggatataatcttaatttcaaaatcatgattgatattaacatgcactagttaagttgtctatgcattgcttcggtttctatatatcacatatggtttctttgtataacataaactaacatgagctgcaatggttagagacgagtgcttttttctaaggaccacggtttgaatcctagtgggggcgcc

SEQ ID NO: 73 - DNA, 1290 bp, Zea mays
  misc_feature (1)..(1290): optimal_loci_227588_G1, chr6:122647050..122648339, Cluster 1
ttgcttgagggattctatggcaccttgcagacaagtgattaccccttcagaaggtattgtcttcaattcacttggctctggttgtaggaaagaacccagagagagataagtcggttagaaaagaaaatgctagattcatctgttagaagaacgttggaaggaagaggcaatactaaacaaaaaagcctacaacataatacatattgtttttcattagtgtacacaccttctcttcttggctctctagccatggcatagtctttaccaaatcatccatgtcacattgctttatttatgagggtgaaacattttttgcagattctaaattgcatgtctgtacagaaaagggaaaatattgtggagggtttggggggcaaacaaaacatgcaacagaatcatcaaagctcatgtgttccacgcactcatgatgccttcattttgttccatctagaaatatctctaatttaagtcatttctacttagaaagtcagaaacagatagaactgaacaaaaccaataaattttgtaaaaagaaaaggatcgagctagatgccctatcctaccactaccagactctactacttattaactcagaaaaaatactcctctctaacattagatggatgaatttaatgcttaacaaaaaacataaattaatggaaagggtcataagttgtagaatatcctaactaagcttaaaaatttgatgcatagttggttccaacctgaatatacacacatctaaacatgcctcgttcttacaacatagatactgatgtctgttagaaaaacatgatactttacatatacattaaatagctagaatgataaagccgtcaaataattgaagtattcaggtttaccgggaagtatgttaccaatatactcataatatcatattcaaatggccagctcccatacttagaagatgcatcatcttgtcattaaaccatatcatcaaatgtgtggtttttggttgtttcataagttaactttgaacgaaacatacctccatggcatcagaggtggatggcttgacatgagtttgttgaacttgattttgatgctctttgcatgtttccttctcatctacaccaacatagccaaatgaataaattatattttgttaagtgattgatacgtgaatacactgaatttatacaatgaaaatgataagcactcaacgattgtgccttcctccgctgttgttgctcatgcgcctgcatcgctagctccttggcttttgccactctacctacctgactggttgattaggtacctaaattcata

SEQ ID NO: 74 - DNA, 1138 bp, Zea mays
  misc_feature (1)..(1138): optimal_loci_228034_G1, chr6:125018380..125019517, Cluster 1
gcctaacagacaaattgacgcgtctacattgacaatctacttcgtcttcttttatgcttgatcaacctaagcaccgacaaaccaacatgagtcaatatgtctattcagttgtttactgtgttgatctatttgtagctatgtgtagttcacatatcagttttgaatacctatgaaatttgcctcaaattataatctgaatttagaatattacgcaattttccaacacataaagttgagggtatgaatgccaaagcctctcaaacctaatcatagtgagatcataaaatgaatttaacagatttaacacatgcagctaatgccatttaccgaagagcccaaagaaacaacattactagtgtttttaatcatagtgagatcatcaaattaatataacgacccatctaaacaaagtaactggtacaagcttctggcgaggaacaatccacgttcaggtgtttggagtttttattcttgatttcaaccgtctcaaacaacaaagggaacgacaattgtcattttcctgtgactaaaattgtcgagatggccaacaaaccaactgacccatcagagtgtagttgctgcttgtagttgtacacatgtcttcgcttgtcccttgtagtgctgagttgcaggagtgatctccacgtaattaaactatatggctactgcagtaccctgggcattttttggagatgatattttagagctcaaattaccaccaatagcagctggttgtcccctatatttttctcagctatacttagattactacccgatgccttgctctctctaatccctttatttatattttcttccttttctttctcagtagttggctcttcatctaataacacaggatagatccacatctccatatcaatgggtgagtcagtgtacttggctggctcttcatcatttcttccttttcagacaaaccactatggtttgggcaagtgtcaagtgtggtatccagtcctagcgtggtccaggaactgaggcaacttggcactgatggagcaattactggacagacaggcactgggttactgtcaggctactgtaagtggagacatatcaccagaagcaagcagatgcaactccggatccggaatcagtcaatggggcacatgcatgcatg

SEQ ID NO: 75 - DNA, 1062 bp, Zea mays
  misc_feature (1)..(1062): optimal_loci_228962_G1, chr6:129768515..129769576, Cluster 1
caaagactctaaagccgatttatcttgttcttcgtctctgtctcttctatttctatgctctgagattgagtacaacaatctcctctaaaatttttccctatatcgtcccaatcaatgggcgcctcaacattcaacatttaggtccagcttagtatgtgccattgcttgtagagaagttggggcagtatcccttttggtccatagcatcttatatagagatgcattacaatgggggctaccaattttgaaatttcaaatgaaaacacatggaagggagttgcatcttactctggggccaagacgaaatttcatgccacggagaaatatccatgcagtgattaggcggcaagaaatatccaccgcgggaatgaaaattgccagccattttttatgccaaacgcttttattttcagcggaaacgaagagtccagaccagaaataagggcgtgtacaaccctgagacatcagttcggtttttcaagtataagagacgactaagaaattgcatggtacaaatctgagaccttagatcatcaatgcagctaagagacaacgtgtatagaaagtcgtgaagagacgggctcgggctcttgaagagctcgtctcttgtatattttttttcacttaggtccttaaagacccctcaagaaactccatattaaatggagttgtacatgtcctaaggattgctcagttaagttttgatacgcacattacttttccctggtcattgtgtcatcagcgaatatatcaaacaaaactgaatggagggagtatcaattaaaactgaatggagggagtaataaataatggggcacgtaaaaatgcaagagagccggcacaatgcacggtcgatttggcgtgcgctcgggctcagcagctatgccattgcatcgtgcgcgtgcccctaaacatgtaggcggatgtggtcgacattgtgtggacgtctgtggatctgtcctgtagtccccttccgccgcccgccacgttctttttgattgtaccccctgttgttatcgattaatttgccagcaacaacagtgatgatgttgattggagggc

SEQ ID NO: 76 - DNA, 1039 bp, Zea mays
  misc_feature (1)..(1039): optimal_loci_229145_G1, chr6:130257822..130258860, Cluster 1
tgcagtgaggttccaaactttgagaaaatcagacagaacacttagggtgatagcacctcgaatgtcatgcacccagttccttgttgtgagagcatcgtggacactcctctttttagccctagaagagaacgacttgaccagatgaggggccagctgacttagactctggccatgaatcccataacaataaatttgtcttaatgaaatctttaaagcttacaagaatagaaaaaacaaacacattaacaaagaaatcagtggaaatgttacagtgcattgctgtaaaagttggatcatgcatactttgatacaaatatatgaagtattatccaaataaccaatattccattcagtaaactgaaagcaatacaagcaaaaacaaaacacagtttcgtgcagccttattcttagatattttattggtctaaagtttaaaaagccagccaatgtagttattcaaagtgcctaatataattagatatagtataacaaacttcgaagagaatagacatgcatcctccaattcaaggcacgtaaaaaatgatgatacctaatcctgttgcacttatggtcccagatgtctgaacagtgacacttcttgctctgttaaaattaactacagttccttgaacaaggccagaaacatcaatatcttcaacacggcatatctgcattacaagagcgaccaggtgttacaagtagaataaaaaaatacgcgaggaaataatataaagagaaatccttaaacttatcgctgtcatccaagtccctaaaccacctgtttggcagagcttcagctccaacaattattgaagctggactagctccaagatccatggagctttagcccgcgaacatcgagggtgtttgggcaaaccatgtttgttttcatttagatgtgtcatcgtggatagacaccgaggtacatagagtaccgaaaagaaaagactagcagtttgttggacctagacacgaccgggaactagcacgcggccagtgtagtgaggttcatgccacaatgtaataccctacgattact

SEQ ID NO: 77 - DNA, 1359 bp, Zea mays
  misc_feature (1)..(1359): optimal_loci_229168_G1, chr6:130329316..130330674, Cluster 1
cttcttttcctcataaagacaactacgctaccaaaacaatcacctttcacaacctactacttgttttggttagatttctgcaaatcattaaacatttaccattttctttttgaataagttaaatcagaacatacttcttgtcttgtatattctaactgcactactagaatcaaagattctatgtcctcacaaaagaattataattggtgtattacttttaaaatccacatattgtatatcaacatttgagtgggcttagggttgggtgggaaaaggctcttcactatttaatagaacatttttcaggtggcactaaaattggaaagcaagcaacccaaccagttattttgctgaccgatgaaatcgattttcttttgacaagaaaccagtaggtaataaggcttataggttttataccaaggatatatgtttgatattgtaatttgttttcctatcatttgacactggtatttttatcaggtgttgtataacattcttgattagcctacgatttggattttgccctacctctgcatgctcgacctctctagcaattgcctccaggatccctcgcggtagggctagaccacaccctgctaagggttcctttagaacgcatgaatttcacatgaatgatatagaaattccacaggaattagttcaaaaacacagaaaaacacatgattcgggaatttattctttgatccaaaggagacctaaatatttttgttctgtccttactcaatcaaacactgatcactcaatcaaatccgtgcgcagcgcgccgtcaggggcaaccggtggtgggtagtcgtgctggtgtagacgagcgggtagtgggccaacatggtccgcacgtggggctaggtgtggacgagtagcgtcagtcgtagcgtcggccagtgcctgtcgttttgtgtcatcactggcgacagccgcgtccttgtgctcgatgacaccatgcacgcgagtttgggtgggcctttggccagagcttagagggcaagggccatttctgattcgtgataacagagttagagaatacgtccctcctagaatatggatatcacactccgctacaactattggctactgcccatgatattgctgttcatagttcgaacatgacattgttgtttcggttcggagtctagacttcagaaacacaaaatgatttatctggttttgatgattgagcggcgtaattggtgggcgattttattggctgattgaatctgattctatatgttgaaaccgacaagattcggtaaatacatatgcaaccgcgtgacatgacgatgagctgaccatcaaatcagttgattaattagtaatgcacatctcctacatccacgtatt

SEQ ID NO: 78 - DNA, 1070 bp, Zea mays
  misc_feature (1)..(1070): optimal_loci_230344_G1, chr6:135528133..135529202, Cluster 1
tagatgttgatatagaaaaactaaaatcttcgagtttaacaagaatcaaactcttcaggtgctggtatctgtgtaggttaagtatggtaactctaaggttcttgtgccaccgatccttgtgtgaaatgaacaaatggggccaactgagcaaacttggtttaaattggtaaagtttagatgcaatgtattatattttgctagtttgagtaagttttgctagaatgcatcaagtaggacaaatgttaaaacttagttataattggctaaattcaaaaataatgccctattttcactagtttaagtaggttttgctagaatttatcaagcaagagaacaattgagcaaacatagtttctcaaaccatgtttagactttatcaagcaagaatattatgtttgactagtttgagtaggatttgcaagaatcaatgtatttagaatgcattacttactcaaaattcataaggttcccgcaaatagttgcctcattgcagtaatggtgaaaggtcgcacttgcagaaacttaacgtgcatctcctattgttgtaaatgttgcctgcaagtgtaatgtgccatcgtgttgagcattcttaaatacttagaatgaaaaagttggaaacttggtcttacctaaattgtggtatattgatatagtatgaatgaagcatagtattgttgttgttgttgttgttgttccctttagaattcatcttgttgccttagctccacacacagccttgtaaactccaacttatgctctaactggcgatgattgctagccctagattgtcgggaggaagacaagcctgacctccaacatataacctccctagagtcaatcacttcattgaatattaactaccttcagaatgaataaacggaacgatctcttgctgagctttggtgtgatgcactaagccccatgtagctccctgtattgtttcactgtattttctgttttccctattccatgtaactctctattttgttttttgatatgtatcaccctccaatgtaacatgtcatccatcaactaattgcagcggaattcaggtggggatatcctcccct

SEQ ID NO: 79 - DNA, 1273 bp, Zea mays
  misc_feature (1)..(1273): optimal_loci_232219_G1, chr6:144698369..144699641, Cluster 1
ttttaaatcgttttgtaatttaaaggatgctggcgatccagtccggaaacccacatttctgccgtccattgcccgcaaatccgccgccggatacggggtcggaggaccggcggtgaccagggaggcggggaacgacggagtcggtttccgctgtggcatccggcatcccgcatcccttgcacagctctgctgctatctgccgcggcggacgcagaggatcctatgcgatggcgatcacgtggcggggccctagcacggccgtcctttcgaggcggtgctgggcctggggcgctgtccctgtctgtctggctggctggctcgcctgctctctctcctctgactcatcgcaaaatttcttttcctttccctgggtgtgcgtcgccgtcgcgcctcacccactgacccaccctgacctcttggcaccgtctccgcgcggcggcctccgtcatggtgcatcaacggagatcggtgcgccgtgcttggcaggtggcgccgcgtcgtgctgcttgagctgccactacccagaacaagcgcggctcggaagggaagtggggttggagtaggtaggtgttttggttggccgctgtggatgttcccggtcgattcgtttctttgcaagctgtactagttagtaccaattctttgcggccccgaatggttctcgcattcatgaggggtgaatgaaaatgaacgtggtaggtttgggcttgattggctaggagggcccgtggcgggtcaggtggttgttgcattgcattgcatgcagacggaagagttcagcagatcacggttggtgatccgccggcccaggcgcccacgcggccacgcccagacagtagtatataaagtgtctgaacggttggcaagcaagagcaagagcactggttggtttcgcctctttcgtttttctttaatataaagtactgtagtaactgcccacactccgtacgagtgtgtgtaattgcacgggtaaaccagctttctttgcaagtgcgccacactttgtgcctggatttctcgcgtcctcaaacgaaaaaaaaatggcatctcagaaagaaaaaaagaagggagcgccaccacggagtgcccacgcaccacgctcattgtcaaccgatgcgtaattcgcatggtcatgccatttacgtgagcggagggaaaggtggtttcatgaaagtatcgaataatggaaaacaaaaagaaggatgccaccgaggaccgacagtcgagagaactggtactgttgctcttttatagatcttttattagtagctcc

SEQ ID NO: 80 - DNA, 1294 bp, Zea mays
  misc_feature (1)..(1294): optimal_loci_232349_G1, chr6:145533946..145535239, Cluster 1
ggtcatgggacagagtacgaggagaaccgaggcccgtacgccgggcggcgcctcccgattcgcggttcgctgacgtgcaggccgcacaatcgcgcaaccggaaacgaaacgaaggatcctgcgggatcggcgcgcgccaaggccgtgtagcgccgcacagtcgctcgtacccagtggccagtgctctcaggctaccagcaacttaacgccatcccaggaggaggagatcattagatcatatcacgacggtaccgtggcatggtcccgcatgacacggacgcggcacactgaattgccaaaaaaatgcgtgctcgcctgctgggtttgatccggcagaacggcatcggcaagcaggcacctgccgcctgctgggctggatgtggagttgtggactggccgccgcatcaaagcagactgactttcggaaggtcgctttgccatgtgttgggttcttccggttcgtcggagagcctgacgccgactggtcttccccgttgccggctcttttgactgccccgcgcgcgcgacggcgtggcccttttggcgttcatccatcctcactcacggacagagttttccaaggatgcacagtgccctccattgaatatatatatgcccgagcagtaatcatggtccacgaaaatgttaatgaacatttagtgtaaaaactcattaacatatatacacgaaaaggaaagagttgatgttttagagaggattgagacgccgcagcctcttttctagggttgtaggtactcaattcgtgcgtgtttcatcctcacacgtatgaataacgtagagacaatgttgatgttatggtattgattaacaacgaacttaacgagcatatgtgaacatgttgttgctgctagtatgcaggatgtacaactactttcactgtatcgatatactcttcttccaccgcgtctgccggtaacgatctatgatcctctacttctatgttacattggttgaacgtggtagatatgctagcgtatagcgtatatatttttctacaatggtagatatgatcactcgcacaacttgtccctacggactcgtatcaccatcgaggctaatagtgtgtgtatgtatcttccaggtcagaaaattgtagcacatttgagttagtacattgttattgttctacctcaagcaattgtcaatatgatcgacgatgaaaatagaaacatttgaaatgtctcgaaaattgtcttgatttgatcaatccaatacgatttttatagcgattttattaacatgaccgatgaattccttggaggtcttagagaat

SEQ ID NO: 81 - DNA, 1313 bp, Zea mays
  misc_feature (1)..(1313): optimal_loci_232479_G1, chr6:146113131..146114443, Cluster 1
tgagcatcttcgaggacgttttggctgttttgctccgcggcatgcaagtggaataaaatgtgttaaagacgacatcgatatatgcaattcgctgcgacttccattctacaaacttgtatatgtccttaaaatgacttctaaatcttatatggaggagtacttgtcccctccaacaatgcattttgtgggggcacttaataaaaggcactggtatggaactgtcgggagttacgttagaactgatcccagattggagggaaaaaaaccctttcattaggtaaagctcagcattatgctgcttaacagagccttaagttataacgccgtttaaaaattagaagctgccggccgcccggcggcatctaccaggaagaatactagatgtggcgggtcggcggggcgcgcagccacgtgaaaccgagtacgcgacggctttggttggacgttatatattagagcgcaagttctgcggcccgtgctggagctagtgtgatgatgtgctggcctcgggagatgctttcagatgaaaaaatcacgtaggggtccctcccatcccccaatcattttggttattatccaaataatattatcagacgagcgtcttcaggcggcacaaatgatagtgaccagtacttttgtactttatgaaagtgtcagctgcgtgcttttgcgccactgagcaaatgcgatttgtgagtgtacctttgcagcgtagataacacgagggaataaaggacatcgaattatctgtagatggtcgaaattgtgaaattttgatcaatgtagtcatcatttgtaatttttttccttgaagaaatactctctctattccaaactagttaacgctttagctatgaatttagataaatgcaaatagttaacgctttagctataaatttagataaatgcttgctcaggtcaactattcctgggatggagtgagtctatgtgagattcgagcacttcaaatagcttcacaaaaacaacaacaaaagaagcaacaatcagcttctcgaagactggtgtagttagggcctttttggaaccgctttgttatacgttcttttcaacttcgcttcatagtttttagccacacaagtctagatccacaaactcgcttcagaaaaaaaacaactggaattataagaccgtgtaaagaaatgctcaaaaaaatttagtttcagtaaaatttgtaacagtcctaaacatgcccataaataaaggtcagttagcaagaccgaagctatatgctagtatagttttccctttattttcttttggggttgatctaatactatggttcagatagatgt

SEQ ID NO: 82 - DNA, 1307 bp, Zea mays
  misc_feature (1)..(1307): optimal_loci_232533_G1, chr6:146449272..146450578, Cluster 1
gatcctttgaggcctggatggggtcactaaaaaacctgagatttttgagtgaattgatgatgaatttgagagtgtcgaggacaacttcctctccttgtgtgaaatccatggttgccatcagatctcaaatgatcagcacgactccccctacatggtgcaccaactgtcatgcattgttcgaaagtgaatttatgggatagatcccgagatagagaactaaaggtacatgcataggagactcaagggtttaaacatgtttggtctcttagtgtgagataacatcctacatcctttttggtagcggtgtctattgtttatgcaatgtgatcagatgacctaccgtatcgaggcatccttgccctactttttatagtctaaagagggatgatagttacaggacatgtatctaggacgattaaaggatatggatagtaaccaagtctagccgagtctatcccatcttatcaggtagcttatctctatgtgtacatgtgtttcactcttactagttgggtcttaccatatctatatggatatcgatcttatattataatttgctaggatctttaccatgtttatttcctaaagctttcttgcggatgagtatttctctgatatggactgtccctatgcactcgaccgagcccatgaccccacctgccatggtcttttttcgcggagtcgtacatggataatcttagtatatatatctttaacatctagggtaggaggagattttggattaaaggcccatttggttcagcttcccaagccaaaaatattattaaaaaactacattcccaattaaagcgatgcaaataggtttataaaaatccacaaatttctctagtccaatccagaatctcctcccaccttagttttttagattcctaccattcaaaatttccaaatcactaacaatttagcattatttataagattaaatcattttcttttctatccaaaggttccatctgactcatcgctcggctcccacccgacgacacttcccaatgatggctagtgttgcaccaactctctacacccgactttggtggtcaatgatgcgactcaaccatatctaaaccgtcacacctcctccctagcaatctttaagtgatggcacaacatccatgttacatatacccatatgatgttgccatgttgcctcatttagcacctaccagactccactttgatgttcggtgatggcgaggctctatccctattaaaacgatgatgtagcacatatcactttagctattgatgtagtcgtgtgtgctgctcatgtaggatgctatgcacgc

SEQ ID NO: 83 - DNA, 1356 bp, Zea mays
  misc_feature (1)..(1356): optimal_loci_232692_G1, chr6:147017645..147019000, Cluster 1
gactcagcgtgtgcgctctttatgtatgccgcgcgctcaagttatctcctgttggtgagcaggcggcacgatgccgaccggtccagacacgaagattggcgcagcaagaagcatttgtgtgaatgtgatccgggccgccggttccgaccgtatgggggcccagcagaggcgagccgtggtgggcacgcgcatgcgcggaggcggcggccaacatggcgagagttgttaggtcgatctcgctgcgccagctgtcccggccagtagtagcgtagcgccagccaggattgcatgattattgatccctcctccgtcccaactcccatgttttgcacgaactggatacgcatggacctggaccaggaccaggccagtcgatcgtccgtcccatcgccgaccggacggacggacgtaaaagaaagttaccagaggaagttcacctcctccgggtcgggtcctgcttgctgggcacaacgcacacgctacgcagcgtccggcgtccggcaagggcatctccccttgacagctaaacgcctccccgcgccgcgccaagcggagcagatcagatacgcgcggcgggagtggacgtggacccccaccccacccggcccggacgagagaaaaggacaagctcagattctgatctcatccaccggcatccgcctcatcggccacggccaccactcgcccccggcccaatctgtgtgcgcagtggccatggaccccatggtcctagtgctactgcatgcaacagtggcgcgtcctcctgtcctgaccgcagtccagttcgacacgggcgccgtctgccatgggtgtctatctgccggcagccttgtgtgctcgatcgactcgcatcctgtatcaggcagggaggcagaggcaggcagcccggcacaggagtgtacctttgcctcttctgggattcggggtatcagagaatgggagggtacattggtcgggagagtcacgagctgcctagcctactgtactctttattttatttactcgccagaattaccgcaaggcattattgtgtttccggtgatggtttgtgatagttttttttttcgcaacagtggcggcgctcccactcgcagcggtggcggcgaccgcaggcaaggagggctcaagctgcggcagtgccctacggcaaaggcgagggagagcacgtgctgcatttcccactgctcttcactctcctctccagctctcccgcaacaccaagaagcaacagccagcgacaatcagcaatggccatgtctcagcaagagaaccgaatatgcatgctctcttatcttcttactactgttagctaaggtcccgtcgttctattcctgtgttgataatatatgtttgtaa

SEQ ID NO: 84 - DNA, 1205 bp, Zea mays
  misc_feature (1)..(1205): optimal_loci_232881_G1, chr6:147891628..147892832, Cluster 1
gatggggagagagcaacaaagatattcatgtgcacgatctgctaggctgctagcctaaggctgatatggcttgtcagcaatttagtagccggcagaatactattgttataattctttgaaatgcgattgatagttattcgttaaaaatatttaacgaatattttttttatttgtatggctgtgggacactggggcggggccgcggagggggagggacggtgctcgcttgacggatgcggcaccggcagcagcagcagatggccgctttcatctgacgggaaggcactgaattgtatggcgatgcggcaggagcaggatgccttttatagcactgcgcgcagaggctctagccagtcagggccagccgggccgggccggacaggcgcccggccgtccgaactccggcggtatgggcgcccgcggcagctctgtccgctactccgctgtggacagtggacgcgacgccacggtgcggctgtacagtcccatcggggacggcagtgcccagcagttgcacaccagcagtccgtgactccgccagcgccagtgccaagagtggcgatgggaacaccaacggcggcccggtgtcgtgaccatggttagtagcagtagcacagcacggcacctgaaataaagaatgcattttttaagagtggtgctagactagctgctctgtcagtttgataatatttgaacacatcaaacagtcgaatccgtgacctgggcttgtcgtatccaataagaattttacaagattgatttcagcagataaaagaaaaaaactcttgaagttgaagtgtattgatatcctcaaacagtcgaattcgcgacctacgcttgccgtatctaataagaatttacaagaaaatctcataattctataatatcatgtttggatgtagatattcaagacccaaattattgggaattggaataaggatttctgaattccgatgtttggttgtctaatgaatccagagctaaaattaaagctcaatttcatggatttggactttaactaaaaagcgtcccttccaattcagatccaagactctatgtttttggtggaattaaaacatccaaacaatatatttgtattgaaactcatttccaatactagaaagatttggtattagatctaattcgatcctaacatctccaatatctacatcaaacagaccctaatcgctttcaagcatcgtaga

SEQ ID NO: 85 - DNA, 1180 bp, Zea mays
  misc_feature (1)..(1180): optimal_loci_233136_G1, chr6:148814677..148815856, Cluster 1
agtctcacatccaatgaaaagcttggtgcaaggaaagataaatgtatcgagagaacacttcaaagagtaacgtctgagccgacgatgtatttacatcgataaattggttacacttatcccgaatccaaacatttgtctcagattcacggtaactactgtagtagatgagcaaatatgagcatcaaaggaaacacatgagagtgtgctggcaacaaagataatacttttgtacgacaatcattgtaactgcgatagtagatgaataaagccaatgaggcaaagacagcctgcagatatgatccatggaacacaggtattgataatactgccaagatagcagagatagtatgcccgaggtaactgtaatcccatattttcatgtaccattttacctagaccgcattgttccattcagatgctgtccactgttaggtatgggacatgccagcatatcagctgagatttgtgatacttgcaaagttgcagtcttcacaatgtggcagtacaataagaggctcgatgttaaaatatatttccagaaagtaggcagcacgaaccaagtaaccaacaactagaagatgaccatgcaatgaaaagtagtagatcattgttgagttttatgtctcgaagccttctgagctaactgtgttgcaggagtccacttagcaacgctcggatcttttacaccatgaggtggctgtatggaacgagcctagttacaacatagttaataaaacgtcgcctaaatagtaaggcgccccaatgacgtaaggcgctgtttgccttactcccacactaaagcgagtggaagagagagcctaggactagcatcgtggcggctccggcaaagccgacacaagagagagggagaagtgggagagggagacgcaggagaggcgattgggaggagggaggcggctcaagatagaggggaaaagagaaagtaaggttaactcaattttaataggctagttggactgatttgtaaattgattggactgactaggctagtcttttttctttatctttttttatcaatgtttttatcttaaatactttctcaaatatcaacattttttctgttttaaaatatatttaaggcatcacctcgccttatgctctatcacttaaaaagtaaaaagagggtatgttgccttacctcgcctcgctgtcttaacaa

SEQ ID NO: 86 - DNA, 1406 bp, Zea mays
  misc_feature (1)..(1406): optimal_loci_233177_G1, chr6:148950009..148951414, Cluster 1
attattagtagcgagaaatggtctgtccttctgccgagcagaagtcctattagctttgcttcaaactggaagaaacaaagaaaaagaaaacgacatctcaatattgtattaccgaatctagcaacttgtgtccgtcctgcctgccacctgattgctcagtagcgtacaccaatgatgagttgaattaagcgctgggaggcagcgttagggccaggggcgtcccgtcaagttgaaaggtcatgcacaaaaggtaacaaaaaaaataaaggaacatttaaaataatattattgttcctatcatttttctcatttttaccttttgtcatgatttttacctatttttacccttcagctttacaaaattagaacgttacaaggcaacttttttgtagaataaaattttaaaggaaactcaactcatgtcacttgcattaaattctattgtccgtctcttttagttgtatcttaagatagtggcaacaagatttcaagcattttttatctagtgactgcattgcactggagataaataagaaactatattttttttttgataactttgatactattaaaatcttcttataagtgaagaaatagtttgatcaacaataagaacgtttttgcgattctaaggtacattttagtaaatatttttacacagaataatatttttatctataatctctatgtggattattctagattttaggcccctgtaattttggagaaaccctataattttaggggccctatgcggatgcacaactcgcacgcccacagggacgaccctggttaaggcacgtacaaacttgacacactagttcgtttttctaagtataagagacgactaagagattgcatgttacaacactgagatcctagatcatcaatgcagccaagagacaacgtgtatgaaaagtcgtgaaggtctctattgcatattttttacttagccccttagagacctctcaagcgacctcatattaaatgcggttgtacatgccctacaacatagatattacgttgtggttttccaagcactagatacacctaagaaacccttcatacaacctaatgtatctaagtcttatagcttattcactagaatgtctcaagatacgactcatttatgtaggttgtatgagtagaatcttatctagacttagagaaccgtgttagagacgttactttatcaagatatcgtcttttatgtttttgcacttacccccttaataccccttaaagatacgggcatttatgtaagttgtacatgcccttacatctcaataactctacttttttgtggtaatctatttgtaccggtaacctacgggtgcagttgctcaaaaaatgtttttttttctagctaccatgccgtgaggcgtccgtgaaagtctgcagatcac

SEQ ID NO: 87 - DNA, 1061 bp, Zea mays
  misc_feature (1)..(1061): optimal_loci_233300_G1, chr6:149368872..149369932, Cluster 1
gacccgccacatcggatcccagtcggcggccttgggcctagcgggcaaaggcactgtacgtctgtacctcctggataagtcctggcccattattatattattattattattattggagcacatatctactccgttttctcttttcacaagtgtgtgcaatccatgtcacgtcacgctcgccagccatcagcagccacaaagaatcagaatctcggaagactgtcatcagccggattagcaaaggcggtcgcttttgttattattatctacacggttccttcatctcatgcgcaatttcgcttaagaccaaccacccgattcgttcgtccaggacgattcacggcgtgggcacgtcggcacgttcacgagctcacgcttcttaagaaccaaacaccttttcaattctgtattgaaaattatgctagtatcttagaatctctctataacctgataatgaaatttgcactagattgtgtggactatccagattctcaaaatctgctatgaaccaactgccatcagagttagaagctatatcagatcaatagctccttagaataaactaaaagaaagcaataagtaagttgtttttcactagcttcttagataagttgtcttttttttcaacaaaaaaaacagctatgctaaataggtccatatatatctcaacttgggattcaagttttcttaaaagaaatgatcaatgtaaacaccatatttagaggtgtttgggtcttctctagaccaccatttttagctttgctgcaacatctccggcgtgagtaacttcaccatagagtttacgtagtttttaaattaaactgtttggtttatatggtaactctaactttataaataaagcttgagatggccttgagtggggaaacgagcaaagaaaacaaaacaaaacgaaccggttaattatttgttcgttcttttgttttccatcacttctttttccaatcttgaagtgaatcccaatttgacaatctgatagaaactgcaaaacatccttattaattgaagcatactttgagatctaaaaatctaactaaggtgaa

SEQ ID NO: 88 - DNA, 1343 bp, Zea mays
  misc_feature (1)..(1343): optimal_loci_233584_G1, chr6:150696906..150698248, Cluster 1
cgcatgctttcggtagaaatttgtctttgcgggcggaccacatcactacagtctacagtctacagctccgtccgctgagggcgtatgctcgggaactgggagtagctggtgctggctgggctaatctgaatctcgtcgccggcccacgatagctaaatttgcccgcacccactcgtctgggccaacgcatcgcatcgaccaaacggccggtgagagggaaaacgcttcctcggcgagaaaccaacagcccatagaggcccaactaaggttcctggtgctgtcggcccgcgctgaaagcggtgccgtcggcgggcggcactgcaactcccacggcccgcaacaactgcccctcgggcctcggtttcgtcgtcgcaacagggagaacaaaaaaatgagccgcacgaccgccaccaagcagcgcagagcaaccgtcgcgcggctcggcctccgctgccgctgccgcccttcgccacttcccttccgattctgccttcctcgcgggtggctgtcgcgcgcggctgtttccaatagcacatccctacacgcggctctccggttctgggcgtttggaatccgtctcctgtcgaggacggcgtccggcaaagcccctgatccgatctctgacgcctgcacaaaggaagctgatgctgccaattgccgctactccgctccgcgggacggacgcagcggcctgagacagcgagcctgtcggacgaagacggcaagcaagaggagaggacgagttgaacactcacttggcagttcgcgcgaagcaatagaaggcatcaaacatgccaaaacagacagccccacctaccaattctctttgttctccctcgagttgcttccacgcgaaggcaaaaactctccagctgtaccaacacggaaccacgaaatgtatatgttacacggtcttgtcgtcttgtcaccatgtcgtagtgaaaacgcgacggaagacgataaaggaccttcttcctttacatcaatccaatccagctctatattagtataaattagaattaaatctatatcataattcatactctaaaataatctaagccaacttatttttttgtttagttaaatccatcgtgaattataactcaaaagtttaagaattttttaaactatagaagacatggattctatctatagctcactaggtatgtaacaaatccattaagaaattgcaccaatttatagtggaatccatatatcaaaagaatactagctttgaaagatacatagattaaatgatggatttaatcttaccataagattgagtgtgagatatggattcactcaatctatacccggatttaaatgtatggtgtgatttagcg

SEQ ID NO: 89 - DNA, 1120 bp, Zea mays
  misc_feature (1)..(1120): optimal_loci_234908_G1, chr6:156841795..156842914, Cluster 1
gcgtagctccacatgtcagtagcagggccgcagctagtagtggtcctccgtcctctcctgcagggcccagccccggggggactggggagatcacaaagcctgcgccctgcagatcggagcaggcagggaggccggccggctgccgaaatcggtctgtgtggcagtggaggcctcgcgcgagcagtgccagtgccagttatcggcagtgctttaaccatcttggcagggcagggcggagggatctctttttgggacggccaccgtttgcttttgccgagccgagcctggacaagcgcagggagtctaggggaggaaagcgaggcgagctgtacaaaggccccccttttggatctgatactcttttgctttgctttgctacctagggtttgcatcctgccgttgatgctgttgagacgctacgcctacgcgtcgtgtagcaagcaaatctatggcggttggcacggccacagctcttcaaggatggagatccactggaggcatcagttgtacgctttagccctctctcgtcctcgtctcgcgccgctcccaccaaaaaaaaacaagatgctgggtgagggtgcacggcgccgccgcatggcattggcatcttcgtactgaggacggccgaaggctgacgtgccgtgcctctgtttgattctttgcagcaacaaataccaaaaaaaaaggcttcatgtagtaggactggtagacgcaagacgccgtaccaccatgcaagtatgcggaggtaggatccaaacgggcagacgatcaggtacagattgtgcgtggccggatataggagagcaaaagaagcatcaacaagctagcagtcattgatgaaacggatcctctctctctatcctgtctctgtcttaaatgaactgctggtggtctgcatgcactgaaccagagcccggagccccaggggcgggcctagaatttggacaataggtattcaaaattttactagagcaaaaaaaatgttttgatagcctaaatctatgttagtagccttagtcatatataattgatggcctaaagcctattagagtagcctttagatatatataattgattagcatgcacagacgagtagctctttcccttgaacctcggcgag

SEQ ID NO: 90 - DNA, 1313 bp, Zea mays
  misc_feature (1)..(1313): optimal_loci_235233_G1, chr6:158395897..158397209, Cluster 1
gcgcgtggagatgtggggagagagcatcgctagccggccaggacaccacgagcccggtgcccgtgaacgtgccaaccaaacatgccgtatatgcatggtggcccgggcatggcatgggcatcgccgcctgcacatgcacagcactgtagctgctgctactatagccactagctagggtttacatcatgtagtcctcctatactgttcagcaatcagcagcgcggggcaggtgcaggagcgcagtgccgtgctggcgctgtgccggccgtacgtgtcgttggtcgactcacgcacagtcacatgattacgcacatgctggtcctccctgcgcgcacctgactgactgtgactgcgatcactgctacccaacaaaggacgacgacggtacaaacgtcagtatcgagtttaaccgctcacgttcttatagagagtatatcaatatcggatggtgttttataactgggattaatgtgtacctcgagttaacaataaaaacagataactctttattaccggttcgacccaagaaataataaggtgccgtttggttcataaaatattacgtaaatgataatgataatgattcacactcgaatactggcggtaacaagtttgaataatacgctatctatttgtagtgtggtaccgattacggttggaattaaataaacattattagatgcctttttcttagtttctgtccatttagtactagtttttttgtaagaattacatgtaataacaaaggacactttgtggtttccacccataggtatatgtagtatttggttctttataagaacaagtacaaagatgtccctcctataactttggacataggtatatgtagtatttggtttccacccataggtatatgtagtatttggtttccacccataggtatatgtagtattcatcttaaagtagttgggtctagtgttattttaacaagtacatccattctttaccttaaccttaaactctatttttttagttttatatattttcatagaaatccttccaagatggatccttgtgaaatgtaagagtatttgattcatggactagcccttattcagtagcgtactcaccaccatctcctatttcaaattccactctataaaaagtgtgatttgcgacgcaaaatagtgttttacacggctatatgcatgatctgcttgccatagccttaggaaggaaacgagaagatacacccaactaggcattagggctctgagtgatgttccagtaaactagcccttttagggctataagtgatgtccaagttatatcaattttaacctttagctcta

SEQ ID NO: 91 - DNA, 1150 bp, Zea mays
  misc_feature (1)..(1150): optimal_loci_235251_G1, chr6:158489036..158490185, Cluster 1
ctatttctggtgtcaacaggttgcctctcacgttctaaaaaaaagaaaaaaaaaatgcagaaacgacgtgccgggtggaatagtcggagtgagagcacccggcaggaaagtactctcctaccgacttggagcctgtcccttcccttcttcacaataccctgcatatataaaaacaatcccggccgggagggcaggcaagcaaggcaaggcaaggggcaagggcatcgatcctctgctgttcaggaaccccttttgctcacagtcccgataccgtttgtgcaactgatcccgcggccacgtcgccagtcggtcggtcggtcgcacagtagctggcttgctagctaccgagatagatcccgtcgcgtgacagcggcggccgattccggatgcccgatagatgcctcctcctcctccggccgcccccacacgaaaggaaagcagccgctgacgctgatccaatccatcgagctgccgctgccgaccaccggcaccggggctgcctgcctagtcggcaaggcaaggacggcgggagagcgcgcgcgcgcgctgtgaagtcgcgacctcgggcctagccgggatggacctggtcctggaccaccgcgcaacgcgcggtgcagcgcacacgcacgcaggcacacccctgtgcaggcaggcccccagctcggatgaaagccacgcatcgcctcctataggcgacgaggacgtggctccagcctctactagctaggctcgcgcggcatggccatgagtcaatgacgcgggtctcgtgatcgtgagctagcgccgccaacaacgcagtgcatcacgtaccggccggattcccagatggggggttgccgggcacatcaagtatacgtgcagaacacctataaaacaagagttataggtgttgtataatgtaagtgaattacccgattccttacttaagtttttggattgaattggttggtgtatacaacttaatataatataaaagccagatgttacaagttcgaatcctggctagaacaattaaataaaataattgttgatcactcatattccacgtctaagacccaagagaggctatacatctaatttggttcaaaggtaaccggtcttactcgattggtcgtgtagttgtttggtaaaaaaaataacgtcgtcttag

SEQ ID NO: 92 - DNA, 1030 bp, Zea mays
  misc_feature (1)..(1030): optimal_loci_235522_G1, chr6:159691861..159692890, Cluster 1
cgtcagaaagaatggggccggatagatcatagatgcgaggtttttaccaagaaggataacagtcaggaggactagctagactgatccggcgacgagatctacaatgaaattgttttagtccactcgaaactttaaaaattttctatacttaacattagatataactaagaggttatagaaaattgagggggggggggtctacaatgaaattgttactttgccctcctttggatgcgcccatgactcaaagcatcatgcatgtgcagaatcaggtacatatgcaaactaacaaatgcaaaacacacgagatctcatgggcacccaagactgcattgctgggcaaatctcctttggcagtgtctctgcacgcaacgctagctaggtcatcgacgaccaggcaagttactgccagaggagacccaacccggtaatgcatgggccccgcggccgcatccgcagcttgccctatctaatagtacttgcctgctcgatcgatcgatctactctgctgagatttttcgtgtccgaggttccacgtatatttatagccagaggcggcggcgtcacgcggtcgcgtccagctagcgccgcccggcccccaatgggtggatcgaatcggcattgttctggcacaaaattattttactgtattatttacaaggtatattttatctccaaatatgcatcaggtccgatttttttttttgcacttgctctcgtccaatgatttcggtgccgttcacgttatattttatgatttgttggtcgactctggggtttgggcttgatggatctgctagctgcttctggaatctggacatgcctgtccggggcggcatatgctgcctgcatgcagaataacaggaaggaagcgtggagaaacttgtgcctgtagcttcgtctcgcagtggtacggtacggtcgtcaggccataaatataagctagctttttatgtttgtaattcattcacgcatgcatggatgcatgcaagatctctgtccgactgacgggatgtgtactatttgtttg

SEQ ID NO: 93 - DNA, 1131 bp, Zea mays
  misc_feature (1)..(1131): optimal_loci_236509_G1, chr6:165144103..165145233, Cluster 1
aaattagaatattggagctcgaacgatttagattttgaaaatgagaaattacatgatatgtcaagtccagatttaaaagctaactgcagtgcagaacatttatatgcttcgctgttgtctcccatacctacccacacacacaaagttagagcaacatgtgttttggcacaatatacatgaagtagaattcaaaagcatgatgatcacgtaacgagttggatgtcgtgttgtaacatgtgggcagtggaagtaaagttttaaactaggcgccatatgctgttctgacacccggccgcatcggcctctcggatcactcctcgcagtggcaggcagccccacccatgacccaccgccgatcacccacgcagcgggaacagcagacaaaacaaaccggagatcgagctgccaggttatactgatatgcatgatcgcgctcgtggtactggcgctatccgccatggctagcagccgcagtggggcggcaacggccggcggcggcgatcgaccaattaatatatatatacattacagaaaaaattgtttcgatcacttgaaaatgttagaccagctaatcttgtaatgaaaggttgagccgccaatatattttaagaacatggactcaacaccaaatataaaacgcgaggtcatcattagctaattaatgtgagaataacaagcaagaaaggtatatcactagtagccgatggaaagaccatattttgaaggcctccggcggcttaggccgacaagatccaatcctctaaatataagcaatggagacttccttcctctatagcctgcaccagcacatatcgatattaaaaggcatggaattgaattgagttcaattataaatcaaccatagtattgaaatgagatgtaattctaattttattgtatagacgtcatgaattatagtttagaattgtgaggtccaattccacttaatatgtaggagtgatgctttgtaccgggagagtgagtttctagttatagtccaattctagggaattgtgtctttgattccaaatctcaattccatgtgcaactaaacaatagaattctaaaaagttgtttccaattcataattccgtgctccaatatctataaccaaacgggtataaagtgtca

SEQ ID NO: 94 - DNA, 1286 bp, Zea mays
  misc_feature (1)..(1286): optimal_loci_237011_G1, chr6:167949139..167950424, Cluster 1
acctaaaataattcagatgcacacacactaacccatcaatttcaaagaaagaggcatttcagccttaatcaactttgtagcatagaccaggatatctttcttggagttgatgtagttccgtgtagttactacccttgtccgaatctgattaagatcatttatcaatctagtaatccatgaaacaaaaaccatctctaatggttctctttacagagaatcaatcaacaactattagaatgggagaaccaaacctcaaactctacagtcttcagtttgagtgttagtgtctttcccttcaaaccctccttttgcaaatcatcaaataaattttctacaatggtagctgatagaagaaattgctaatagagcaagtagccttctgcagtgaaactaagttgcgtaagcatgggagatctgaaattctaaattgatggcaagatggcaacaattgagatgtgtggtcatcatgcctttttttgacagaaagtataatcatcaggcctcagttacacaaataagttaattaacaaattccatttttctctttggtggacacattgtcttttgttaggaagcgaagagtgaattcatatgtttttgtggtagctcagaagagtattcaagttctgggatctggagacatttgagttgattggatctataggacccgagatacattagtattttgagctgatgaatcataaatttttattttatttgtatttgttatgctaagaattttagcattattttctaaataagtagcttgggtgggtatctcatctctatgttccatcgaaagaaaatggaaaatgaaaataaacttggatctccctatttgatgctacttgataccagtaccacaaacaggcatatgctaatgttttgcagcataattcggttcatttggcacattttttaacttatttatattacttgtgtttccatcaatatttaattcctctagattaattctcgtgcataacatgtcaacaaccaacatagctcgcaacaataggatgtgatgtagcatgtaatgcataaaaataatcaaagtagtaagctaatgaccaaaccttacaacactcttaggcactatgttaaaggtatctttcatctccttattcttatagtacaaagcagtattgactcctcgcatcttgaattgtgtaacaatctgttgggcaacgcatgcacatgatttaatcatagcaacgcgtaatagtttttcctgttaaaaaggaagggaaacgaagaatgtgatgttcactcacatttgtgagtct

SEQ ID NO: 95 - DNA, 1393 bp, Zea mays
  misc_feature (1)..(1393): optimal_loci_237734_G1, chr7:3176202..3177594, Cluster 1
ctgcatgcgatgcgagtggcgagtggaggaaaagcgcatgcatgggctgtagctgctggccatttgccatcattaccttaatcaaagttgagccacacggtatgggcgcgaggtgcatgcatgcagtgtgtggatccctagctagtctcccctttttctctcattatatatagcaccagtcttggatcgtttgtgacactgcatatgccgctgcatgcttggaggccttggtcttggatccctaaatacacctgattgatacacatgcatgccgacatggtttaggccgggttcttatctgttatctctgaactgaaccctcgtgcgttcaataaattaatggtccatatatatttcatcctagataatgctgttactgtcaatgccaaattaagcatactatactgtagcatgcatgcatactgggggacaggccggattccacaaacaatgggacaagcaagagagattctttctcaatggtggatcttattaggaccgggtttagcctgacacagctcctactaagtcctaacactctgtccgaagcactaattattctacctacctagctagctaatagagacctccttacgtaattaatcatgtgaagaagatagaatatctgtcttaggatgttcccccagcatatgcaactgtacatgccgccattgctagttcagctcaagtttttttttaaaaaaaagaagtgaaggtaggaacaaatgttaggccatccgcaatcctcccttttgacaaaccgcaagaaacaaaagcagaaaaataggcgtttaattaatctccacagcaacacatccacaccatgcatatgcatcccaagagctagtagcatcatgccatatgtgcagccaatgtttgatcgaaaaaagattgcagccatatatataaatacattgttccttttggtttggggccggagctagctgccctctcagccatggcaaaagtccaagggagctggctggctggctggctgcataggggtggcccagctgagcctgtccgcctgccaggaagtagccaagcatgcttaaaggggatggtgaaatggtactggtacctcccaattagaaacagcctttcatctctctctctctctgctggcccccccttcttccctgcatcattcatgagaacatgctattgaccgacatctctcttttttgtctgcagctagctgttgactagcgccaacattcaaaaggaagagcgcaaatctatatatcagggtatagaatctatcagcatgcatctccaagctaataagagctagggtagatgatcgcttcattgtgtggtttgcaagatatatatacacaccgctgctagctctccactctctgatctgtttttgagccacgcgtataatata

SEQ ID NO: 96 - DNA, 1051 bp, Zea mays
  misc_feature (1)..(1051): optimal_loci_240342_G1, chr7:17492110..17493160, Cluster 1
cgcgtacaatctcgcacgagtctagccagtcgcgcgttagatgcaaccaacataacttattttacgtctgtctatgtagcccgcatttcatacgtgtagacaaccatacacaaactcagagaaagccaagtcatatggtgaccctggatgaggcggtgcatgtaaccatgattctgactctatggtcccaaagtggcagaacacacgccactaccatcccaaatagcctcagcgtggcagtaataaatagcgggtgggccgtgggcgtgggctgcacagttcctgcatttgaccgcgtgcctgttttggttggcgtacgtatgaccgatcggaggacactagtcactagatagcttggacagaatgggacgccaggatttactactactgttgcgcgcaaggtttcgccgtctcatctttaataacataaacttcatttatttatgtcagtcagtcaatgtatcaagagcacagtcatcacctcatcagctgtctataaaaaaaacggctaaaatctgtagccaaaagaggagatcctcaagcgctcacgttgtactgagtcgatgcatggttcatctttttcatggtccattagtgtgtgtttttctctattaatctgtttgaactgtgaagacagctagattctttagatccctgaagatactactggttatcagttaataattgtttttatatctaaacagatactacaggtaatacattagtacagttgtcggaagaacagactaatctacctcgacgacgggggctataggcaacgacacccgctccgcctgtgcgtgcccgtgcgcgcttcaccagcaggtcgtctcctctcactcctgcgtgagagagagagagcccggtcaggtcaaacctggcgccccacatgtcatcctttgggtaggggtacgagcaagaggcgaaccggcgagaatgcgaatccaatgcgctatctctctcacacacacacatgggcccggcgccgctgacagtaacagcagcagagcagtacgactcctcgagaagatgaggagtgggacaaaagtaa

SEQ ID NO: 97 - DNA, 1067 bp, Zea mays
  misc_feature (1)..(1067): optimal_loci_242236_G1, chr7:27697713..27698779, Cluster 1
tatatatgacatgtatggtgttctcattttatctttctgattttcaaccgtcacggcactaaaattctttgcaagtgccttcaccagatattcttgatagatgttcctgtaaaagataagttaacacacttaataaaaaaacataaacaataatctgagttccaaataaaggtaaagaaaatacatgtttaacacatgcatatacctgttgggccagatagcaacactcgttgacaaagtgaagatatagcttttgtaaacctcaagtagttattgcaatgtaaatgtacatatgccgatgacaggtttaacacatgctttaacaagtgatgtagaaatgtgtacctcttgttttcgttttatgaaatttactttactggagggacgaaccctgcattgcaaacaggcgcagctgcgacgcctgagtcctgactcctgagaccatttgcactgccatgcaggaagcctctcacggtaaaagcagatagagagtaacgtaaaacatgtatataagaaaattcttacggcatcagtgtcgtctacaacaaaatcatgtgttatatatagagaaaaaactagatagatgttcgtgcattacgacagttctatatatcaatgtaaaccttatttaaatgaaatagttgtttaactacgttccaaacctttgtaatgagcatttgaaagtcccgagtggtttgcaaggattgtaagattataaagatcaagtacatgtgttgtcctcatggtcctttgatgaatcttcttcagctgatcgttgcctatgttctgatgccagtatgtgttggatcaataggtctggaaagtcaaagtgccagagcttgcctcttctcttgtgaggtctcaactggagctgccaaatatcaaacaaaaatggatgatgctgaactagaaagacaaaatcgtgaagaaagtagtggtgtacaaatgtctccaccaggccaataaatatagcatcctaaccaacatatttctgttgtttctccactatgtggagagtatagattggccgaaagtagagatgacaaggggtcagtgaaaggaacaca

SEQ ID NO: 98 - DNA, 1295 bp, Zea mays
  misc_feature (1)..(1295): optimal_loci_2424_G1, chr1:12809266..12810560, Cluster 1
cgtagagagcacactttagtttggtgacaataggagtttccattaacatactagtggcgtcgataaagcatgccatggatgcaccatgagggcccagattacaatatctagtctatacccttgagcacccaatagtgtcattccctagtgtttttgcaaagcatcaactagcatctatattgaacaactcatgctacacctagatgccagtggaggcaaatcttgaaggccttcagccagcgccatagtttctaccagaagcactagaggaggatatgttatggagtcaatgatgaagttatttaggttttatagcccaaccatgaagcataaagagaaaaataatagtcaagattcatgacctacatgagttacgagcataacagtttggtggatgagacaaggcactttggattcccaaactcaaatatctttatctataataggacttaatagcacacagtaactaaaagcctgaagtatctactcatgtgtagatacctagggggttgagccctagggaacacaacttgacaaacctttagcttgaaggcacccaaaggattgagcattggactggcttgccattgaagtcttttaggggttgttgttgtataaactcagtataccacgccactcgaacatcatcccattaccacaagggtgggccaaagttgttcaagatgaggcctagtcaaactaagatacatcattagacatgcagaacaagtgacctaatgtatagagtttagtcgtcgacttctatgggatatggtagttattgttcttagattttcttgtggttaaatagaaaacatatctacaaatcaatcgagatgttgtaaccctaccctatggactatatacgacgaggtagagagcctccgatcgacattgtgacatactcagtgctatgctgcatagacaactagtcttagacaacaccttataaactcgagcatataagataagagatttatttgcaattggacgtatgatatcctataactaaaccagtataagtttacttcacgtttgttgtccttctaattccttgtatctgataaagtgatctttgttatcagagcaaatagtttcctcagaccgtttggtcaaaatactaagacaaccaattaagcagaggcggatttgggccccgggccacctgggttgtggcccggggcgcagcccaaaagccctcttgtatataggtttttttagctaaaaaatcttggttaaaatatatttcagcctaaaaatgtggtccaaaagacctcctgcttgcagcgattgag

SEQ ID NO: 99 - DNA, 1318 bp, Zea mays
  misc_feature (1)..(1318): optimal_loci_2428_G1, chr1:12815752..12817069, Cluster 1
acataactaaaggaacaaagaaagttagctgaataccgaagttgaccgtctgaaggtctctccttcccactaattccatccagcgagattgtgcatcgttggaatggtttcatgtgtaaaacaggttatttgtacactcgagatcaaaggcttgatgggggtgcaggatttgctgcgagctgaaatgagtgaaacttttgccgccaaggaggcgctttctgaagatgaactgaggaatgagaagctggccaggctgcttggagttgaggaagttaagaacaaacggcttcaaaactccctcaaaaggtagctatccggaggtcaaaatcagatagcacttgccattcctctttgcagcaatgcacgcttcgagtgagttcatgatggaagttctagtgctttcaatgcaatggtgttttttcttcataggatggagaagacttctaatctggatgaggaaaacagaatgattcgacaggctatggcgttaaaccctgctattgtcaggtcgtcatcaagcgaaaaccatgaaggcacctggtattcaggtatgcccaatcattgtatcataaactgacttgtgatgccatgaccagtactaagaaatcatacttttttagttaatagttgatcatagttgtgtacattcatgtactaccatgaaagaaaggattcgttgtatcgtccagttttatttgttgagaaagaaaatcggacatttttatctgaaactaaaggaacaaagaattatatttcggtctagcttaattctgtttttacattctagcagatttgatataaggtttgatgaactgatggagagtgctaggaaactgatcaaagcgacatcaaaggagatcaacaagtgaaaataaatatccatgcagtgttttcccaatctccataatcaaccaacggggagaccaagaaggttgtaaaacctggccatctcggtcagtaagctaaaggcacttatattttttgcttactatctacattctacgaactgcccttaatgggggaaacaacacagttgctgcagattaataaaaaaattgagttgatggctttctgagtatgagagttcttgaatccaaaaacattcagaaacatttggcagccttcagaaaggaaatcacatatccttgcaatggcaaactttcgatggccagctctgtgctgccggcggaggacaagaagcccaagtacatgaagtcccgctcccggacccaccgctccagcgactaccacatttccaactcgtcgaacgatgccatgggcccatggcgtggttcagcagcgatgcggccatgccgcc

SEQ ID NO: 100 - DNA, 1037 bp, Zea mays
  misc_feature (1)..(1036): optimal_loci_25001_G1, chr1:151371224..151372260, Cluster 1
aggttgtaagatcaatggctgaaattccctgcagcgaataggaatgcgagacttgatcttatccgccgattaggcatcggacggctattcgatcttcttctacctacacgcaccagtgcacgacggcgctgagtacatcaacagcgcgtcccaccgaagtgatatcaaggtgccgaggttaatacctaccctaagcaagcactaccgccaggaagataagggtgagggagctcatgggcacatgacttaccgtggcactgcgcaggaacgagtagtcacgctccacggccgcctagttcgtcttctacacgcgacgaggaagcctagtccttccgttgacggacgtgcgagggaaactattcctagacacccggcgcgtgaccccggacgagcaccgccccaccggtcaacaccgagaccaacgccacttcagagcgcccgttgacagggtccaagctcccgtcggcgagcaccgccaattgacggcgttgagtctccactctaggcaattttgtggtgccctaggtatgcccaacagaggacgagagggtcgcgacacttgattttattcccgcggtcaggttgcgcccgccaatccgcggattcagttggagagcccggactgcggagatgctgttgcgcctgcccgggagatgcggtggccaccatggtttcggctggagagagacgtcacgcttcgggtcccacatggcagagagatagacaggcgggtccgcaagtcaacgccaagagctgtgcgtgtattccgggtgggagaaacggtggtcagttggagaaccgcgacgcgatttccggctgacggacattggcttgaagacaactctgttagggtggccccaagcgtaagcggcttagggaacggtgtgttgtgtggtgagtccgtgagtggttcggacacgagggaatgtgggctgatgacgcgtgggcccagggcatcggcgagagtgaggaaacggatccgggtgcgtgaatagtcactggccagctgggtcagggagtcagcgaaacaaggttaa

SEQ ID NO: 101 - DNA, 1377 bp, Zea mays
  misc_feature (1)..(1377)
  misc_feature (1)..(100): optimal_loci_253626_G1, chr7:105352993..105354369, Cluster 1
aaaatcaaactagctcataaacctactaagacactacaaaccatttcttaacttgctaagaaacaccagagagttaatcatttttgaacttcttttaaaaccccacaaacccaatgagtaacctcatcacttctttaagatacttaatgccctaaacttgattaaggtggaactcttttctctattttgagaagcaattagtttgctaggcaaacaaaaccaaaaagcttcaaacttgacctaaaggttaacatggccaaaacaaacttactgaaaaattcttacaatttttagtgctctattttcattgttaagattcacaaaattctaattaaaccaagttttaattattccgaattaggggtttgtctgaaaaccccaaaatcattactaacccagagaccatattcttttaacctaacaaatcttgcttcatgaattttacatcttacacaagctctagacaaaatacacaaaaactgttttacagaataaaagaataaagggctatcccattggatctgggcttgtcaccggcccaactggacaacacacgctgcgcctaaaatcgatgcccagctcccgcgccccggccgcgcgtttccaagatcgacggcggcgacccgataccccagcctcgacaacgatgagctagacgacggggagaaaactgtcaccccgcacttcgggaccgcgcgcaactactagaagagctaagctgcaggtttcgggctctgcggatgtctaacggcagccatggcggcacgatggtccaacgagtagtacggcgagcaccgcgaattactaggaacagagacagggaccggggaagcttcacaggttgagaacaaactgaaggtggacggttggcgacgctaaccgcggtgacagtggtgttcatagacggcgaacccaccattccagacgaaaaaggcagtagaattgaaaggacaactccgcgagcatcattgataccagacagttatggaacataaaccaagtgtacgagaaggcggactttgatagtggcgtggtcactaggttaggagagaacggcgtgcagcgagctccgaccagttaaacgacgacgagacacaagataatttggtcacgagggcgtgaactagtgaaacgtacgacgaactttactaagggtcgagaaacggcaaggaaatgcactaagtcgaagtgcacgacgactgaaagaagagaggaaaaaaggactctgcaattatcagccaccaaaagttcaagaactaagatttagaagggtccaaagttgagaggaattcagcaaaactgaactctgcaccaaactcaccccccatcgttgaccccattaatccacacgattcaaaacaataaggccaaccttga

SEQ ID NO: 102 - DNA, 1344 bp, Zea mays
  misc_feature (1)..(1344): Description of Artificial Sequence: Synthetic polynucleotide
  misc_feature (1)..(100): optimal_loci_254318_G1, chr7:108859097..108860440, Cluster 1
gacgagtccaaagtgccaatatgaaaggtgaagttgtaatagcaccagacgtctacattagatttttaatagagtatagagtagcgtagataagtcaccgctgtcccgggaagcaggagggccatctcaccgccgctggtccggtgggcatatgtgcatcagtgcatgttgatgcatggctgattggctgaagcctttttaggctgtggctgtgatcttcgctttaaattgaaaccacagtccacagccgttgtgacttttatacctggagtgcttctgtgcttggtcgtagaaagaaaattgcagccaatatggctacaggttaaatctacaacacaccctatatctattgcaactgttagaggaagtacagtacagtacaataccaataattagaaccattagtgttaaaaactaggagcaaaaaatgatgttatatacactgtttggatgtagatattagaacatggaattaggaattggaattagctttcttggattctgttgttttgtttcacatggaattagaatttggaatcagagattcagttccctgaaattagactataactagaaatttcctctgtcaatacagagtgtcacccctctgaattgagtgaaattagaccgcataattctaaactacaattctgtgacattaaaataataaaattgaaattacatctcatttcaatactatgctgatttgatattgaactcaatttaattctataccctccaacatcgacatcaaataaagcactagaggatctagacaaacaattccttttgttgttttaccttaaacggtgtatgtgtagaagtcgaaggatcgccaaaggtaagattcttttgctaggacacaacatctcggcgttctgtgcaactcccaagaactactttagatcgggggctaatcagaggcgaagccaactttagggtggtactgctataaaaaataaataatttaataaaaaaatatggtaaaaaattttaatcagtaggatttttttcattaccctggtgcattggcactagggaagcttaacgtagcttcgcctatggtgctaatagcctcattgcttccaccttccagcttctagcgctgatatctagagagctaatctaacatagaagacaagacaatatttttttctgattcttcggatcagtgagatcatcgctcttcttgtcgtttttattagacatcatgattttagattggatcactattgacctcaaccgagtcactgacaaacgggttatttcacctacaccagttagagctataatgttcaagactacatatggcctagataaacaacgtgaaaggtgaaaattagt

SEQ ID NO: 103 - DNA, 1095 bp, Zea mays
  misc_feature (1)..(1095)
  misc_feature (1)..(100): optimal_loci_255924_G1, chr7:117965183..117966277, Cluster 1
  modified_base (185)..(185): a, c, g, or t
  misc_feature (185)..(284): n is a, c, g, or t
  modified_base (186)..(186): a, c, g, or t
  modified_base (187)..(187): a, c, g, or t
  modified_base (188)..(188): a, c, g, or t
  modified_base (189)..(189): a, c, g, or t
  modified_base (190)..(190): a, c, g, or t
  modified_base (191)..(191): a, c, g, or t
  modified_base (192)..(192): a, c, g, or t
  modified_base (193)..(193): a, c, g, or t
  modified_base (194)..(194): a, c, g, or t
  modified_base (195)..(195): a, c, g, or t
  modified_base (196)..(196): a, c, g, or t
  modified_base (197)..(197): a, c, g, or t
  modified_base (198)..(198): a, c, g, or t
  modified_base (199)..(199): a, c, g, or t
  modified_base (200)..(200): a, c, g, or t
  modified_base (201)..(201): a, c, g, or t
  modified_base (202)..(202): a, c, g, or t
  modified_base (203)..(203): a, c, g, or t
  modified_base (204)..(204): a, c, g, or t
  modified_base (205)..(205): a, c, g, or t
  modified_base (206)..(206): a, c, g, or t
  modified_base (207)..(207): a, c, g, or t
  modified_base (208)..(208): a, c, g, or t
  modified_base (209)..(209): a, c, g, or t
  modified_base (210)..(210): a, c, g, or t
  modified_base (211)..(211): a, c, g, or t
  modified_base (212)..(212): a, c, g, or t
  modified_base (213)..(213): a, c, g, or t
  modified_base (214)..(214): a, c, g, or t
  modified_base (215)..(215): a, c, g, or t
  modified_base (216)..(216): a, c, g, or t
  modified_base (217)..(217): a, c, g, or t
  modified_base (218)..(218): a, c, g, or t
  modified_base (219)..(219): a, c, g, or t
  modified_base (220)..(220): a, c, g, or t
  modified_base (221)..(221): a, c, g, or t
  modified_base (222)..(222): a, c, g, or t
  modified_base (223)..(223): a, c, g, or t
  modified_base (224)..(224): a, c, g, or t
  modified_base (225)..(225): a, c, g, or t
  modified_base (226)..(226): a, c, g, or t
  modified_base (227)..(227): a, c, g, or t
  modified_base (228)..(228): a, c, g, or t
  modified_base (229)..(229): a, c, g, or t
  modified_base (230)..(230): a, c, g, or t
  modified_base (231)..(231): a, c, g, or t
  modified_base (232)..(232): a, c, g, or t
  modified_base (233)..(233): a, c, g, or t
  modified_base (234)..(234): a, c, g, or t
  modified_base (235)..(235): a, c, g, or t
  modified_base (236)..(236): a, c, g, or t
  modified_base (237)..(237): a, c, g, or t
  modified_base (238)..(238): a, c, g, or t
  modified_base (239)..(239): a, c, g, or t
  modified_base (240)..(240): a, c, g, or t
  modified_base (241)..(241): a, c, g, or t
  modified_base (242)..(242): a, c, g, or t
  modified_base (243)..(243): a, c, g, or t
  modified_base (244)..(244): a, c, g, or t
  modified_base (245)..(245): a, c, g, or t
  modified_base (246)..(246): a, c, g, or t
  modified_base (247)..(247): a, c, g, or t
  modified_base (248)..(248): a, c, g, or t
  modified_base (249)..(249): a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
gctaaaactgttctgttatgggtctcctcgttgaattagtctagttctatcgactcttgtccttttacttggtttttcctcacatctattcatccagtctcattcttgggaggccatccatagaaggaccccctcaatattttataacctcttatacctgacgatctgtagagcgtctggttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagactggggggaggggggccctctttggcccgggtatacggggcatgtcaaaattgaccgaactcatttggggaaaagggcttgggggtagtccgtgcattgggaagggcgtgcacgcaggtgcgcgtgaacatgtgcttgaaaaggccagtagcgcagccgagaaggatcgccattcacacgggcgcactggtgcggcttctcccccgagtgggatgaacatgtgcttgggtgtagtttttccttgagctgaaacgtcttgcaacagtggccgcacacataggcaagtggctcggcacctggagtgcgagcagtggtgcctgagggggccgtggtgggagcagcagagggagccggggcctcccacggctgagtgccgggggctgcctcgggctggagtgtggggtagaaggcgggtgggggcgcaggggctggcccggatggtgctggagggggtggtgcgggtggttcgggagcactcaagtgaaaggggaagagtgcgacaggcggccctggggtcttcacgccaggcgggcggggtccggccagtatgcagtcgggctggacaggggtctcggtgggacagccttcggggacagcgccatccttgtcgtgccaagcggttacatagctgtctggaaatacgtcctcagctgcccctgatcccagaagaaaatttttcccacatcaccgttgtcagagaggccagtgggtgcatggaactcctcgcacgcgctgctgcttctcttcttctctgggccacacacccacgagcatatgcccacttctacaactaaggcaaccaggctac

SEQ ID NO: 104 - DNA, 1285 bp, Zea mays
  misc_feature (1)..(1285)
  misc_feature (1)..(100): optimal_loci_257500_G1, chr7:125855965..125857249, Cluster 1
gtaaccgaaagggcctctagcgtaatggttaaggtttctctaaattataggttcaatcccctcggggacgagttttaaagaaatagtagtatcgaaccacgttggagagctttgaactcagaggagtttgtgtctttgatcgaacttaattctgcaaaacaggccatcatcaaaattctttccctggaggaggaaaaaaaaacattagtgattgagtttctttggatatggtgggatgcacgtaaaaaggcgaacgctggggggataagattatatctattgaggagatagtctataaagcacattctatgaaatatgttgatactcttcgttcacagagagaagccaaataagagacaacgtggattttctttctggttgatggagcctttataaaaaggagggaaaaaaggtgcgtgtggttttattacgaaggatgagaaaagggctatggtgttggctggtggtgcagggagaatcagtgggtgcatgacgcgttaagcgcagtgtcacaacacaagcatgccttgcaaagctctgtaagtatgcaacattggacggagcgtagagttgttgttgttgttgttgtccaatgctcaggccatgcgccacgctcttgtaattagtgcgcacgcggagttcctcgagttggtttgaattgggacctggaagatcggctggtcgcatgtttgggtttcagactctaaaaaaaaatgtggactctgatgatgtaaacgatgatcccaagaaataataaagtgcaactctgcttaaaaaacagcgacaatacagagagaaaacccgcagtgcctcgagacagtgaccacctcttcggcacaagggaaaactgcaggctcgctcggcactctggcaagtggtggtgcaaccgcgagcgtgctgattgatgtccgcaccgcactcgcaacgggagattcctgcaactggcagatgatccacacaccgaacgcttgctttgctggtacgtgcggtaagaagagcaggtggagtcgtagagagaggagactagggtttgggatcctcctcgcagacgcagagtcgcgctcgcatgtgcggcgagacgactggctcctggttcgtgcggttgggtttgtcaacccgagcaggtgggccgtgcacgtgcgaccatgtgcatcaggggaggggaggggaggacagtgtttcgccgtcctcgtacacgtgccaagggtaataactcggagtccgtctccacacgggcgtgactaaattgcaagaatatgcaaactcatagctacgtgctgctgta

SEQ ID NO: 105 - DNA, 1304 bp, Zea mays
  misc_feature (1)..(1304)
  misc_feature (1)..(100): optimal_loci_260418_G1, chr7:142408510..142409813, Cluster 1
tcaatagttctgctgatcaaggacatgacttctattacagctttatatgtaaaaaaaatggaacctgacaagttcaatggtcctaagcttactgggattcatggcatcacccaatagacacttcaagccaagttctgtcactcctctgcagtcattaattaccaaatgccttagcaatcgaaagtgaattctagcaaggttaagcattgcccaggtcccataaacctgagcatttcaccaggatgagagtagagagctggcgaaataagcataaatgatggaggactgatgattgtcttgcaacattcatatgtgattctccagccatcatgcccttgagctcaagtttatccagataaggttggttcatcagtaaggacaagatggcatcttgcccaatttgagggcagcttcccagagtaagggactcgagtctcttggcatactgcataagggctcttagagacgcctcagtgatggacaagcacccttcgatatggaggaacttcaggtttctgcattgcttagcaacctgaggaagaccatcgtcgctgattgaagactgtaacataacgaaattttctagtgcagggcagtttgaagcaatgatcctggcagctttatccgtgagagagaggcagtcaacgagacaaactgacttcagattgccgcatgcactgcttacaaaatggatagcactatcagtgagccgtggaacaccagcaacaacagtcccacatggtgcacaacaaagaccaagatcagttatcacaccccttgcacatatgttgacaacagcggctgcaagcttgacatcatcaacatcagacatatgcaggcaagggtgaacaccttgatgaacactgaaggggccccaaaaatctggccgctgagggaccaatatgttggcccgtctccaacagacacaggcacatgactggcgatcttctgggtttcccacatgcctgaatatttcagctatgcaagcttctggcagctcatttatcaagtcctgtggaagagttcttgattgatacatggaagaacctgcgcttaccttcttacaagcttcataagaagttctaaggcagcttgattgcctcatgtttcctgtcatacaaacaatttcgatcagatttggtggtatgaagaaataatggactcatatgaagtgaactgggaaaattttaataaactattggcatgcaaacaactcttccaaaatccaaacaaagaaatataaacatattgtactgcaatatatacctttactactgatatgaatgcttcacaaaagataccca

SEQ ID NO: 106 - DNA, 1318 bp, Zea mays
  misc_feature (1)..(1318)
  misc_feature (1)..(100): optimal_loci_260477_G1, chr7:142803862..142805179, Cluster 1
tgtagccatgttgttcgcacatgataagataccggcactctacctcattgtatttccatgtacaacaagcacatattagtatattactagggatacagtaccgttgcatgctctgcctagagcccttaagtgttctacgggctatatggtgcccttgcatgtctcatcagctctgtaatgtcccatcatgtgtttattgtgttgtacctcaaacttagctattaacccaacgatctctctagcatggggccataccttggtgtcatacggtccctagtgggtttttgacatctttcaaccttgctaagtccttatttatcaaggaagggtcctttagtccccaagtgcctatacgaggggcccaaggcttatttctttaggtgtcccacgtcatgagggccccaaaggcttatactgttaggtgtcctatggtgtgagtggcccaagggatagtcctatcaggtgcttcagggcatgtggggctatgagggcttatccagttagatgctctggaggcttgtatcgttaggtgccctaaacgcgagggacttggggggttatccactaggtgtcatgagatgcgagaagccctagggcttgtactaccaaaaacatattatataagcgaataccttttaggtctatttgtttgcttgccttgccctgacctgactagatttctatatgtggtcatgctggtgtatgtttggttataatggtcaggtcatcgatgtggggttagagtctatttgattgcctagttttggtctagtctattttgtatttcaaaatttatatggcaagattagtctagtttgattcgtgaagtcgtcaagtacataagcatgaaattggcttaaggatcaaatattttagttaagagaagagttagttgaaaaggtattacaaaattctagcctggctacctggaaacgcttaaatcttatgtactaatctagctaggctagttgtatcacccaaaatcctattttggtaaattcattttatgattcgaataaatatcctttcaaataagaagttaaataaaatatctctatatgaattaaattaacttatgtaaaagttttcgtttaggaatattcaccacatgagaataaaagtgtctattcataaaggaaataatttctgttataaaatatgtatttagaaacactcctaaaggtatataaaaataactaataaatcatctagtaacatatgctacaccttagaagatattttcttcaaaaagttattagttatgtgtatgaaacttgcatctaaaagtatttacataaatgaataggataataaagaa

SEQ ID NO: 107 - DNA, 1017 bp, Zea mays
  misc_feature (1)..(1017)
  misc_feature (1)..(100): optimal_loci_26052_G1, chr1:158299399..158300415, Cluster 1
ctggacaatacaccatactaggtgtacgcttacacaagttggagggcggagttcatgacgaaagatgagactacactacaaaaaccataccatgagacaaccccgtgggacccaccaagcgccactaagaggacatcagcattagactcactatagggacctatattgcggacagatagagcggtacatacgaccacacatgaccctacggacgacattagaggcactacatcaatcggggcaacagatcacgctcttacaaataggaaaccaatccccctataaggtcctacccttgagctataaaaggacaggtcaccttccttcttcccacacacgacaccagatgtaacacgtctctcaagtaatactatgatcaacactacacaggactagggcaaaagcttgaaccaatataactctctgtctccatcctctacttgaatcctaggtggttcaccattcggagtgagtccgtgctagcatcccctgtcgaacacaattctattgtcctctggtttccaaaaccatgacaggttaataattacacatgaaactaaattaatgctatacatgtacaaggacgatgtttttgccatgtttcaataattaaacctgggaacattaacaacaatactgaataagagtaatgtgcaaataatgtaaagcattatccacctagctgaatgctactgttagattagactatgggaacatggcatgcatctgaagtggagacatctctaacataattaagtcaccaacaactaaatagacctgcaaactatgtcaatctagatgaatgctcagtttaagaacgtttgaccttgttaggttggttagtgaaagtcacaactgaactcacatagttactcaaagcacttgacttttgaagcatgattattcttaacctgcgacaaaatgaaataggatttgctcccatcactcacatattctccactaccgacaacaaagtcccgaagatgtcaaaaatctacgtcctcacctccatagatg

SEQ ID NO: 108 - DNA, 1153 bp, Zea mays
  misc_feature (1)..(1153)
  misc_feature (1)..(100): optimal_loci_261023_G1, chr7:145711344..145712496, Cluster 1
cgctgcggccatagggtgcccctacgcaccgcatgtaaggggagtgggatcgctagggtgtaccgctgcgcacagcctgatgcatgcatgcggccggccagaaagaatcgctcgcgacgcgacgcgagtgtggatggaatggacaggcaggcaagcagagcaggatctgcaggggcaagcaaggccctctgtctggtgctcgctattggctccatctccatccactgatcactgctcctgtgcggagatgcgtggcgtggcgtggcgtgtgtgacgaactgacgggaccagctgctgagctatgcacaaggccaaaggctgctgctctggctctgctagcacgagtgtccgagtggagtggaggaccagagtccgggcacccggcttcgtttctttctgctcgcgcgcgagggtctttctcggcttgggagaggcacaggtgaccccacgcctgtagctgagctgagccgacagccgagagagatgatccagacggctctcgtgtctcgtctcgacacagcagcatccacgttgtattcacgcacatgcgcatgttcaccactccctcttccctgccgatctgtacgcgccccccgacgacttgactgcgtgcgtggtggccatcggtcctcgtcgtcttcttctccactccgcgcactgcagcgcatcagtggagtgctgttgcttccatatggatggaatgcgcttcagcttcagcaggtgtgtcagtgtcagtgtgtgcggtgcatctacgtatgcatggaagaggacagcgcgtgtacggaccagcacgagtgtacttatgtcttcaacccactatatatgcaatttcatcaaagacgtctgtagcgttatcttaatatttaaccaacaacaaaagaagattaatatggaaaaaaaagcatacacatatcgagaaatgcagcatttttctaacttgtatcaacatagatgatgtcgagtcatggacaggatactatttttttatattaaaacgagacataacacttatggtctatctgacttcttcctcctcccttctcatctacctcaacctcctcttcttcttccacctctcttctcctctacgctccacatttttatttaatagagtttcatggatatagggggttgagtcctccaaatctgtccc

SEQ ID NO: 109 - DNA, 1008 bp, Zea mays
  misc_feature (1)..(1008)
  misc_feature (1)..(100): optimal_loci_261732_G1, chr7:149753482..149754489, Cluster 1
gcctattcagtaatggtgcatactccaatgccaaagtaggtaacgaccaatccgtcccaccatggtcggtaccgaccatgtcaaccagtcgatggtcctgctgactgaccagccaagactaccgtcattaaagacataatggtcagcggccgataacggctagagttggatccgcgcatacggtagatcacctatggacagtcaccaagctaaaatctatatgatggggttgtatttgatttgtgggtggataaaaaaatattctagagatagatatttgataaacttttaagattttgaaaaaaaaatatgtacatttgcagcctccgaaaataatctagtgcaacgacgacatccgtcgccctcgcccaacccaaccgacaggctggtgacgcagctccccgtacgtgcagacaacgaccacatggccgccgcatccacgctgatcggtgactggtgagatggcagacgtgagcccgtcactgtccttcgtcggaaataaaatgagtgggtggatgggtcgggccctttgttctccgataaacttgattaaccagccctaggaaaaatgactagtgaacctaaattaatctcacaccagtgattagtgctgattagaacatcgctgttcttttatgaacctagaattcctttttttcacagttatggttaatctatgctgctactacatggaaatctccgcaaacgcaacgcgcttctctgctcgcagttccgcttcttccccaaccaagccaattgccacgcccccacgagccacgacgcgacgcgaccaccccacgccacgcaccgcacccacccagaataaaccagcacgcgccgcaccaactgccacctctccctgccgctgggcccagagtatgccgtacctgtagggcccatacgtcggtgacaaagtacaacgttcgcctttgcctttcgcccccaacggctgctgccgctttgtaaaagcgacgtggtacctctcactctctctcctctcagtcgtct

SEQ ID NO: 110 - DNA, 1319 bp, Zea mays
  misc_feature (1)..(1319)
  misc_feature (1)..(100): optimal_loci_262734_G1, chr7:155571882..155573200, Cluster 1
tgtccactgtcggaatgatcaatcgtgtgatgaacttggtacgccttcttggcttctgtgctgaaaagaccagcaggctccttgactacgaaagtgatactggttccttgtttccatgttgggcagcaatccaagtgatcgatggcaacgaaaggagcattttagatcagagactagagggagttgctgacatggatgaacttgtgagggcttcacggctagcatgctggtgcatttagtttcagtatgaggcgcactggccatccatggcgcttgtggtgaagatgatggaagggcccatagatgttgatgtaccaccgtttccagaacctcttcgttgtctactggacagtcaggcttcctctctacctgatgttagccattcataccacgaccctagttaaaaaataaagtgcacactggcccagaaaccttttcattggcgcctcttgggaccatgaacatgttgcgcatttcagtcacaaaattcagtaagccgactaatgtagaaactattgataagatgacgtgttgatctttcttctgctaaagtttgagcacatgcttattattttgtattccagtaaagctattgtaaatgcatatggtgtacagtattgctgagtttgtcaacagtacgttgttggcttatgctaaatgaaaccatgcataggtccatttttgcccccttgactagacacaccaaaacagtgacaggaattatgaaagtccggagttacattcagctacctggttgggagttcagtatactaataccaactataacagaattagtgggtccgtgaaatagcgaacaaaaatcttgtcagcctcaagtttttagcctcaaaccagtgttatagcagtgcttataagctgccatgtgcaaaccagcaaaaatggacacaagtcaagtgctaaaagaatgcattaccatactaatctcctactcagccaggaaaaaaaagtcaaagcactcaacagtttagtactactataatttttttacttagccttttaaattcaattttttagtaacaacacaaaactgaaattttgaaggagcccctttggccaccctaatgagctttgggtgaatccttgacttggtcatgccaaattttattctgacccaccgtccccccgggaaaaataagttgaagtagcctatctcagcgcttctagtatgattgcaaagagagtactacctccattccaaattataagattttttttattttctagattcataacctttactacgcacctggatacaagcagcagcggagtgcgtgcaaaaattaaagtattgttaatgc

SEQ ID NO: 111 - DNA, 1001 bp, Zea mays
  misc_feature (1)..(100): optimal_loci_262997_G1, chr7:156725859..156726859, Cluster 1
gacacaatggtttatacctgaagtttggttgcttgatgtaacatacattcttgttgtgacaagtccaagctaggtggttcacatgctaattagaatcacatgctccctaaattccctaccctatgggacgtctagtaccagtatcagacacatctgatgagctcctgtgatatcaaaactcctaccttgttagtggtacctgatgcacataagatcacttggtgctcgactgaaaaattgtatagtgtgtgagaacatgccacatgtctagtgcatgcaaaattgttgcaccaagagcacttcctcgtgtattcacaagtgtacgaactctcgaaaatttttccataaatatttttgcttgctcttcgagcgtgtttgaggactatatgcacatgcacataattcgaacacctagtaatgcttgatgaatgaattatccaattaaaaccaccttttaataatacaaccatatatcctaaatttgatcatgcactcttttgtgtcttgaccagtgaaacaaaatgccctagatattagtttgcattgagcccttgcattttgtttttccttttgttctttttatattgagcacttgattattgtaagtgtcaagggaaggacatacccttggatactagcaatacatatcttgaagatcccactagcagaaggaaactcaaagaggcctaactaattctagccacatgtccttggtccccacaccacgaggggcatgcccagctctagctaagtgtagggtcatccatgccttgggactagatactaaggccctccttgacaggggactagatcatagggtcattaggacctctagggctctcttgacctcctagtgccatcctagccttgtggctctcctagcctattatagcattctaaatctttatggctctaccagtctcctaggccctctaggctaggaaccaagctcatcgcttagccaagtctagaggtccctataaactaagatctataactac

SEQ ID NO: 112 - DNA, 1353 bp, Zea mays
  misc_feature (1)..(100): optimal_loci_263137_G1, chr7:157192627..157193979, Cluster 1
gaatagagcctcaatatgacagaatgcgcacgcatgatgtagaggtccagatcacttgaacacaatattctatgtactctatacggcgagtggttagatgtaagtataggtagtgcttaaactctcacatggtgactgagctagtgagtgagaacaactctagttgttccttgtgacgtctaccaagagagagcattcgatcatggagaagcgaacccctttttatgttgttcaacatctcccttttacaccacaaaggagagagagagagagttatatccctatatggataacgggccctgcccaacataagtctaactactcttatcatatggtagttctttaaccatacatgaagcatacctttggtgtgccatagcgaaccatacatgatgcataccttcagtgtgccatagcgatgagtgtgacatgtcacaatggcatatatgagtgcccatactatcaggtacgacatagttggtaggtgcgaggtttggccctctgggcacagtgctcgagtgtgaagctggcactgagctaggtcattagtgggttcatcttctgatgatggagttgtaaagtgtgttttgtcagcatatgacgatatgccttttatggatgttgtgagccggtattatttaaaaactctagtaaaattttgatattcattgacatttttaagcaaagcggcaacctaaatacatgatttttatcgacagtttccttaaaaattgttatgctctatttggatgtcgatattggagtgcatgaaattgatttgagttcaattacaaatcagccatggtattgaaatgagatataatttcaattctattgtttggattgtcaccgaattggagtttagaattctgtggtccaattcctcccaatacaaaggagtgatgctctataatgggagagtgagtttttagttatagtccaaatttagggaattgggtctctaatttgaatctcaattccatatgtaaccaaacaatagaattgtagaaagctgataccaatttctaattatgtgctccaatatctacgtccaaacgaggtactaggtagtaaagatgtatttatattgacagttcgtaactactatgacccacagttctatttataattttatactgacgcctaaacattataaaccgctatatttataaaaatggattccgcactaatgtttaagtagtaaatttagaaaatcctttgaaaattttcaaatggaaaaaacacgtgtcatgcatctcggtcagatcctaaaacgtctacgtcagatatgtccccactccccacgcaactttttttttgcgtgtggtggtgtgcgtgtgtatgatcttagtt

SEQ ID NO: 113 - DNA, 1363 bp, Zea mays
  misc_feature (1)..(100): optimal_loci_263138_G1, chr7:157194100..157195462, Cluster 1
attaaaagaaaaagaaaaaaaagaaatgaaagtgagccctagcatctattagtagatgtacgtaccctagttcgtggtcagtattcctgaaacaaacgaataatcaaagcgaaaatgctgcaaagagtgtagcttaagaaacgcgatgatgtatcgaggcgagaaggtctcatccactccatcaaacgtgtgtgcgactgagttcctaggcttttccatcggttttcaggagcagtttgctgtcaatcaaataaagtgaaataaataaatagattcacaagaagtgaagcttgctctttattcagagccttatcgctcaccgagttaaaaaaaaatagttttacaagtgaagggaagccctaccatgcaaatgggatctaatctacaaatgacgtcgtcgaatgctgcttgtaatggcaattttgggttgattattgactcggtcgtcaaccagacacctgaacgccattccctaatcaagctagcaactaactaagcaccggtcattagtttaagcaagtggttgctaagtccaaaccaactaactgggcaaccacaaagttgctgcactaacggtacggattcagactcaatatttcccgtaacgaagttcatttaccaaacatatatttctgatgcaaatattacttcatgcatgaaattaattaaacaccctttgtcaaattcaggccggcgtgtctcgatctctggctcgatcgaatcaaattcaggcggccgcacggaaacttacctttgaatttgacaaaaaaaaacacgttttgtcatcatgtgcacgtaacataacttgatcgtgcaaacttgagtgacgacgatacgagtgttgcatataagtgcaaccatgcatgcatatgtatgcatcgctctcgcgcgcggccggccggccggcaaacaaacgtacctgagctgcttattaatttccacaaggctgaagaaccgtacccttaattgccgcatatgcggtcaatcgtacgtgacgaacccggaggaaaatcaggggacggggttcgagttcgattggccgacgcaaagatgacagtgcctcgtgccgccctgcgcacacgggccgggcgaatcgccagcgcacacaccgagtgcgtgtgcgtgcggacgcatccaacccgcatgcagccatccgctggcgcatgctattcgactgccgttaataattcagtccgtacacgggacgcagttcgctaagcttaggctactcacaatgaggatttcatatctctgttttcaaaaatgtcacatcagatttatggataaatggaataccctctctcaatagagagtttcatctcactatttcatatatcaacatacttcttaaatgctgcatata

SEQ ID NO: 114 - DNA, 1066 bp, Zea mays
  misc_feature (1)..(100): optimal_loci_264449_G1, chr7:163935593..163936658, Cluster 1
tgacgatactaacaatggcaacgacggtgggggcagacggggtttcagcctttcgtatcgctcctgaatccatagtcttattagagttcctctaaaatttaaaatatacactttataataatacgatgacggtttagtttagttcttatgtaattttatcttggctccgttgacggcatgcatgcaggtggcaagtctgcgagcggtagtgcctgcatggggttgtggataaggatgatcgcatgcagtcgcaggtgacagcaggcagcacgatcacacaagggaccggagcaggcatcgtcccacgtgcgcggggcgggagccgggagaggccggcgtgtccgcaaccatgtcccgcaccggcacctagtacgtagtacgcctccctctctctatctctgtctgtctcctccgctggccatcatctcgacaggtgccaccaatcggtctgcgatccggcgagcaacgccgccaacacaaggcaacgtcggcacgtcgctgtgtgctgcgcggactgctgtgtctaggtagagcctaggcctgaggcatgaggccaggccaggccagctgcccacttgcccaggcaggcagctgtgcgtgtgcctgtgcggtgcgctgggctgatgtgcggctgcagtagactgacggatgtttgcatagcaagcgaatagctagccgaaggcgaaacatacacgccacgcacacaccacagcgcatgcatgtcaccagcatgtgcgtggtcgtcggtagcagttcatggtaccggccggcacctgttaatataatcgttgtcacttcactgctggccatgcatgcaggtacaccgcctgttctgaaatactggaaccggttcttattactgtgttaacatgaatggaacagccatcgcgtcaagataagctacggtggtgggtgggaactagtgatgaaaactgacggatacagatagaaagactcatctctcgtttccgtatctgcattttatcatcggaaataggattgagtccggaatagtcgggaacgaaaacgggagcaggataaacggaattgcaaaaacgaacggaaa

SEQ ID NO: 115 - DNA, 1067 bp, Zea mays
  misc_feature (1)..(100): optimal_loci_264737_G1, chr7:165693781..165694847, Cluster 1
accgggcggtgcacttaatttctcacttggtctaatgtatgtgtatctgtttattcgagcaatatattgtgcttcagtatcttcgtctaatgagcttcctaccacaaaatgttcatcatcttcgccagtaaataggtacatggttggctgttcttcgctttcttctaggacaatgcactcatcaatcatatggtgcacatcatcattggaggtgacagagatgagcacattcagttgctctcctggcaaatggtacttgactacgtgagcttgcctgttgagcttggttgtcttgctaatcagtccttgccatgacaatccttgactgatctaaatcagatgcttttcaccaccgacataccggagcttacaataggaatctgcctccaaagttgcaaaggaacttcattctagttggtccagaggtatatatctcttctgggtacgtcttatttgttccttgattacttgtttcactgattgaaggacatttcatcagcttctttgatggtttatctccagaaaaattagcttcttctccccaaggagtgtgggtggttttgatgttcctgttataagaggtgattgaaaccaaaggcttccttgtgtttgccctgtcttgcacgaattcaagagcaaactcttctccagttcggaaggagtaattcaacaacctcgtctccctagttgtaacaaaaaacactggcctagggctggcattgaggacacttggtgccaaagcttctatggagctcatatgtccagcttcaggacctccagttccaattatttgtaaattgcatggagaatacacagtgttctttgacattacctctcgggtcaagtttggtctaagctgtatttcttattccattttcagtatccaagcgaactatgatattagttaacatgaacattatcacatagcatcacttatgcatccttatattcagatagttgtagtttggttcccccatggactgagagctatgaactgcagatatacaggttaaaataataatatatagctaagaacttgttatatcataagttatttttcttctgaa

SEQ ID NO: 116 - DNA, 1055 bp, Zea mays
  misc_feature (1)..(100): optimal_loci_265902_G1, chr7:172168117..172169171, Cluster 1
gagggaagatgaggctacgacgtacgagacctcatccgtctttcccgatttcgtagggcgggccgtttagaacagggatggaaataatttttttttcctcacagcgttaaagggtaggacacgaaaattaagaaaacagagatggagaaaaaaaattagagacccgataaaaaaactctaatgtgtatttgtgtattatacttatgatttgcaagagcgtaagactattactaagttgaaataattgttgcttatgagttataatttgtattataaggttgttagttgtttaagattttttttgtcttgttgtgttttgataattgatatatttgcatttgatatcatacagtgaattttttttgttgcattattccccgcggagcctcagatgaagaacggggatccacgaggacaaagatggggatgactatccctgttaaactaaacgagacgggatggagaatggtttcgggaaataggacagagacgagttagtccccagcatcccgttgacatccctgatcatcatcaagagcttctaaagtatttaatattgaaaaagtatatcaccaacgactctcgatcctacctctcaatcttttctcacttcaaaaacttccaccccacatgtgaaaaaattcatggactcccctatcgcatgtataatcagacatgcacatgaaggggcttccatgttcccgcgcgaggtctccttctccatcgatgtcctagaaaccttgtcgtctctggcctaggaaagagataatcgatcgttggacaagcttgatttcattctagacttgttatgactatccttgatactctaattatccgcaactaacacctggaggaccatggccatcactagccatatcaggccaaacatagtcgactatgggcgcccctggcctatccctggtcatttgtggcctagccctgcttggttgctggtggtcaaggcaagattcccctagttcccttgccacgactacctagtgtctacgtatggcatgtccatgcccagctgcatttgtggtctcctatggcctagc

SEQ ID NO: 117 - DNA, 1006 bp, Zea mays
  misc_feature (1)..(100): optimal_loci_266104_G1, chr7:172889672..172890677, Cluster 1
ttaaactgtgaatcctcttggacgggcaatgtgaacctgaagccatggacgagcaacaagaaccggacgtctgtccatatatatatgcatcagaatcagatccttaaaaaaaagtgatccaccagaaaccacctagccagtgtcccagtcatcaaccacacacacacacacacgtgtacaccacctaaaattcaggtgaactgaacacatgaatgaacacgacggagagagtgacaccggcagtcactagaattggacacgaagcaatgggctgctggttggccggcagggcagcagtatactactgaacactgctttattagatgcatggtgcacactgcaacgaccttcacgggaggcgggagcagctgcatctgcatgcattattgtggcgtcgtatagccattagtccttatcgcaatctgccacctcacctctcaccagggtggaccatggccagctgaagatgccggccggtcatgttcgtgttccttgttcaattattagttgtctgatacgtatatatctatgcacagaataagctagatggtgtcacaaggcagggtggccaggtatcttttggtggtcacatcacatgaacagctagctgatggatgatgctgctgctgctggcgcagtagggattcctttttatctgtttttctctttctattggtctgttttctttttctattggtctgttttcctttttaggatggatgcggccagcctcataaacgaagcaaaaaaaaacataaaaaataaactaatgatgatcaaagaattaggatggaggcaactctttggatccaatttaaatgcatggaataatgatttgttggcacgtacgtatggaggggattgtgcgaggtcatgatccagatgctttttactggaacttaactccaaatggaaagtcctcggtaaaatcacgttatgctgccttgatgcttagaaatacctctaacacatgaataaagacttatgtaatctaaaggtaccctaa

SEQ ID NO: 118 - DNA, 1091 bp, Zea mays
  misc_feature (1)..(100): optimal_loci_266475_G1, chr7:174415737..174416827, Cluster 1
ggttccctgcttcgacgctagctattgcgagtgccagatgccttctttggttccttgttttactattcagttcattaattccattattagggagttcattatattgcttcttcttattttttccctcccctctcatctttaggtcatgttgcaaaccttaaggccttgtttgaaagcaaaagtaatacaacagattgaagtggctacattatcttactattcaaaattgaataacaatggattctaaccccctcaatccccttcattatctttgctctcaaataaggccttagagctaattgttagccagctaataagttgtcaactggttttagctaggttgaggcagctaaccaattaatagttgtttgagaggtatagctaccaattagctggttcattaatcaatccgttctaaacctttcaattagttttaacggcttcctattagttttagaggtttaaaacatatggccttagctgtttggttttgtttcatactgcaactggccatctcatcgaaatgaaaaaaagacatacactgttgagctttatttttaggggtgttctctgggatttgagggggggggggggaggggaatctctgtggtcggcggttaagttgtagccttgtacataacctctctattctgctacaaagcttctgccattttgtttatgaataaatggaagtaaagtgatggaggtctttgttaaagtcaccatggacatattcctgaggaagcgagggagctctcaaaggcgcggctgtcgacaagaaggttaattagcatctcttgatgtcggtgtgtcatccggccagcaaattgtgattgttgcattcatgtgatctataggtacctagatgctaacagctagtagcttagtacgtacgcatgcagctgcatcgtttatgctagtgacgacagcgagatcgatcttgctttggtttgttcgatatatatttatgatacgattccgagcgctgactagctaagctagctaggtttgtgcgtgctcatccacgccacaccgcacctgtatagttgctagcgctctacagtgtatatgtagcttgctaccctaacccg

SEQ ID NO: 119 - DNA, 1218 bp, Zea mays
  misc_feature (1)..(100): optimal_loci_266506_G1, chr7:174549248..174550465, Cluster 1
ccgggccgcggcggccgatgatgacgttgcagcacgcggttcatcaggtagctgctgctatgctaggaggcgtcgctattgcaacagcacggcacagccggccccgtcgtaaaagcatgatgatgtgcatcggcaagggaggaagcttcgcggcagcttcattcgttcgatcgccgatcgggatggctgattgcatgcatggccctctcgccggcggcgtagctccccggacgacgacggaggaggacgggacgggacgggacccccgaccccgatccagcagcagcagatggatgatggtgatgatgagacgggaccccccacccccacccccacacggatgacactcccccgggtgtgtcatgtgtgtgcatgtgttggtttctggtggcggtggccgccggaccaccagctcgcgtcatgtcacatccacctctttgcttcttgcgatcgcatcacgtattccacgcacctgacctgaccttggacatcggctacagtagtctctgggaacgtccgacaacaagggcccctctgcttcgttccaccacgtggcgcatgcgtgtcaggaccactgcatacttaaaagatccgattgtatcatgagagttagtcatatctaccaattatatatcaaaatatatgatcaagtaacttctcgtagtatttcgtagatgtattttgataaattttgtagctaaaatgttctctccagttgagtctacaaaggtggccattaatcttaatgattcgtaaaccatttcatatatacttctacacaattcgaaaaggtttttttttatcaaatcagcaagcgatcgtaatgtatttaactcgagatgattgtatacttgaggtgaagtatcaaattcgtccacacacaataactgtccggtgactactttggactaaaatttatttttttttgaatcgagattttactctacttttagaaagcatataacatttgttcaaacacacactgaggatgccagtttacagtcattagacagccaaaccaccagaccttctaaaataaacaaacagactagcaaagcaagaacatattcagtgaaccgatctgctagcagaaacacggtcttcacacaagagccatgaacttctccaaaaagaacaaaacctccagagcatttcctccagcaaagttgtaccaccagcttgaggagaacactctgaatcactccagaaagcgctgag

SEQ ID NO: 120 - DNA, 1386 bp, Zea mays
  misc_feature (1)..(100): optimal_loci_268745_G1, chr8:10276874..10278259, Cluster 1
atgttagtcaattgacttcacttgtatctttctatttatcataatatttgtaaacatgatatgttatatgcttataagctaatttggtaaaaaaaaccttcactagatttggccatacttaaatctttttcgtcctccgtccatggtatgtatcgctatggtttctatatatcatatgatatatccggtttctatatatcatataatatacatcacatagttataggtgtctatatgtcactacgcccgttcgtcgctacgttttttagaaaaaaaaaaccacttaccttcaattttgataacaccgacaagaagggctgcattgatatggcaatttcagcttaaaggaaagcttgttattgaaacagttctaaaacaaagttaactgaacgtagcaacaaggcagacaaaaccaggaaaccaatacaaaaacgattttacatgttttgaagtctgaaacaacaaagttagaaggcaccggttggcactttattcaggatggtgtcattgttttacatctgtgagaggaacacgaatccttttgctgttgacgtgctcttcacaaatctagaattatctcactgattaggttaccttgacgcgctgtaggcaccaaaagagactgatccaaacattatgagtagaaacggggctttaaccaacgttctatttgatcttcggtggccagtcgatcggaacaccagaacgcataacatgaactgcgtgaatgatgatacatctaattagccacacacaaagacttgtgtggctagcagattagtgagttaatacagtctcaacaaatgatttgaacagcctagtaccacattttgtttggtttctgaagctgctgttttgtgtctttgcagttaccttagtccagtcctaggcctatcagacattagtcctatacaacatctgattttttttatgcacccactataaacccattcagtccaggtgactacacaaaaacaggatgtatcttacttatgttttatttcctgaactggaacataactttgattctgaaaggtttgataactaataaagggatgccactctattatcaaatccatgtgtaagtacacgatactcttctaagagcagatgagctccaagagttatccccctcccaccacaaccccaccccccacacacagaataaaagcagactgcgctttgctgcttgcttgaacaataatcttagccttgttacttgctttgccgtggctagcattggcatgctctagaccatttgatcatatctggaaagtttggttacttttttgggtagatttattccttcgacaaacgtttaggacaacttctgacctagtgaactcacattacaccgaacactcataaatacccaaaggtaaacaa

SEQ ID NO: 121 - DNA, 1318 bp, Zea mays
  misc_feature (1)..(100): optimal_loci_269335_G1, chr8:13000438..13001755, Cluster 1
acaacaaaaataaaaacttgatattgtcttgtttattgcaggccttgaaagttcgtaagcttgaccctacattgtttccaaacggccaaactggtgccttaactggcttcacctaggtgatggaaagaaggctttgcttgttatagaatgtatctgcacctgaattcgggtaaggcctgctaccggcaaggagctgccatgatgtttttggagatgtaatgacaaaagattacatacagtttaacattgagaatcctatatatgtaattgttctttctcagatctgtgttgtacatttcaaagtagagctatgatgagttgttaaatattgtaagtttatcatgtaaacagttgtaaattctttgctatatgatttatagaaaccgtagcaacgcacgggcacatacctagtgtatacctatactccgataccactgcaccctctcaggtacggcctggtcctagccttaactgacggacaaggacgccgttgcgagcacttgctagagtatccggcgtgccacggtacggctacggggacacaccagtacaccaccaaggcacccgcccgcgcaggaccactcgaagcgttcgattttctttttgcattttaaactttttttaaaaaaatatatatatttagaactttggacgacgtaatatcaacttgacactggcaggcagtagtactgggtgctgcttcagggaggcaggtggcctatgccctgccctgtctggctgtctccatccgtctgttgctaggcatggtccgcgtgatgtacggcgccagattttgtttttgtttttttgacaaaactaagggccaggtccctgctaagttaatctctatatgggtttgagatagttcatcattcaaaaaaagtaaatttagatacggcagctctgtcagtggcagctctgttagtggatccgaggtgtactaatagagaggttttgaggatggttagcgtataaaaataggaacaaggcgatctcgtggttttctggaaaggtagtacataataaggtcctttatttaccttttttgtatatatatatagtctttaacacaaataggcatggagattacagataactcaaccaaagcccaaaggaaatactcctactacgtagcaggcagtagtcgcacgaaacagtctgccacatcttcatcacatccagcgcccgcccatgtggtcgcgcgctggcttaaccagagatctcgacgctcttcacctcggcctcgggtttcttgacctcggccctaggcacggtgaccgtgagcacgccgttctccagcccggcttacaactgttcc

SEQ ID NO: 122 - DNA, 1357 bp, Zea mays
  misc_feature (1)..(100): optimal_loci_270806_G1, chr8:21838624..21839980, Cluster 1
gggttccagcttggacttcttgcctccaatagtgaatacaatgtcagactggcagagtcgacgactgattctcccatgggactcggacaacgctcacaaaactgtcatagtgaaacaattaagcaaagtagagtgctaaatggcacagaaaagctctgtgccctttgtcagtcaagctcacctgattgatgtagtttaggatgagtttctatgtcttgttctgggaaagttggttttgcatccaaaccacagccatctcacaggtattgcacattgggtcactcttcagaccaccatttgatgtcctagcttcatcacgcaccatgctttgaactgcatggctgtgtttgcatagcatatatataacaaaggaacaaagaaaggtttgcccaaatgatcatcattatcatgagttcatgagaggctacgtcacactatagtcattatttacagtcctcacgtaacaccatgagtgccatcaaaagtgcatgtttctgcaaaataaccccaacaaggcaacaacataagatgaatgtgcacagaggaagatgaggtttaaatctaaacttcaaacaaaggcctagctttatctgcaaaagagcaacatctggactttaatttgctatgtagtgtctattgtgctgaccttaagacgtatgttatatgtaatgagaagcaatagagtggccatgtataatcacacctaactgcaggcaacctacttttaggtcaaatgtgatataaaatagcacattagcgaccaacactacacactatataactacttaaatttaaataaaatagcaacgaaactacaccatgcgaagataatccaaataaaaaaatagtaggaatgatcatcgcacaaaataaaatcccattgatgatgcttccctccacagtcatgagtcatcaagtgcttttattgtcattatcgaccaaaactacacactatataactacttaaattcaaacaaaatagcaatgaaactacaccatgcgaagataatccaaataaaaaaatagtaggaatgatcatcacacaaaataaaatcccattgatgatgcttccctccacggtcatcaagtgcttttattgtcattattgtgtttggttgccatttgccaacagagtcaactgttcagccactaaataaaccaattgattgaaggcatgttccagctactgcagcatgacatggcacaaaagtatgtgagcataactaagtgtattatgccacctaactacaaaccggaaaaatacagatcatgtgaagggcagagcagacctagtgccagaggctcccacatgagtaaggtctgaggaagggataaactgaggcaagctttttccctg

SEQ ID NO: 123 - DNA, 1077 bp, Zea mays
  misc_feature (1)..(100): optimal_loci_27184_G1, chr1:164648643..164649719, Cluster 1
aatagcctcagaaagaaattagtaatgcataaatagcctcagaaattcatgaaattttacagagacacaacatatgtccatgtataatcctcaaaaatgtttataccataaaatccatatgatatcaacgtttctttcatttcactctcacttattatgtgagttacatgtaaaaatcactttatatataaatgtttgtgccataaaatccacaatatgtcattatttcttctatttcacattcacttgctgcataagttacacttaaaatcactctaagtttcaaaataatcaatactttactttatcgttttcacatctgcttgctagcttgcgataatccataaatgcacctcggaaccccatccgatcccatcacgcatgcacccttcgtttccaggcgcggatccccgcgctcgtcctgttgcccggctgagccgatcgccaaacgcggcgtgtggacggtggtccatggcagccatgcgcggctcccggcctgacccccggcgagcggcccagatcttggcgccctccggtcccccggttccccactgttctagctagtccaaaacgccggcccttgaatcgtgcgttttgctctcactgctcactgcccgcactatgtcatgatagcttgtagacgtagcagacagcgacttcgtctgcagacagctccttcttcttcagacagctttgcgtatgcccgccctagctagctcacgagctgatggatggacatctcggacacatcgtcacaatcacaagctctagtttttctcaccatgtgtccggtcaaaatgcttcggtcagcccgttttcacaaggtctgcactttcaaaaaactagactgcatatgtaaaagtgctgttgagatagatagataaagcctccgtttttttatgattgggcgtggcaagatgctacggatcagcctcacgattcctgagcagataccacgccgtgtcggtattatgtctccgctcggtgctcgctttcagaggagcctttgcttttctggatccaagccgggggcggtttgtctcactacccgttcgtttctgcagaggagcgttgcga

SEQ ID NO: 124 - DNA, 1125 bp, Zea mays
  misc_feature (1)..(100): optimal_loci_281471_G1, chr8:96045338..96046462, Cluster 1
ggccgctctaaacaagaccttggtgtggttaattggaaggttctctcattgatgatattattctttttatatgggtcaatgcatttagataatttgcaaaaataagtcaaaccggaatctaattattttgcagcttgtgatatgcgttctccatcgaggtgattctagatgacaaggaatataatgtgcatcttgtgctgatgtgctggtggcaaatagcatgtgtgcggcgatgctccttggatcgagcacttccttttggatacgttcagaaggatgtgaaaagatatgtatagttggaagatatgctactcacgaacatgttcagtcaacacgtatggcgactcgtcagtgcattttttgatacgtaaaaaggatgtgaaaagatctgtagagttcgaaggtacggtgctagctagtgttgtgtttcactcaacacgtgcattggcaagtttgcaaacgttggtgttcgcggtgaagccgtggaagggattcgagtaatctacagcaatgcatgcaagtaaatgtgaatgctttctctttatcttgaaaacaaaccttttacattaattaataatgtataaaatttatacagaccacctgtatatatataaagtttaaaatactctctcataatatataattctttattttggataatacatctctagaaatgcttgacgtctactagattttgtggccattgctgaaacgccaccatggccacaggtggggcgagcttgattcagagttcactgtccacggctagcatgcgcatcacttccacgagaccatggcgatgctctcacccccgtcgcaactttggtgaggttagaagccacagggttgtctccctcaatagcgagttcggctatggcctccaccgctcacccatgtgaccaccaccatcgcactacgaagtccaacaagaagcatcacagtcgacatggaaggtcaaggcaaagctactggtgtggtccttgttgtcggtgaccctactatcaacgagattcaccattgaacctgtcagcagctttgtttgttcccgcaactggctcatgtatgccaggggcatatggttttaggctcacgatcacgaagggtgatggatggagatatggtagg

SEQ ID NO: 125 - DNA, 1124 bp, Zea mays
  misc_feature (1)..(100): optimal_loci_283613_G1, chr8:108178885..108180008, Cluster 1
atgctagctagctagctagatgctggtcagtctaaatctgaacaaaacctagagccgctagaaaatttcggtcccgcccagtacgtgcgtgctctctcaagtcgtctcaacctagctagcacggaccacgcgtgcacagtaagccgctcgtgtcgtgtgcatggcttaatcacgtacgtaacgtgtgcgtgtggtcaatatgtatatgatgccttgcctgtactatatacatcaacatcatccaggcaggcacagacatgtgtacaatgctgtccgtcaatgtcgctcgctcgatcggcagagtctattatattaacgcgtcgttttttttggttttgtttttgcgaggaattaatgcatcgtatgaaagcaagtgcgcaaattgtttatatgacatagcatatatatatagcaggggcgtgtcgtttctgcatatttggcctatcgacgagatgtcgagatagatatcgctatccatatatgcatgcatggaagtaaccctaccaggtcaatattgtttggtaaacatagtgttttacggtttattttgattcacaatgtacaggagtggagaaccacacaggtccaggaaaaaaacgcgccatgtatgtggaaaaagaaatgcgccatgcatggccatgcaccgtccagggagaaagaaacgcgcagcaaaataaaaaaaaaaacgcgccctacatcgctcaactaatttctgtcatgtctattacattatcatttatagaaatagatagatagatgattatagacacacacacgcacgtgctgaaccccccagtcaacgcatgaccaaagacgtgaggtcgccgccgcaatatatatacaacaatgcaagaatgtgacgcgtagtcgtcgtcgcttgacctcagatgagtacctggtctcgtctctttttgaacagtaccgtcgttgcgcccattaatgcgggagaatttcgctggcaaaggttcctccgctcccttggcagccaagaccgatcgtgatcgtctaggtaacaagagcatctcaaaataaagcataatttatgagccatttaaataaatattgttttttctaatccatcactatagagattttcacaccacagaccattggtataactctat

SEQ ID NO: 126 - DNA, 1136 bp, Zea mays
  misc_feature (1)..(100): optimal_loci_285474_G1, chr8:117644034..117645169, Cluster 1
  modified_base (1006)..(1006): a, c, g, or t
  misc_feature (1006)..(1105): n is a, c, g, or t
  modified_base (1007)..(1007): a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
atttcttagttgtcttggcccatacggccgatcagtatttatagcgattacatgccaatcactggcccacacgtcataacagctcagtaaatccactactaccacttaggctattctcaatgggaatttcataacactctttccaacactgtcacatcatcaaaagtgccatgaaactaagaataaaacaatatctctcaatacaaaattccacttcactatttcataaactaacataccaattaaatgctacaactaaatgaccaataaaagttagtaaaatatgtgaagatgaaacaattcattctcaatggagatttcacacggtttccaagaccttagaaatgggttgacatggaaactcattcatcttcaatgttatgtcatgtcatctaaaatgctgatgtggcacactattaaatatgcatgaaaccactatgaaactatcattgagaatagccttaggctaatctatgcccgtaccctcaatacaaggtaatgatcagattactactaaaaccacctcacctttagagctgaccacagacggtgctctaacaaaatccctcctcgcttcaccagtacacattacccgcaacaaataccaccgtccatataagaaccaaaatgatgaaatctcaactatttctcgagtacccagcacagaatgccaccactaaccacacatgaaacagaagataaaggcgctaacctaaaactaaactaaacaggagatgggagccgcgcgtacttacccgtgagcgaaggacttccgccatctcgggcgtggagaagaaatcagccagggcggtggtgaggcggaccttctggtcggattctgacagcccgacctcggcctcctcgggaaagtatgtcggccagacatccgcgagccttctgaattgaaggtgtagtcgtccctattgcccttgtcccctttgggttggtgacccttcattgtgtcgccgtacatttcgtcgccttaccggatttctcggaggccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttgcgttgaaagaatcagcttgtattcg

SEQ ID NO: 127 - DNA, 1175 bp, Zea mays
  misc_feature (1)..(100): optimal_loci_287671_G1, chr8:129775119..129776293, Cluster 1
tgaagacataaacctttctcctgctgaatctcaagcccgagggctatgaagatcatggttgtcgtagtctccttgagcgagctaccaactggaaacaaaagaagcaagcagaaagccatcagagaagcagatgaaaatattgctttgcaccatgctcacgcatgtgctcgaaagaagaagtgcttcatcacccgagtataggttggccaagtcgtctactcaggcggggaagaaaaaaacccaaaactatcaccgagtactatgcctcatctatggggggtgctcccgtacctatccctaccttcgacttccagaatctatatccccactaccctcctagccagctttgacgctcccttcagagtaaaagaaaccctagatgccatcctcgccatgccttcccaaagcgccccggccctgaaggcttcggccccagtttctacaaagctaggatttggagaatttatcaaggatcttaagatacttggtacaatcttcttaaagccaaatatatgccagaaaacaatttcttcctctcaaaaaacaaaaaaagcaaaaggaggtttacagaaagtaaaacatttatttcagtggggggctatgaataaagttgataatggggagggtactcttttctggcagcacatttgattgggtgatgtgccaattagtgtgaggtatcccagagtctttgacatctgttcgaaaaaggaggttcgtgtctctgagtgcatggaggatgggagctaggatttagattttgcaagaccctcacagtttcaaaaaatgatgagtggaaggaccactattctaagcttcaatgttacacctttttctcaagggggagacttggtgttctaggcactagataaatcacaccaattctctactaaatccctattcaagtttaggaccgatggggatgcatgggggtattacgaaaaacatccgtctaataatctagaagtgtgtagggtgcctttgaaaatcaagattttccttcgacaactttataataggaaaatccaagctgggatggtgataaagaaaagaggttggaaaggatttggcgcaagggagaggcgggagaaatgcgtgccataggcacgtggtgtacgaagcgcgcacgccactgagaaattggatatcggatatgtattcatttcatatccgga

SEQ ID NO: 128 - DNA, 1317 bp, Zea mays
  misc_feature (1)..(100): optimal_loci_289802_G1, chr8:141919392..141920708, Cluster 1
tccaaaagccaatcttaggcaaaaacacaatgaggtatctgcataaaagcctgaaatacgtcttgatgaacataacaatttctgttgtattgcattgttgtgaaaaatctagaacgagtgctatttcaagaagcataattcttatttaagtggttgtaaaagtatgagtgttcctccactcttaatattaccaaaaatagtctaaaatatgtttcaataataacatatttaaattcaataataacatatttaaattcaataataatgtatttgaagagatataaaccgtttaaaacatgttttaaattaataacgtatttaaagagacataaaccgcacggacactctagttccatactgatgcagtagttctttagggtcggaattgaagagcacgcgacagggaccgcgacaacgccgtgcttatcccagttgctatcggctcctcgtcgcagaaaatgattttgctgcaaaagcacaaccgagctaggtgtagtcaagtagtattgcagggatatgtcctcttcgccattcctgaaaataggtatatactggctttagaaacacatagacagttgatatatgagcatgcaagcaaaagatagggcgggtttggctctcgccaagtgttcaggtgatgcgctgtctgtctcatgatttcagtgtggcaacgacttccacttggtggccgtgagtatggagaagataaagatgggtacagggcaaccacttccacttggtggcaaagaggggcgtatcagcgtatgtgctttagcaaaagccgcatcgtgcttgctacctccattggataaccaacattccatccaataaaagccacgggataacggagctgggaaaaggcacttgagtctatctagttctaggactagaggcgtcaatgaggacccgatatcggttaacctatgagaaatcatctattagagttagagtatgagaagatttcaatcctcatacatgggtacaaatttggggaaattcttcccccattagatatgtgggtatgggtatagaaaagcagaatttgaacccaattatctacaagtaatatattcaaccattaaaattagctatgtgtcccaataggcaataagtccaacaactaaccctacctcttcaaaccttttagccacccatacatctaacccaggcagctagccaccagccgcctcatctaccagtccacgtttcactttgtttttgttattttacatggtcaaacaatgttttcttgttacatgtcaaatttttttgtgatgtattattgttgggtgtcatgtggcttttaaatgtcacaaa

SEQ ID NO: 129 - DNA, 1351 bp, Zea mays
  misc_feature (1)..(100): optimal_loci_290491_G1, chr8:145242805..145244155, Cluster 1
actatcatagaaagaagtgagaaacacatgtcatagagtatcatacacatgtaggcacaacatatcatataatgcataaagtaaacacacatgcgaagtatgggagaaacacatatgccctgtttggatgtagatattggagcacagaattaggaattggaatcagttttctagaattatattgtttggttggtgcatggaattgagatttggaatcagagactcaattccctagaattggactataactagagaccccctctcccaatacagagcattactcctctatattgagtggaattggaccacacaattccaaactccaattcagtaacatgcaaacaatagaactggaattacaattcatttcaataccatgctgatttgtaattgaacccaattaaattccatatccgccaacatcgacatcaaaacggagaaatagagatatcaaatactgatcttgctcatagctctcccctatctcacatactatccctctctcccgtcgacatcaagcaccaaacattaaggaccttgtgtaggggtatacatagtcatgtaaaatgttgaggtacgtggtgagacctcaaactaaatgagaagagtgtccttgtctatatctgatgactcttctagctgtccaacaagctctaaagctaaaactattatctcaccctctagctggccaagtgaagtcgttgtggcaaactattactcagggtctaatggcataactaaggatgatatggtgtcgtcagtacccatcaggggtgcctaaaacatgaagagtatgagctttcagaagtgaagtttattgagatagatctcttgtgagctaactgtgagtagtagattctatctgagtaggcggtgcaaccgatgtctctattgtcactgatattttcaaatgtgttgtagaagtgatagcccatgacacgctagtaggacccaaagtgacaccctatcatagtgaagataagtcaagaatcatagagtgaattagagacacataatagtagagaacctggccttaaagtcatctgaactatatcgctagggccataagaggtctatagtatggtaggagataccatttgtactggaagaggtggtgctgactcttttgtctcctacaaaatgtgttggaagtatgtgaagttgcttgtcctatctactagcaacaattgttgaaaaataatcttgtctagcctaaataatctcaaatagggtgatcatcctactaatctcacactattgaacctcgatatgacatctctactcctccatgttccatgcatctctacatagctaccaactatgatcctctactattcaagtggtagtttat

SEQ ID NO: 130 - DNA, 1029 bp, Zea mays
  misc_feature (1)..(100): optimal_loci_291264_G1, chr8:149128030..149129058, Cluster 1
tccctctctcagcccgtccttgcccgccgatgtggtacaaaactacacaaaccatcagtcatagaccaccgaaccatctatttgggtcgtgtggaagcccagtcagcactaggtggatcacacatccggcccactagaggcagaatgctcggtggccactggccaggtcgtcttccgttcccgctcctcttccgtgcgcttgagcgcttcagccttcagccgttgtccgcgtctcttctctctcatgatctcatcttcgctgccgccctccacattcgccgggctccaaacgtcgcgtaaagccccaaccgtcacgcggataggagaaggggtttgccttgccggatgaaggcgaggtcgcagattgcgccgaagcctctcaaggcggtggcgatggcccccagaccgagcggccctaagcggaagccgaggccgaagccggcggggaagggcgacccccgcgcacccaagaagccacccaccaccttcttctacttcatgtatcatgtatgttctgtgctggctgctcccctgttaatttgccgcctacggatttaatgcctgttctggccgcgactaagcaattttgattagttgggggttctagcgtgcatctcttacatatcaaaaaattctaatgtatgctagtgttagtgcaaggtactgctaaatgggctcaccattgtagctcagcagcttgtgcaatcaggcttttgcctagtcttttcgtttcttttcttttaacaaattgccatttattgcttttgatttgggaattgggatgctgggaggtaaggttacattttttgtgcactgtggttttgtctttcagtttcatctcgggatgctgtgattttgccatttcttgcttttgatttgggaaattaggatgctcaccattataggtttacattttttgtgtactgtgattttgtctttcagtttcatctaggattgagattattggttaatgtcattgctgaacttaacatatggcactggtgtgaagaacatttggaaagtaatcat

SEQ ID NO: 131 - DNA, 1399 bp, Zea mays
  misc_feature (1)..(100): optimal_loci_291360_G1, chr8:149604238..149605636, Cluster 1
gtactaagcttttgtgttaagttagaacaagaggggcttttaataaataaatatatacaagccgctgagctgtccgcagtccgctggtgtgcccatgtcggcatgattgatctgtcaatgtgtcatgtgtgtacggcacagctagccctacaggagttctatgcatgggtaatccagtgaacgaacgtctgtcctgtggctgctgccagcgtcccttcagacgcaggacgggcagggaagagaaggagacaggccaatcgggagccacctcagaagaagatgcgcggatccacgggattgcaagtttgcaacgcataaacaaagcgcgcgcgcacacgccgcgcgagccgagccgatcgagaacggagagggagtaaacaaaaaacgaccccggcctgtccgttctcgtgttcattgtcgctgctggcaccgcgcgtgtggtatatactgctagacggacgatctcctctcggtgttgttggggctgacgggggaggggcgcgcggcggcagtagccgcagtgtgtccgcctgctcgccgacagcgccttgtcagccgcgcgtgcgcccatgcatgtgctcttcctgctctctgcccatgcatgcatgtcgtcgatcccggccgtcagcaacgtgcggtcgaccatgattgggtggctttgacttgcacgttacccgaggcacgcatcatctcctaatcctcctcctctctgccatatgcccatacggagtatgagacagcatgaagtttcaaaagaatagcggcatgatatatacttaactcagctcccattgccatgcaagggctcgctagcctagctgataaataatgcctctagtgtagactgtagagacatgataattaaggagaggttactccgggtcggagcttagcctagcgagctgataaagcccctgtactcgggaaaatgcaagttatgaccactactaccggccggccgtaacgacagttcatgtgatccatcgccatcagtgtcccgaagggccggggtcaatgtaatcatgaaaagggagattgtcgttcatgcatgattacagaaaccaaaagatcatgatggatttgttgtaatggcggttttgccttgaaaagacattatatatcttcttgcgatgcaggtttcatcgaggcccaccacaatcacgtacgtacgtgtggagataactcggataactagtgcgcgtacgtgtggttggtctcactagcctgtcaccagtggtggcctgccagatcatacagaccaaatgaccatgcgtgcaagtacaagtagccagtgtagcctctcctctattactcgaaaaaggagtttatgttggaagaccggttctaactgccataacctaataaagggtacagtaccacttgatcactaccgaaattc

SEQ ID NO: 132 - DNA, 1303 bp, Zea mays
  misc_feature (1)..(100): optimal_loci_292933_G1, chr8:157874429..157875731, Cluster 1
atgtatgagaaacacaatcgtctagatagtgctgaagatatctttgaacgggatactcaactgaattataaggcagttgacaatttttacaaggctattgaactgatgaggcaagtaacactagagccctctcttgagtttaagaggcggggtataatataatctgttagatccatgttatttttaaattttcctgtgtattttatagaacattcatactaacaatatgattgatgcaactgctgccgagagaaatgagcctgttcaaatgaaagtgtataaatatttaaaactatggagcttttattttgatatggaggagagcctcagaaccttagactctacctatgaggtttatgagagaatattagttttacaaattgtcattccacaaatagttctcaattatgcctatcttctagaggtaagatctttctcaaaaaatcatggttttaagtgtatttcctatacgctaaaacatatgatttaatttgttttctgtctcaaaagtcatggttttaagtgtattatttcctatacgctaaaacatatgatttaatttgtttgttgagtgcacgaacggtttagcacccaatagggcgctttctcattctagttataataataggatctttagcccttttagtaatacctatattgtcatccctttaacctccagagctgaagagagcccattcccccaaaatatcttgtttattccatttcatttgctaggaatgcagcaacttccagttcgtgtatcgctcgttatgcttgttaacatctattctaaattttaatgcaatatagtttttgtgtattagtatttatatgcaatataatttcattccaatgtcctggcgatgaagctattgtgccattcgaatgctgatcagtatcagttttctgctaacattgcgcccaaaaatttagccggtcccaatcgtttggtctctactctttgacccgccatatataaactgcatttgtaatgaaactatcggttcctactgtttgcattccatttactcacttgtgaacctgctgtgtcactgaatacatcttgtatcatgcagttagtgatagatctagatatcacttgacttcggaggtgtttggttcttaccttctaaactttagttagtcacttttaatctctaaaatagcaaacgagatgactgaaataggtcttgcaaataagatttggagagactaaaatttagttcctaaagtttagatatgatagagggtgcgtagcctgcgtttataatcactatttttgtgtcctttacatggtttgtgt

SEQ ID NO: 133 - DNA, 1036 bp, Zea mays
  misc_feature (1)..(100): optimal_loci_294447_G1, chr8:165292811..165293846, Cluster 1
aattgaacactcttgtataaccaattattataagtaatttgttgcctttatgatttgtggtttgtctttgtatgatgccaatgatcttttcgtctttatctgactatagaagcaattgttaattgttttttgccaacacatatcagatttagttggatttatgattttatctaattctcgacacaaaaaattatacaacgtttaccgaccctgaaccatacaactgtgtttggatgtagacattcggcctcacaattcagaatcggcattcaatggcttaaataccactgtttggaagcacaagaatttagaactggaaatcgagtccaataccagctcggaattcgctacacttgtgcccccttgccactgattcatagcctcacccctccgttttgctgggaattttaaaagccaattttatggccatccaaacaacagattttaattgtggaccatttcaatatcaaagctgatttggtattctctccaatttaattcctttccttccaatatcgacatccaaacgtagccatagattattcctacatgccttacaatgagtcgaatatgtaattttagtataaaacataaacaatagccgttatcatgaaaaaaaattcagatacctgaacaaaataccaaattcctattttttatttttggttggaccttcataaatgacaattagacttgatcatgggtcacccgatccggccaaaccaattcgacccgcccgaaaaaccccaatccgatctgatctgattaatgcgatgaacatatacatgtagtagtttttaacccacaacaagtcacgggccatgatttttggctcaaaacatgactcaacctgaaaaaactaatctgacgtgtccaatcggaacgcacggaccaacccaacctgatcagacactatataagggtcggatataggccatgctaaatgacctataacctgatcttaactcgaccgaataggtctaatggcaatgtcttccgtggatcttaaattcaccatctgctggcccgtaaacta

SEQ ID NO: 134 - DNA, 1127 bp, Zea mays
  misc_feature (1)..(100): optimal_loci_294706_G1, chr8:166631896..166633022, Cluster 1
gacggcggttgttagcggcggcgggatgctggcgtgcgcgatgtgcgcgacgtgcgcgtgactcgcgcgcgtagggcgggcgggcgggtgacgggaaactcggcggcggttgtttgcggcggcgggatgctggcgtgtgcgcgcgagaggaattgagagcgggggcagtctacagacgggtcttaatagttgtagagactagtataatgaatccaagccaaatccgccgggacgaaacgaaaccaaggccgagaattcctccagcaccgcgcgcgtctcctcgttctggacttgggacgggaccgagggagcaagggcagcagagcaggccgcggcagcgtcgtgcgcctcccgtcccctgtggatttccggtcggcccgatggacacggtaataaaacgagggtggtagtacgaacgtatagtgaaaaaaaactggggaccggcgtccgttttgccaaaagctcctgctactccttccctagagacgagcaggcggcgccggcgggcagcggtttacaaccagcggggctgggcctgggcgcgcgcggcccgtatcctgtgcgggctgccgcgaatgaatgccaacttgtccgcactagcgcagctaagcgcgtccagcttttgcctttgtgcagtgcaggtggtggctcgctcttgtggagttcgtgaccctgacacggtcagtgactcagcgtgtttccggcgctaatagctagtactactagctgcgaaacctcgctactagtatgtgttcggccggcggccactgcaccgcccgcaggccgcggcagggctgctggctgcatatgcgcccgtagcccgagtccggtggcatggcacgcagcgcatggatgaaggatgatgagggcgtgtacaacgccatttactcaggcgtctccacatcgtctccagggggttttttgaaaaaaatctctgcagccgttgcttggtggggagacgtctctggctcccgtccctagcaagaaccgacgaggttacgagttctggccgtctcttgctgatctcgtgtggtggcaaggagattaggtggcagactattgcagttccagtagtagctgatacaaaatgtgtgtgtacatttgattaagagtgtttttaagtctac

SEQ ID NO: 135 - DNA, 1043 bp, Zea mays
  misc_feature (1)..(100): optimal_loci_294707_G1, chr8:166633408..166634450, Cluster 1
gcattgtacttgtacatgccctgactgatgagccgtgagcgactccgagagcccgcgcggcgaggcaagccgaggcgagaggccgcgcgtccattaatgctgacacggtctcggcagggctcacgggacggcgccgcctctagcctttggccttcggctacagatcgcgtgcgccaactccacgccaacctccaaaagggggccaatgcgagctcgagcggcgggcggcgccgccgtcgcgccgctctgcccacgcgtgcatgccgggtcattatggggttgccggtggcggctacccgtagcgacggaagcgcccaagcgggtgctttggatccacttacatttattacgtattggctctcactaatcccgatccgcgctatcatgtatcatgtgacccgcgagccgttgaagctgcgcgtgacgccgagctcgccacgccacacgcgtccggccggaatgcctccgctgccgtgtcctgttcgtcgcctctctattcgtttcccaggaggtagtactggactgggccgtgccattcctgcgtactagagcggcctattttatccctgacaaagtcaatgcacagttacaacgagtagtacactccacattggttctgctatttatgacagcagccctgaaacttttctttttactgttccctcgatcggtactgctacgcacgatactcccagactaccagcggctataagattcagtgaaaagtatctttaccgatattgatttccctaagcaagttctgtattccatatgcaagaccccatgtctcatatatataaccaacccaaatatacttgctttcatttcacacctaccaatatataagacatttcatcggtctcctttggggtcggggccaccaacgagggctcctagtgctccatcatgggtctccttttggatccagaccgccaacgagggctcctagtgctccagggcataacatgcccctaagccctactctggagtctggacccagacaggggtccgatgacgacacatggctgctggacgcatagtgc

SEQ ID NO: 136 - DNA, 1061 bp, Zea mays
  misc_feature (1)..(100): optimal_loci_295977_G1, chr8:172232105..172233165, Cluster 1
ggttcacattttgtggttgattaattcgtgtggaaacctaaacacactccaaactgatcgtgctaaccgacactcgaaaaggagatggttaatggtacgaggactataagcgaaaacaaacggagcctatatctgtttacaagaacatggccaaagccagttgatactagtttaatcagctggagttgatattgtaccaaacaaaagcatccagtcgttactaccgtgatcgaggagactaatcgtaatcggtgagaactgaagaaagtcaactcgggattaggaaggcaaatcattgctcaagaatcgttacatcatctagtcaaaggaaggccagctgtggtggcactttcgccgtattagcatcaactgccgttcttatccacccggatcgaccaagcttcttccacgtcgtactaaaacattttttttcccttgtatgattaagttttcgcctttcggtttctccttcgcctttatttcgtctccgttttcctgtgctaagaagtggtctactgagctgtattgcacacaagggcatgcatagtgttttccatcttttggcagcttaatggtacttttttttttattatttggtctctgtctttaacgggtatttatcagtagcatgtaattgaacatctcatgaagcaacaggaatgaaattaataaagtaggaagaacaagtaagaaatatttactaataagctaataattgaagtgctgcactgactaaacagcaaatctgctgaagtgctaacaatgcaagctgcttgttcgctcaaaaaaggctaaataaactgtgtatcataaaagatgcaacccggcccttcctcctcgttgttacgctaactgcttctagttaggctgaaactaaacaattagctttggcgctaagcaacctcgctcgggtcgggggggacacaggttttcgaaagggaaagatcccggaaaaggagaagcagaaaataagacctggccggggatggatgtggacatgtcaccactggccggctttaccgcggcggccaccataccattaccagcacagcccaatccac

SEQ ID NO: 137 - DNA, 1259 bp, Zea mays
  misc_feature (1)..(100): optimal_loci_299681_G1, chr9:11579121..11580379, Cluster 1
ctacaagtatgaaacacaggcacgtcagtacccgatgccccatttagcatacataggaaattgaatctcactgtgctcaatcgattctgaattacagaaaagatataaagcgacaaaaggtgaaattcagtatcagcaaccgtatgatatatgtgcttgctattaactctctattacttaaagattgtttggtagcgaattgtaaacatgatacaaggtgaatgagactgattaagcatgaacaagaggcaaacggtgtaattactaatgtgcatttgcaaaacaaaaaatagcattcaaagctgaaatcagtgctctatatcagtgtctgccggcgaaggcaaatcattagactagattactagacaaaagtagtttttggctacaccaattcacaaatcattaagtgataacactatgaatgtttcaaaatgacatgcatactgaaaaccttttggctgcaccgattcaccaataaaatcaaatctacaataagaaaatttatatattagataacaacaatataagaaaagtgtattgataaaagtagcatagtgaatatacagctaagttgtaatatgtgggaacaaatttttcccctaaacaataaagtactttacacatcatatatgtgatcgaaagataaaatgattttttgtaagctttttcacaagtggctagatgtaacgaattgattgctgatctaaaaaatgagaggcatcctgttagcttgtgccttatccatccaattccaatctcgagtttctggtggttggtaggttaacgaacaatgtgcgggtgcggccatgacccatggccagattcgaaggaccgcgacagccacgctataccccttctctccccgtccctcaccactgtcgtattcccttggttcttgtgtcgatgaactgagtttgagaagagaaggtcgaggcagggagcttaccagtgaccggcggggcagcagcagcacgaacgcaagatcaatctctgggtgaccgtccgcattctgcaggtccgattcactcagatatttttgtcccgacttttgagcgccttctttcctgactccctctctgatcctgtgtagatcgtaaaatttgagatggggcaatggcctagcttgcccatccgtgaaccagccgttgccctggacagcgtgaacccaagcggccgcacattattttgcagcctcaacacatgttggttaagaatcagcacagcacgaacttgcacaacagggtttgcctacgcagaag

SEQ ID NO: 138 - DNA, 1203 bp, Zea mays
  misc_feature (1)..(100): optimal_loci_299840_G1, chr9:12447071..12448273, Cluster 1
gtaacactaggtgaactcagtttgtacacttgtcacacaagcttgtgagccaagtgtcctactttataacactcaaggcaataacaaatacttcagcaccatactggacatatgagttatctctaaatcggtctaaactctctctttcccattctcgttaaagcaaagccattggaatggcaaaccacaaaccctcacctcatatacaaattatttattttagtaacaaaaccatgacagttgacacgctagatagggtactcacatattgagtttatttacgatggatcctgtcatttttgtgatgccttcctccatagatcgagggccaccttcgggactatggacttcatcaccgtggaggatgatagcctatgtttcatcatcccccccttaggataaggcaaggccaagcccctcgatgggcgtctctcggccaatcgatcaaggatcatgcggtatagcaacccatgcaaggatcattaggggaataggggaggtgaagataacccaattataagtgtctgaataagcccgagtttaggtaggtcaactagtgggtagcagacaaagcccaactcctcattcaaccaccccaacctagcatggggagtggtcttcgacattgttccacctagggcatgtcaagcatgtaggtcagagcttgttattgtgaagagtcatgacccttgtcactctacaacctcctcgacatgtcttctagcgatggctcctcaataaatccataggacactgccaacgggtcacccctccatgattgcttcatgaccgagaggaagaacacatcaacgctaataggagtactcccaattgaggatcagcactatcccgaacaagaagttgagtacttttagtgctaggccaaacaacacctaagatgacagaaggcatcataggagaagccgacactgtcgatgcagcaagtctcgactacccgcaacaagatgtagaacagtacccctatcacacctagattcaaggacaattctagatgcatcttatatgtgtgccatgatcagattttacatttaagatgattcggtgtatataaactagtgtcataaactttattatataagtataatgtcttacaaaactaactaaataaaagaaactaaacgactatgacgaagatggcgacaatcctgctaacgagacacaggtaggttgaccggagcgata

SEQ ID NO: 139 - DNA, 1353 bp, Zea mays
  misc_feature (1)..(100): optimal_loci_299991_G1, chr9:13478616..13479968, Cluster 1
agctttaaaaactgctagtgaaattagatagctagctactagctaagtttagctgggtcgaaccagctaattaggtaacagatagttgagggtatagctaatagttagctggactattagataaggtgtttaaatgtctccaactaaaagcatataatacctaactattagttaggttatttagatgtctataactaattttgtcagataactatggctctctgatgcattatttaaacatgactttagtcgcccgtggtactcgatctctgagaaatatcctgcactgcatttgcatttttcaccataaagaagacgaataaatggtgctgaaaacaagcagcaacaagaaagagagagaaaaaaaaacttgaattttgaactccgatacagtacgagctagcgagaggaggaaacggcagtgtgtagcggctgacgatctgtcggccccctgctatcatgggtcaataataactaccgccatccccgaaagcaaaaggctgatgatatgggcgagatcagataaaggtggacacgttaattggcgcgcgtaattacgaccggccggcattacttaccccaatagtgacggcgccagttgagccatatactgtagtacgatgaatgttgcgttgcgttttgttggttgggcagctagctagctagggcgggaaagacgcgcgcggggcacgtacggtgatcatgcacgcgtccatatcttggcacagccttacggcgatatggaaaattaatattacgcccgcgatctacctagcccatgcatgcatgcatattgttgtgtgtgcttttttgtgcagctgcaggatccaaggacacgtgtgtacccaaagctagctagctctctcgactctggaaggtggaaataaacgggagctgacgcgtgtcatgatcgtcgagcaaagagccctgcgcgtacgtacgtacgtacaccgctcgctctcgtccaagagacgtccatgcatgcgatagaatgtagtatagtacgtgtgctacgtacgagctaggtactccaatttgaatcgatcctcagtgcatgtgcgtatacatgaacgtatgtaatggtgcacgtagtatatatatgtcctgctgagatctcgatcgataccaaaaacgcgtgacgcgcgcgaatgatccgctgcgcgtatatggtgcacgtttatacgttcttagtactactgcctactgctgcatgcacaccctagctagcttcctcctgtacgtaaagtcttcaagacaaagttcggaccagagaaagcgtgcgtgcaatgcatgcacgcggttgcaaatcgtgatcccagccacaactccttacatgctttgaaaaaaaaaaca

SEQ ID NO: 140 - DNA, 1058 bp, Zea mays
  misc_feature (1)..(100): optimal_loci_300741_G1, chr9:17729374..17730431, Cluster 1
ccaatgatactcttcgtgcaaaagctagcagcaagtgctcggaggtgagagaaaggtacgcataggtgggcgggggacagataaattaggttggaggccacttttagcataatttagtatctttggtggaactaaaatgctaaaaggtgctaaactttatcacaataattttagccacactacttatttctttagtagctaaactgtagcaaaaaataatatagtgctagattttagcagaggaaaacaaacaaacaaacgggaccttagaatgcttggcaagccggcagtgggtcggctcaaggcaaagatatgattgtagcctacattacattaggtagtcttagggtgcatccggtaacgtttctatccaaaatgtggatgtggggggcgaagccactttgactttcttggtgcaccgatattagccgtaaaacaaaattttattaatacctatcttaaatttaccagatatttcttttaaaatcgtatactttgctttatgtttgataaagtgtgtatcatgattatatttgagctggcttcgcccccatgtgagtcagtaagcagggtataatataatatcatggtgggatatagaatcagcaactttatggggggattttgactacctatatatatacatatggtctcagcatgaaatgtaccaccacgcggaataagggtggtggaataaaaaaaaagatggtcgacattttaaagttggaatagataggtgggtgatactcgcacaaagttcgtccaaaagaaagcagacacgtgccctctcgttaaggttttttcttctccttttgtcggacctggtgagatgacacctgaccaataaatgcaagccgtgaccatgaataattgttctggacttgtgagtaattgttttgtacgtatggtatcgctgtttttcttcggcaaggccaaggactcgatcgcccgtcccttgctcttgtcgggcctcgtagtacgtcggcgacggcgacggcgacagtggtccatcgcggcagcacggggcggcatattctggggggcaggtcgggcctcct

SEQ ID NO: 141 - DNA, 1257 bp, Zea mays
  misc_feature (1)..(100): optimal_loci_3016_G1, chr1:15345877..15347133, Cluster 1
gagcgctttccaccgtgcaatgcgatcttgcggctaggaagaggtagaaccatggtgcacggatggtctacgcgtactcttatagagtaggagagatgtattcatttatatcatatgattaaattgtttattcaataagacttgtaatatatgtttttggtgatttatgaaatcttttattgagatgtaatcttgatttgttgagggttactgtggtctgtggttatggtacacaaccagaatccttaatcttgatacaggggagacgtggatgacatctcctagggatctttgagattgatttgctagggatcaagggaatgacactcaatttagataaattgacgaggttggtccctacatcctcctccatttgctcatgtaaagcttttcccaactcaggcaatgcagtttatgcttattgtcgctccactgcaaatcatggcactcatcctatcacatagttgttttggtcaaaccaaagcaccccatgtggcgaaggttggatggcctgtgccatcgctttgatcaacatttctttgccggctttcgataacatcttttttcttccaccctagaatccgctcccaaattcgcttcgtttataaaattacaggttcccacccttgagttcccaacatgtacaggcaagccaagatagcgatcgttcatcgtttctgtagctatctgcaggattgccttgacttcgacacgattagctgcccttagcttgtattggaactgaacaagacgttcgatttgcctttattgatcgtccgtccagaaatacattcatgcagctcaaggattccatgaacttcttctgcatcctgtctacctgtccgaacaagcaaaagggagtcagtcatatgcaaagaggaggtgcttggagcttgatggcatattctcactcctctaatcaactcatccctttccgtttgattcatcagagcactaaatccttccgtgcacaaaagaaactctttgataggttgccattcaccttcactttataagatacaagatcagtcaccttctccggagatggcacctttcacccttgggatcagcgcaatcgttgtttcactccaaagaagatcaggcatcggcccaaccttcagtaccgcctacagctatcttcgatcccatcaatcacatggcagttttctttttcttaaaaggttgttggcatataatccggtcctgacgcctaaatccacgatcacgtccaaagctgcctgttcgaaccaaaattga

SEQ ID NO: 142 - DNA, 1138 bp, Zea mays
  misc_feature (1)..(100): optimal_loci_307617_G1, chr9:62338570..62339707, Cluster 1
cctagtttcagaacggcacttggcaagtttgtctcttcaggttttctaattgatggcagtttttaatttctggtggcgcaggcgctatgtgatttctttggctccatctgcattgttcgggaaaactgttatcctcccgtgaattctggataagctgcatattgctggactgtccatgcgaagttgcagagagcactgcaaacactgattgcattgctttatcaaagagcctctagaaccagcaggataagctgtcgcttggttatctgtatttttgtggcttttgtcagccattatattttgtagcagacgtagggctatggggcagtaagaacataaaccaccaacttcgccgaaaagaaagagtgaacagcggagcttcggcatcttgccgtggatgcagacttcagtgttaggcaaaattgcaatttaatctggagattaaaccttcgatcggtttgggaggctagcaggtagaatcacaaatttttggtaggggtcacttgagttgctgtataagaacatcaggctaatgggattgagaagcatggagttttgccctcgaagaactgctttgcttcggcttagatcatctgacaactaacgtcatagtcatgcagctgttggtttgtttgggaaagtgaatcggaggagattgaagggaataagatactcttactattcaaatgctaagagaattttagcctatttacagttggtttgaaaactcaaatcttccgcccttgtttagatattttcatattcaactcaatccacatgtattgaggtggatttgagagtatctaagcaaggactccccgagataagagggagagatctgagtaccaaactagcgcttaggtcttattcgattgcatgaggatcgaagtgaattgacaaagattaaattactttctattaaattttggctagtaaattccttttcgatccatcctaaccgaattagctctcagaacatgtttgggagaagggaatcgaaagggttaaaatctcttacttttcaacttgctatttaaaattgaatagtaaaaaaaatttatcaccttctattccctttgctctcaaacacgtcctcaatcttctcaaatttccttactgctaaaccagccctaaatcg

SEQ ID NO: 143 - DNA, 1371 bp, Zea mays
  misc_feature (1)..(100): optimal_loci_307893_G1, chr9:64111024..64112394, Cluster 1
ctcccaagcccaccactgtagcaatagggacaagacatgatggaggcctatgagaaacataagtatcaataatgcaacaacaaaagtgaataccaaagtagctcctatatcatttcctacgtgatagccagcggcgggtataggggtaagtgatatgctatttgatgcctatggtgatgacaaaaaaccgtgagaagaggtttcctccaaaaaaactattattaaagcttagatttaattaataaatttgataagaacaaaattgcatcttcatatagttcctaattagatttaaacacagcttgtccataagtgctcaatctcactggcctagtaaagaaaacatgtattgttatttgtatatgttttcccatggcatatacacaacagttcaattgagtcatgaggaatctgaaccaatatactacacatacaaaaggataaccttgaccagtgcagaatcccaaaataagcagagtgccaccccttccaaagattgcacataataatgtttgtgcgcatacaatcttcaattggtagctagcagcctgcactttatagacagatagatcacttaaccaagctcttggaaggagaggaaccaagaactgctcgagtgcttacattaatgagttggacaccacaataccttctgacatagataccctctgcatcctagcatagaaatattgtagcttcaggtcggagtcggtgaggctctcgtagacaaccctgagcttcttgtcctccacgtccttgaaatggccctccaaaatccaaaagaaaggaaaccaagacaaatatgtcctgctgtgcacacacagaaacatcccaaatctaaggatcagtagatggtaacacatttgcgcagggaggagcaaagtgtgttggaggcgctcgacagcctcttcatgatggtgcagcttccccacgacgttgccacttgtggtccgagagaagccaccatgactgtgtgccaggtcctagggtcgagcgccacctgcagggtgcgactcgggtcagagggcgtcctgccactgctcgtcaagctggcggagtactttagcatcgcagggtgcaagaaggccgagagggggaggaggtatgagagaggtatgagggggatcttgacggcgtgcagctcgacgggaggttactttcgtcgtccttcccgtattttctggaagtgtcatgtagtatggaggaggccggttgcctagttcaatcggctgcacagaggaatcatgaagtgtttcatcaccgttgaaatatgatccgaaggccataaaaaagaggatgacgtggagcttcgaggagcgagctttgctcccacgaataatatagagaaaaaataatataataccttttatc

SEQ ID NO: 144 - DNA, 1184 bp, Zea mays
  misc_feature (1)..(100): optimal_loci_320575_G1, chr9:136039639..136040822, Cluster 1
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(179): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
  modified_base (164)..(164): a, c, g, or t
  modified_base (165)..(165): a, c, g, or t
  modified_base (166)..(166): a, c, g, or t
  modified_base (167)..(167): a, c, g, or t
  modified_base (168)..(168): a, c, g, or t
  modified_base (169)..(169): a, c, g, or t
  modified_base (170)..(170): a, c, g, or t
  modified_base (171)..(171): a, c, g, or t
  modified_base (172)..(172): a, c, g, or t
  modified_base (173)..(173): a, c, g, or t
  modified_base (174)..(174): a, c, g, or t
  modified_base (175)..(175): a, c, g, or t
  modified_base (176)..(176): a, c, g, or t
  modified_base (177)..(177): a, c, g, or t
  modified_base (178)..(178): a, c, g, or t
  modified_base (179)..(179): a, c, g, or t
gttgagaaagtgccaaagagagagagagagagaaaaacatgagagataatagaggattgcatcgctaaggtctatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttctcctacgatacagtttgggttgtcagagtcgtcgttgcaggagatgcccggcatggatgatttacctgcagctagctgcagcgaggctgcgcgaagcatcgctgagagggttagttcagttcccttctcatttgctgaaactccagtatgatgttgatagtcttgggcggtgcgccatcttgatgttggatattgattcataagcagaacagtttccttgttgatgtttacgaaagaagggcaaggatcagcaagaggctgaagaagctgcaggatcttgtgcctaacatggacaaggtaaattaagctgaactgcaaatgtccgtttttttttttgcttgtacccattgatgttcgagaggaattactaaaaatcaggattcatccttcacgttcctcccaacaataaaatgataatgaaactggatttgctaatcaacagaacctagcatctcctacttggtgtcagtccattccatcagtaattcagtgtgcgttcttgtgattggttgcttgtaggagtgaatgcaactagctgagtccagccctgtacatgtggatacacgccgaacgaccgtggcacggggctggctctggcttcttttctgcacgaacgtgatctggcccaaccataaatacagctaaccaaacagcacataccaatgtttttttgcatgccacgggccatgtacttcaaagttgctggatgtggatctctcgcagacgcatttttttttatcaaaaacacatttggcctgtttgggttcccttcttatatgagccaagttgtactttggcagccaagttccaagtagccaggttgagcgcatgcatacgagcgatgtttggttatcgtatacacgaaacctggttgcttggagatttcgtttggttagcttcatgcaggtatcttcttacactcacagagccactgacatatctgatccacacgcttgttgcgctcgcgcgagcctggccacgtaaaaacgaaggttttt

SEQ ID NO: 145 - DNA, 1111 bp, Zea mays
  misc_feature (1)..(100): optimal_loci_321304_G1, chr9:139756055..139757165, Cluster 1
tacgcgagtgtgcacgacgtgcatacatctctatatgtcacactgaacaagagaaaaaaaaatcatttagaactttgtccaccaaatatgcatgaatgatcgtatacgtaaaatgattttgatagatttgccatgaaagcagcttcgtattattcattcatcttctcataactagccatttcgttttgcctctgtgatttggcacatgcggtgtaggccgggtttttctggatttgtctgttgcgagtttcacggtccacaagaagaagaaaaaaaacggcgtttctcttgcaagtcctcccatccaatctgcatgcatgcatggcaccccgaccacgtcagaaaaaagcgccgacacgtgtcggccgggcacgccgccattggttcctttcttccctaggcttatccgcctcctatccccttttggccgaaaattcgttagatttccgtggccctcgttatctcccacggagagagggagagaagaagaagagatattagcaacacgagaaacatttctgtgactgctgctagcttctaaatcttcgctgctcctcgccgtcgtcctcggcatcgtcatccgctcggagggagaagcctcccactacgatcgccacagaaaaccgctagacaaggatgtggatcggtccttgtgttttgtgtgcgttcttttcgggcgatgcgaaaatgacccgacgtcacgctcgcttcgttaattaaggatggcatggcggggcgggtgggaggggaggtcaccgccggccacacgatcgggacggcgccccccgacgggggctgacggcgcggtggttcgggcgtcgcgactcgcgatagataaggatggggttcccgggtcgccatttgtgacggtggtggtggtgcttgcttcccggcgggcgggcggcggggccctcgacggagggaaaagggcatctatcggctgcgtgagggtcccgcacttgaggatatactgtgggcgcgtggagccggagcgcgggactgacggcgaggcgagacgaacaggcaagtaggcaactgccccgcatccgtgagtgtccgtgggcggtacacggttgtacgcgctgaaagtttttcgggacaggcggcgcgc

SEQ ID NO: 146 - DNA, 1351 bp, Zea mays
  misc_feature (1)..(100): optimal_loci_323504_G1, chr9:150833880..150835230, Cluster 1
accttcaaatatctgaactcggagacgtgtgtgttctcattgatcgttttgcattgtcattgggcttgaagttttccggtccaaatctagaggagggccttcgttgttgggccagtccgtgagtttgtaggaccgactgggggctggtacaggggaaaggagcccagaaagctatgcgcgaagctcttggcctttggaaagacgtcgccgggaacatggggaagcggggggaacggcgaggtggccgcgccgcgccgccgcgggagcacgcgcgattgcaaagggtaaaagctgctgacgaagccgacttgcaagtgacagattcgaactctgtacgtggtgacaggattcgaatttgtcttggtggtcatttttcaccccgtctcgaaaagggggggctgtctgtgtcttgcgagttgcgggtcgtacgaatttctccacatgatcgatctgacgagattttccttatttgtccgtccatacgcgttattaccatttttttagtagtgtacacatctgtattcacattatcacatagcccctaccatctgccagtagattagcattgccgacacacgcgaatatatactagtacggttatgtcgtcggtcgagaacatggataaggttccccgttcgagattattagcgtaaagcaggggactgtggacggatcattacatttcgtcgtacccataaaaaaaacctaatcccatgcaacatagcactagctagctatggtttatggtacaactataatagtggatatggatcaagcagagggccacactgagctagccttttgcaattatatactactactagtgtgtatatatattatatgccttctagaacgttctaattggccaaagcacaatagtaggctttgaaagttcaaaaggcccgttgcctccgtgtagctagctggtgccgtgccgtggcgtcacgtgtacggagtagtgcttggtttccccggccagtcgtggttaaacttgtggtaatgcgtgattacgacttaatcgtacaatgaatgatgagctgagctgcatggagcccagttgacttggtccccggctacatattgttttttcaagcgcggacggcgacaaccagcagatgggaatgcaatgggtcacgtcaaaagccctgttgcgtggtgcggtggcagagtaaaataggagatagctaccgtggcgggctgatcgaaattcctggcggatacagactccgcacggtcagcgaccgatagaaggcggcggcgacaacgaccacgacaccggcgtgtcggagtcgacagacaggatgcacaccgcgtgacgatctgattggaacagcggcagcacagatcgatg

SEQ ID NO: 147 - DNA, 1088 bp, Zea mays
  misc_feature (1)..(100): optimal_loci_324149_G1, chr9:153750613..153751700, Cluster 1
tggtggtttgcgcacgcgcgtgcgtcgttgggtatgtgtgtatatggcgaattggcgatgggtagcttatgaagcaactggacacaacggggaggaagaaggatctaatggggagttagttagcaaggacacaaaggagatggtgaggcgtcttttcgagggttcttagctaagccggggggacaacggcaaggggaaaaggcggcctgcctgccggccggccttgagagctagcagctagctagccgcgtgcagagaggaggcgacccagacggcagcagctaactgtagctgatgacgatgaggccggcggggcggccggggatggaccgatggaggtgaaactaactaaagtgcgggtgtgaattgcacagccgtgcgcgatcgagccggccggccggtaagaaaggaaggtaagatgaagctttggaatcatccaaagaggagaagaagaggaacaaaccaaagctagcaaattaaaggtgccgcctacagctagctaccaagagttgcaccgatggccagggtgctctgctgcgttccctgcaggctgctctctactctaccaactaggaagttggggagggcatgcatgcaaagtgcagtactctcaactttaggaggatgaggatcggagggctagctgcactgcacatgtggctaatatgtagcttcgcgtggatcatgtgtgttcgtgttcccatctaaattttctttcgctcaagaaaaaaaggtcgcatcttttggtgtagacggtattaattaggacacaccttattaacttgcattgtcgtactagctatatactgctgctactactactctggaagctaattaagagcaagaagagaaaaacaggtaaggctgttgtcatgccttgtgcaactagctagctagaggctacacttcctgctgatcttgtatgtgtacgtgtagtgctgcgattattcggctacacctctcctctgtcgagtgcggttccaatcacgcatagaatgcatcaatccatcaatccatccattgggattattaataccgactgagggccccgcccatccatccatccgtttattcgggacgaactttgt

SEQ ID NO: 148 - DNA, 1126 bp, Zea mays
  misc_feature (1)..(100): optimal_loci_324152_G1, chr9:153755069..153756194, Cluster 1
gagcgagcgaatccgcaaagtacaaggctatattccccaggctggggtgtggacgaggccgcgtcaccgtcaggcccagctagccgcccaggcgggggaacgcgcggtcggcgggtccggtggtcgatcggccatggccggccccccgtcggcgtcggctggtccacgcgcgcatgtagtcggcagccgggggccgcgcgcgtcggggttggtcgttggagagttccgagacagcgacgcggtgcgcgccagccccggcaggccacagcccacagctgtcgctaccgcggcctgtctgtcggtgccgccgcacgttcgtacgttacctgtgtgcgagcgaggtagcttgaggcagcaagccagctgggacgagagcctcctggactgactggtacggcggcaaccaactgcttcatgcagtacttggtctgttaggctagctgttacacttgcatgcaggacctgacccttcttcgttcacgagatcgatcgcagagctgcgctgcgaactagctagttcatccaacatgaaaagaaattaaagggcatgtcagtcttgggtagctaggtaggtacttggctttggcttgctttgacattgagccactttgagcgccaacaaactcatgccattgagcccccaactcatacatataaataatattataaataatattaatagtataatattaatgtatttatgtatataatgaacgtatagtgtatacggctagaagaatagtactatattttcttttttacttattattgtttcttgtttagttagttgaattgaatggattggtcttctattatacctcattccttactagctagtaataaataattactagcataataaatatagccactctatcaaatttcatatgatgaacccatgataaatcaaatcatctagaataaagtgacttcccaaactaaagacaccacgtcatccgagacgacgatagaagacgcctcacaacaccctcgcgagagcataaacaacctgtcattattatgatttttaatagatcatattgagtttttattggtaaaatttatacgtaatattaacaatgacctctatttaaaattttgttacaggcccccgaaatctcatgac

SEQ ID NO: 149 - DNA, 1132 bp, Zea mays
  misc_feature (1)..(100): optimal_loci_326427_G1, chr10:10152645..10153776, Cluster 1
  modified_base (461)..(461): a, c, g, or t
  misc_feature (461)..(560): n is a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
  modified_base (472)..(472): a, c, g, or t
  modified_base (473)..(473): a, c, g, or t
  modified_base (474)..(474): a, c, g, or t
  modified_base (475)..(475): a, c, g, or t
  modified_base (476)..(476): a, c, g, or t
  modified_base (477)..(477): a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
gcgccatggccgggctgcgcgcaccggggcgagctgacgcgcggggagcggcggggctgggcgggccgcacagcgggcaggggcaatgctgggccgccacgccgagccgggcaggggccacgctgggggccgctccgaacgggcgcaccgggggtcgcgctaggcgagcacgccggggccgtaccgggcgatcgcgccgggggccgccgggtcggggctgcgtaggggccggcccaaccgcgccgaacgggcgccgtgacgaggagagggaagaagaggggggcgagggagaggaggagagggactcacacgagggggcgagggtgcatcggggtcggcggttcgagcgcgtgcgcgtgagaggagacgagctgccgaggtagagaagaatgccggagtagagagagagagaggagtagtgggggctgacggtggactcatcagggtggtggcgcgacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtccattaacaaccctgtaggtgctaggcatgttgcagttctgtcccctggtcggctaggaacgactggggccaagcctggcatctggcgtatcgagtcatgaccgatcgtcgggacgtagaatcagtttcccaggcttccactgatcacttacgtgattgcgatgactagatgtagtctagcagaaaggttgtatggagcataggtcattagctcaatcagtgcccagtcgtcgtaccctgatgggaagtgtcatggcagggccgcacagtgggcatgggccatctctggcatacactcagtgcctcgcatgtggtcatgagtgtgtacgcgtgagagggtagcaccgagggttgcggtaggagcgcactacggggccgctcctgtcgaacgcccctggtatacgccgcggcgttgctgtgtcgtgtgcggccgcgtcgcgccgagtctggcgccctggacgacgatgaagcgaagaagaggagggcgaaggagaggagggagaagcgactcaccacgagggggcgagggtggcaccggggtcggcggttccgagcggcgtgcgcggt

SEQ ID NO: 150 - DNA, 1218 bp, Zea mays
  misc_feature (1)..(100): optimal_loci_337006_G1, chr10:77257387..77258604, Cluster 1
gctttaagtatatttgagaaatgtgactttttgtaaaaagatgacggctgcttggagcatcagttgaaagcgattaaagaaacaaagtaaaaaaggcttggacaccccatatatttttaggtggtgtttggttcttgtattttgtttggttcacgtcactaacaaagtcaaatagctgaaatcggattacagagccgaaggagcggaaacaaaagtgtatgtcctgtttctgattactttgtatccgattacacgggcggcctacaccaaacaaaatcagatggaaacataccaaacaaaatcagatggaaacacttacagctgaaatgggaacacgtacaattacactgaccaaacagcactagttctttccaccaaaagtaccatgcatacatagtagtgcctgccagggatatatacaaggttacagcctcacacggcacaagttgagttgaaagcgcgtgccgtcagcatgatgtaaactgcatgctgcaacctagctagctagcgcttgtgtgtgctgctttgcccctgctgcattgtacgattaatcagcgggatttgttaccgagaacaagttgggaacatatataaatataggtgccaaacaaaattaaataaattagccagtttgttatttgtggggcaacactagcaccaggtaggtagctagctagcagccatcgtcatccatcaagataatatatatattgttttcattttgttttaatcgtttctgatccccttctcgcatccaaattaagcacgtcgtccctgtgtcagtgataggctgaaaaagcaccgcataaatataacacctcctcctcctcctcacaaggcacagtgcatggcacacgacgcaaactttggtgtgtctgtctgtatattatttgtcatttatttggcctccatccaatgcggtccacccaagctgtcggtgtggtacgtgcccccataactgatcacgcatagctttttgagtccacgactaatctaatcatgtgtaccggaacttgtctggaaggcacttgctacggtttgtttttcgacatttcgtgacgagacaccatatatgcgcttgcttaatgtactggtcaggtgtattaacgcatggacgagctagctagctggattaaatgccctgctgcatgccttccggagagcacgtaatgagatgcggggggtacatacacaacctagttaacagcgctagctcat

SEQ ID NO: 151 - DNA, 1199 bp, Zea mays
  misc_feature (1)..(100): optimal_loci_337968_G1, chr10:82190294..82191492, Cluster 1
ggcgccccctgtagccgccatgagggggctagctcggggtgaccactgcagccagcctcataggtgttgggtttacaacgcacgacccaagttgaatatgaattgttgtacgaattgagaggcatctgaatggttacaaggcatcactggattcagcaaaacaaactacagaggtgcaggaacgttaatacaaggagttcaaatttaattttttgcattccatatgtagaatcgtaaacggaatctaaaataaaatttaggactcggtctgatgcaaactgtgttaaaaggattccaacaccaaaccattatgtatgatacacacacatacttgaacattatgtagcatgcttcctgcttcatatttctattttgtttttgtgagacaagctgtttggcagcgaagagatttagaagatgagcataagaactttgtggaattagagacatgaggaacacaaatacaacaacactagattaggaacccaaatagtgccacatgctgggaatcgatttgaagctctgagcgtaccaagttggggaagcaccacaaatcaactaatttacattattttatatttgggtattctcaacatcggtacatgtggaagtggcagcaaacatccaagtaacaactctgatcttccttcagactcagctgagacatactattagcctgcatcaaatgtactactagcctactagattatttttttcgttaatgttattaaatatgttacataatgtgaggaactgaaacatagcaatcctaacgatgtaagagattttaatctttttttgagaaaaaaataatcggcaaaagattcatacatagaacagggattaatatatgatgactgatgttgtctcataaagagttgtcttacacaaaccctattggaggaagtactggtcaaagaaggattcaaagttatgcctgtcacttttcactaactccaattgattgacttcatttttatcacgttatcgtcaatttgtcaaaacgattttgttgtttctacctagtggagtagcaaacttccaaacctcattgtagtcgacccaatattcagaagccaagagctattcttggacaagcaatttgatcaatcaatatggaaccaaaggtgtgggtttacaagtagtttgatcaattaatatggacaagcagtttgatggataaatatggaaattgttgc

SEQ ID NO: 152 - DNA, 1084 bp, Zea mays
  misc_feature (1)..(100): optimal_loci_341136_G1, chr10:99553868..99554951, Cluster 1
ctacacaagaataaaagatatacaaaacttaaccagataaaaaaatctttcttgtcttaactgacgactcctaaatagcctttatggaaagctaagaaatttctatatcaatccagaaagaaaaaatcgaatattatgtacgaataacacaaaacatccatgtcttgtgtacaagaaaaccaacatctgtccgtttgggttattatacacttatagcctgtttggttgctggtatataccagaaccagactctcaagatgcaattccagcgcgttgggttgcctacacaggagtctggacctggctccctaaatgcaaaaggcagccatcagcctggctcaccagatatggatttcatttgtttctggtgagccaggctctcgtagtgcaaagctgattttcttagtggtgctattaacacatgattaatgtatattaagcaatattagtatattttaaagtagattaagatattgagactattagagtgtagttacacaagttaaatattataagattacttgtttatctattttcattttatactatgtgactttatgcaggcaacaaaacaccatctcttgttagccatgctctatatgtgcagccaaccaaacaaggataacttgaccaccatatcatgtctagcatgagcctggttcccatatgcaatgtaggctccctagagaagacaacagcctattatgtcttccctaatataatgatatgcaactctcttgtgcgttcgagaaataaaaagtgtgatcagttggatcttgaatgtgaaatgaatatacctagggcttttcaatcaagccatatgtgcagactcttgttatgtggggcaagagattcacggcagagcaaagaaggcaagtacagcaagccaggaaaatggccacaatgacgtttttttggggggggggcaatcctgagcgcaccattagttggtgttaatttagaaggttagcaacagtgattgagaaagaactaagggtgattcggggtgcctaatggctatgtaaaccattagataccctaggaataaaaaagcaatgagttaatctcctttctctatcgtttg

SEQ ID NO: 153 - DNA, 1053 bp, Zea mays
  misc_feature (1)..(100): optimal_loci_3423_G1, chr1:17635757..17636809, Cluster 1
atccgtgtacagaacggtgtcgatggaggaggagggcacgtacgagatacagccttgttatgtctgtcgctctgctcccccggtaactcccaaaatatatgctgtcgagcgtttcaggcagtcgcctgcatcctcctcaccccttgcagtttgcacaaactgaaatcacagcagaaaacgtaccgtacgccggcagttgcagagcagagtcgccgccagggagcgcgcagcacgcattttaatgcacataattatttacatatgaaatactaatctagtctgctgcatatcatataattttttatatagtttaaagggcctaccatgatcagttcgactggtggccttcaaaatcataggaccggggctggcctccgggtccgggtgtctgcctggttggtcgccgcatgcatgttgctgtcctgtatccagctccgcctcgcaagtcgcaatgcagtagcgtttgcacagtggccagtgggtcaccgttgctctcttctatatcttcttctctgttgatatcccgtgtactggtctgggagcgagcctacagtggggttacagttaagagagcggtgccgttggccgtcgggcgcgcacgcggagctgaaatcggctctgtttgaccttgtgcccgtttcattttttttttgtcagagatacagctggcttttagttaggtcaccgtgctttccaagaacagttccgcgaaatttatagatacatctagtggagcatctcaaaaagtgctgaaatattcaagtcattattccactaccatcactcgtcaatcaaatataccgtcgctgaccagagttgctcgtccgtgccttaggatgtatttggttcatctttttaaatctacttcttcttttttaacaaaaaaaaacataagctaaatcaaaggttccttcggcattttgctactactttaaaaaatcatctttttaaagtacaaatttgaaaaaaaaaacttgaatcgaactatcgaagggttcagccatcgaatacgcatgcatacgaacatgcatacttatactactagcctgctaa

SEQ ID NO: 154 - DNA, 1323 bp, Zea mays
  misc_feature (1)..(100): optimal_loci_3433_G1, chr1:17689028..17690350, Cluster 1
atttaatccaaatcatctgaattgggtgaatccatatgtcacacctaatcctatggtggaattaaatccaccatgtaatccatgtatctctcaaagctagctatttttttgatcaatggattctaatataaacttgtgcaatattttcatggatttgttccatacctaatgagctatggataaaatccatgcctttcatagtttaaaaaattaccaaatacttgattataatccatgatgggtttcaccgaataaaaataaataaatagacttggattattttggagatgtattgtggcatggatttaattttaatacagctaatttagagctgaattggtgtaaaacaataaggctgcagtgcaggtacgggggcgtcgggaaaaagaacggccaggatcgcaccgactggagctcggaagaggggcgctgcaggtgtcctttgctggcccgcctgatcgagcccgggcaaccgaaccgtaccttgctgtgcaagctccgatccaactgggacagcacccgcatcagcgatcatgtcgtcgatcggagaccgtacgtacctgacgagttgctgtccacaacagccgagcgaaattaaaccctgaccaaattaatcacacactgaactaataagcgtacgtcgtctattccctcgtctatatatatacaaaaaatcggccaaatcgcagaatatatatatatatgtatacatggtgagtggcttctggaggatgcaccaaaccctgctggcagatgtatgtatgtatgcaccgggaagcaagcacaaacgcgcggatcggatcggaggttcagttgtccgggaggggccgggatcgcctctgtattttatttttaatccacacactgctttatgcgtgaagcctttcattgcctacttccataaggtaggaagggtgtgtcgcagctactgctacttgaagtggagctactagctaattaagtttggactcataattcattgaatatacttcagtcagttgcctcaaggtaattaacgacgacgcagcataagtaacgcgatcgagccgttctaaagcacgcgcggccatgcagcatgcacaaaccagtgttttcagcttttgatgcaaaactagctaggtaaatattcttgtgtgttgcaaccaaaaaaagtataatatcacgttaatgtatgtaagagcgtgtattatacagttacaaaaaaaagtactgcaatagtaatgtttcggaaatcaatatttggagataggctcggcgagaccaaatctatatccttatctggcagatggtcacataatctttgtgtaactgtcccaccttctt

SEQ ID NO: 155 - DNA, 1104 bp, Zea mays
  misc_feature (1)..(100): optimal_loci_345196_G1, chr10:122265310..122266413, Cluster 1
ctatcaaatattttctctctcctagctagaaactctggtagaaagacaaaatcgtttagttggattgaggcaaaactattttgttagcttccttgctgggtgccaagctttatggaccatttgttcatcacgcccgcaccaccatgcatattgaacatccgtcgaagctccatgcactaaaatccccttttgtggacactcaaccattgaatagatcctcactttagaatttttgtcccggaatacttgatccttcgagttcgttgacctttgatcttaaatcctggttgcttcacaatgcttgactcttctttattctcatgatcttgaatcatggattgtttttttcttgacttttgaaagaccttcaacattcaatattgagttatcgatcactttgccatacactttagggatgtcacacacataaggatgcaagtaactagggaagctacttacttggtaagaggcatgtaagctcacagatggccataggtaaggtgtgctagaattgtataggctaagtctgactttgacaaatcggggcacctaaacctattataggtatttaaatggtattatagcatctccagcaggttacatatacttgatacccgttttagatgcgatatgggagagtacctatacatggatgaccatttttctcaaatatgtatttgggtaccttgttgggcacaataacatttggatcttgtcttttatatgattgtgtaactaaacgtgtgtttgaattcatattttttgtatattcttgttggagttagcctaaaaatatgctgtgagtcaaatttatagagcttccattgaaaccgcgcttggagccattcgaactttacaggcttgggtgcccaagaatgaacttcaaccagttagattcgccctagcttaaggacaggtgcacagcaaccgtagagttgattgcgagcatgtatatgggcctggttaacgagactcaagaaatgatacacagttttaaaaaaacctttgctgcttcgattcaaggttatttcagggaccaatgggtaaacgacacgttcaaaataaaaggacataaatttatgcacatctcgtcttcctttgaat

SEQ ID NO: 156 - DNA, 1396 bp, Zea mays
  misc_feature (1)..(100): optimal_loci_345197_G1, chr10:122266690..122268085, Cluster 1
aataaataagcacaagcctgatgcaaataattaaaaaaaactaagtcaactagtagcacgcaccgctagcaattagcaaagattggaggttcagaggtggatagaatacccaaggtaaaagaggcgcgtcctgcacggcatgtgaggcagcagcttggaggagtgaaaaaaaaaaataaatcccaagtaaacgcgctaattcaaaccgtcatcacgacgcggtggctgtcagatctaatccaaatcgcgcagctcaagcgtatttctgtagcgttgcggaacgcggagtgagctgcatgggtgggttcgtttattttgtcgtccgcggtcaaagaatcctaggagcagtggagcaacgaagcaagcggcgccgctagctggggctggggcggcggagagggaatagtcagggagaaggctgtggcgggccagttgtcacgggactcctccgcggcgcggcggtgggggcgccgaccgggcagttccatacgtaactcggaacacgccaaaggctgtggaccggggctggattggcggtgcagccgttagcatcggcgccggctctttttctcggatggacgccggggttctcgctgctcttgggcggcggaacgcgtccaagaacagaactaaacgtgtgcttcggaaccggcttggacaggaaccagtgctcgatctttaactgcctgactctgagctagccacacgcccagacacacacacacactagagctggcggcagcgtgcaatggcacgtcgacataaataagtggtgtatgtatctccccggtcgcatcgaagagccagtgtgatgaattcaattggcagccgtggagcgcgtgtgcacgccgaagaacgcaaggtcgccagtcttccggccgtatctgtcggatgaaagtcttgcgacgaccagattactattgggcttggaattaaaacgcagcaggcccagaccacctcgcccaggcagtgcttgtttttatttagctggtacggctttcttaagttccaaaatggttccaaaatgtattctctccctcgttaaaaaaggtgatcttgatcaaaattgtttttatttagctggtacggctttcttaagttccaaaatggttacttctaggaagccaaatggctaaaaaatgtgttgctccgtgatgagagtgaagtgaatctagtcttcattttgtactagagagtggaagccaaagaaagctgcttctccctgttcccaacctgcttcccacactccaatcccttagaaatcacttcacacacaatttaccaaacgattttcgtcaactagattcacttccactcgagaattatttggaatcgttatattagagaattagctctcggagctagagaatcggctgttccaaacaagctcatagta

SEQ ID NO: 157 - DNA, 1218 bp, Zea mays
  misc_feature (1)..(100): optimal_loci_347453_G1, chr10:135065970..135067187, Cluster 1
gctcaacaagccgggccttcctcactgcttgtgcccagtatatggcgacaccgcgacagtgacccgtctgaggtttctgcagcctgcaacgggaattctgttcacagcaataatcatatgcatatatcaatgtatgataaacaaaaggacgtatgctattacacactacggtacaaacctcaataaaaatatgtatgtgctctagcctttgatgctatgacttggtatacatgctccatgctctactttgctaactttactttggtgctctcggtgtctttgatacgacaaattccctccctggagcatcgtgatcgtgacgccatctaggaggtagcttggagtgtggaattgaagggctagtgtaaacatgcaagataatcgaggagatatataaatacatatgtgatgtgtccctttgtgaaaaatatcactttttttttaaaaaaaatagagttcttatacatcatacctacggtatggccttgtcatttgtcaaggtcgctttctttgacacccaaaatacatttggatggaacctttcgtcatgatttttttttaaaaggaatccttcgccatcaagcacttactaacaatatgaactggtggcaccatatctctttaaaattccttttgttttttttaaataaacgacagatcaggctattgaagtcatcaaccaccttaggctttgttcggttacatgggatgaaatcccatcatagatttaatccaggtatggattgggtgaatccatatcccacacctaatcccatgatgtgattaaatccatcaactaatccatggttcttttaaagttagttattcttttgatttatggattctaatgtaaacttgtgcaatatctcatggatttgttccatacctaatgagctatggatagaatccatgtcttccatagtttaaaaaattctcaaacatttaggttatattccatgatgggtttaaccgaataaaaaaatttaagtaatcatggattattttggggcatggattgtggcatggatttaattccaatacatgctaatccagagcgggattggtgtaaacgaacaaaccttaattaagtggggggcaggtttcatgttatgggcatcaataattggctattcttttatcagatttggcctggtcagtcctttgtgatcatttcactgacttcactcccccataaactaaacggcaccacttacttaa

SEQ ID NO: 158 - DNA, 1005 bp, Zea mays
  misc_feature (1)..(100): optimal_loci_347454_G1, chr10:135067402..135068406, Cluster 1
ctacccgtccggtggtttcatttcatcgaagggggctctgatgggtgcctattttgttccggcgggcccaggcgcgtcaccgtcagctgcaagtgaagccggtgggcggtggcccgccggccagcgcacgcagtatcgtgcgggcgtcgccgtcgccgtcgccatcgcagggggcgcactggcactctcctattccgctgtttgctttgcgcaggatctctcggcgccctttgtttttccgacgtggcaggtgtcgcgggcctgcaaatcgctggatccaccacaaggagccacagggaaaagtgcgccctgccagatgcagcatgtcgataggcatggagcagcgtgtgtgctgggccccggctgttcttggacggccgtcagtttttttggcacgggaaccccgtgctggtgctgcgcggataaaaaaaattgccccggaccttgtaatctcaggttaaccaatcggctggacgcgtggttatttgtgacaatattgtttagcatgcgttttactttgtaagctgccaagtcagattgaactgtccaaagtgtagacaggaaaatgctgcggatttagtgctttatacaagagaatagacgatacagatctcctgaagaaaaaataatgggaatacccagagactgaactatcgagatttcctaacgactaccagtcagcaaatgaaactctttatcgtcccagggtttccttttgaccggtgacaacaactgtcgaaatttaaaatcccggtaccagaaaccatggatccagcgcctcaactacccaacccaaccaacatggagatgcagagatgaactctcttttaattatttgtcgtcagagtgacccctaagcaagctttgatagtactgcatagagaataattcatggcttcgacgtactatttccgtttcaaatatttcagcttttttactctaaaaatagaataatttataatataaacagagggggtgctattattgcagtattgcagcttcgtc

SEQ ID NO: 159 - DNA, 1217 bp, Zea mays
  misc_feature (1)..(100): optimal_loci_348197_G1, chr10:138873203..138874419, Cluster 1
tgagcttcaaaggttttagtgaataagataccaaacttagatatattgagttgtatgaaggggtttcttaggtgtatttattgcttggagaaccataacataatatcttaggttatacatgtttgagatgaaaagaaatagacgaaccacgaagcgtatcaaaattcaaaccaagcgcgcgcacccgtgccattacccccaagcgcgcgcgcagcgaagcgtcacagctcgcaactcctcgaaacctcacccacccgcgcggcgctgatataaagccaccatggcgttgtgatttcgctgtccgctcctgcctcctgggacttgctcgaaaccggaacatcgacaacgacaacgcggccacaagccagcgagctgcgccaatggaaatgccggcggcgacgcaggggcggcggacgagcaccgtggtggaccggaagctcgacgagctctgcgcctgcctcgttgacgcgctgtcgtccggacagcagaccccccacaccgacgagcagctccgcgcgaaaatcaaatcgaagaccgagttcctccggttgctcctgtacgccgaggcggagtgccacggcgggccgcgcccggagcacctggccgaggccgaggcgcgcttcgctgtcctcgcggccacgttcgatgggtgggcgcggcgcgcagtcgtcgctgcacctgaaccagttgaggaggaggaggctgacagcttggtgtcctcgcggtccgcgtgcttctgcaccgactcgtgccaggaggaggcgaccgagggggacgccattcgcgacgccatggaagcacgtaacgaggaggggacgttggatgccgttgctaagaagggcgacatcgatcacgaggccgcggtggagacgggaagcagggttgtacagcggcgctggtggaggcataatgctgctgcctgcaggtgcagtgcagccggcttggtcgtggtggttgcggtcgggttggctttggaattggctgctgtggctcaccacaatgttaacatttgcgttggtccgaagtagaaaagccacataaaaagactagatcaggcaacttttatcttagctctaactcttgggccatagttgtttgtgatgaggtgcttttgttcttctgattcctgcaaaacttgcttcgacgctgtagccgctgggtactcacatttctgttcgaaattgatcaccatgtttggttttgatgtttactttgag

SEQ ID NO: 160 - DNA, 1377 bp, Zea mays
  misc_feature (1)..(100): optimal_loci_348938_G1, chr10:142852470..142853846, Cluster 1
  modified_base (1242)..(1242): a, c, g, or t
  misc_feature (1242)..(1341): n is a, c, g, or t
  modified_base (1243)..(1243): a, c, g, or t
  modified_base (1244)..(1244): a, c, g, or t
  modified_base (1245)..(1245): a, c, g, or t
  modified_base (1246)..(1246): a, c, g, or t
  modified_base (1247)..(1247): a, c, g, or t
  modified_base (1248)..(1248): a, c, g, or t
  modified_base (1249)..(1249): a, c, g, or t
  modified_base (1250)..(1250): a, c, g, or t
  modified_base (1251)..(1251): a, c, g, or t
  modified_base (1252)..(1252): a, c, g, or t
  modified_base (1253)..(1253): a, c, g, or t
  modified_base (1254)..(1254): a, c, g, or t
  modified_base (1255)..(1255): a, c, g, or t
  modified_base (1256)..(1256): a, c, g, or t
  modified_base (1257)..(1257): a, c, g, or t
  modified_base (1258)..(1258): a, c, g, or t
  modified_base (1259)..(1259): a, c, g, or t
  modified_base (1260)..(1260): a, c, g, or t
  modified_base (1261)..(1261): a, c, g, or t
  modified_base (1262)..(1262): a, c, g, or t
  modified_base (1263)..(1263): a, c, g, or t
  modified_base (1264)..(1264): a, c, g, or t
  modified_base (1265)..(1265): a, c, g, or t
  modified_base (1266)..(1266): a, c, g, or t
  modified_base (1267)..(1267): a, c, g, or t
  modified_base (1268)..(1268): a, c, g, or t
  modified_base (1269)..(1269): a, c, g, or t
  modified_base (1270)..(1270): a, c, g, or t
  modified_base (1271)..(1271): a, c, g, or t
  modified_base (1272)..(1272): a, c, g, or t
  modified_base (1273)..(1273): a, c, g, or t
  modified_base (1274)..(1274): a, c, g, or t
  modified_base (1275)..(1275): a, c, g, or t
  modified_base (1276)..(1276): a, c, g, or t
  modified_base (1277)..(1277): a, c, g, or t
  modified_base (1278)..(1278): a, c, g, or t
  modified_base (1279)..(1279): a, c, g, or t
  modified_base (1280)..(1280): a, c, g, or t
  modified_base (1281)..(1281): a, c, g, or t
  modified_base (1282)..(1282): a, c, g, or t
  modified_base (1283)..(1283): a, c, g, or t
  modified_base (1284)..(1284): a, c, g, or t
  modified_base (1285)..(1285): a, c, g, or t
  modified_base (1286)..(1286): a, c, g, or t
  modified_base (1287)..(1287): a, c, g, or t
  modified_base (1288)..(1288): a, c, g, or t
  modified_base (1289)..(1289): a, c, g, or t
  modified_base (1290)..(1290): a, c, g, or t
  modified_base (1291)..(1291): a, c, g, or t
  modified_base (1292)..(1292): a, c, g, or t
  modified_base (1293)..(1293): a, c, g, or t
  modified_base (1294)..(1294): a, c, g, or t
  modified_base (1295)..(1295): a, c, g, or t
  modified_base (1296)..(1296): a, c, g, or t
  modified_base (1297)..(1297): a, c, g, or t
  modified_base (1298)..(1298): a, c, g, or t
  modified_base (1299)..(1299): a, c, g, or t
  modified_base (1300)..(1300): a, c, g, or t
  modified_base (1301)..(1301): a, c, g, or t
  modified_base (1302)..(1302): a, c, g, or t
  modified_base (1303)..(1303): a, c, g, or t
  modified_base (1304)..(1304): a, c, g, or t
  modified_base (1305)..(1305): a, c, g, or t
  modified_base (1306)..(1306): a, c, g, or t
  modified_base (1307)..(1307): a, c, g, or t
  modified_base (1308)..(1308): a, c, g, or t
  modified_base (1309)..(1309): a, c, g, or t
  modified_base (1310)..(1310): a, c, g, or t
  modified_base (1311)..(1311): a, c, g, or t
  modified_base (1312)..(1312): a, c, g, or t
  modified_base (1313)..(1313): a, c, g, or t
  modified_base (1314)..(1314): a, c, g, or t
  modified_base (1315)..(1315): a, c, g, or t
  modified_base (1316)..(1316): a, c, g, or t
  modified_base (1317)..(1317): a, c, g, or t
  modified_base (1318)..(1318): a, c, g, or t
  modified_base (1319)..(1319): a, c, g, or t
  modified_base (1320)..(1320): a, c, g, or t
  modified_base (1321)..(1321): a, c, g, or t
  modified_base (1322)..(1322): a, c, g, or t
  modified_base (1323)..(1323): a, c, g, or t
  modified_base (1324)..(1324): a, c, g, or t
  modified_base (1325)..(1325): a, c, g, or t
  modified_base (1326)..(1326): a, c, g, or t
  modified_base (1327)..(1327): a, c, g, or t
  modified_base (1328)..(1328): a, c, g, or t
  modified_base (1329)..(1329): a, c, g, or t
  modified_base (1330)..(1330): a, c, g, or t
  modified_base (1331)..(1331): a, c, g, or t
  modified_base (1332)..(1332): a, c, g, or t
  modified_base (1333)..(1333): a, c, g, or t
  modified_base (1334)..(1334): a, c, g, or t
  modified_base (1335)..(1335): a, c, g, or t
  modified_base (1336)..(1336): a, c, g, or t
  modified_base (1337)..(1337): a, c, g, or t
  modified_base (1338)..(1338): a, c, g, or t
  modified_base (1339)..(1339): a, c, g, or t
  modified_base (1340)..(1340): a, c, g, or t
  modified_base (1341)..(1341): a, c, g, or t
tgcctccttattaatcaaggatgcaacggtatcctcctatagaacagatcctgttcaagtaagatcgtgctgtagggttccagagctgaacatttaagccggcttatacttaatcgagcaatcgaggtggagctaatcggtcaggagtgtccagcaaatcgtgtactgggtcggcccattctggtattctatgcgtgggcttcaggtcgagcccatcaagatggttgtagttcacacttccttggcccatgtgcaatgctgaatgttgctatccacggcccccgtccccgttgatcctgacaggattggaaggttggcctgcactctgcgtctctgcgactctgccgatctgatgctattcgcctattcctctggaaatcttgatacgagctcaaaaaaaaagggtaatgtagattactagcaagcacacacttgacactagactcacctcgtactcacatgcggaaaatcatgtttctccgcaactcagttttactgtaacgtttcgtaccttcgaaaatgatccatctatggtcgtttgacaacacacaagtcatccgtggtggttgaatcggcgagtgaacttgtgcttttgtgactcgtattttcagtacgggtaccatcattcatgacaatgcaatgcaagcacggtgtaaaatatagggtctaactgatctgtgatcacggtgtaaagagaagttttttgtcgtcgctgccttgtttctttagcgtttttatgtttggctttgtttccaagacaaaacctgaatatagtgcaaagtatatacaccatgtattctaaattacaaaaatattttaggttttccatatatattaattttactataatctatatatagtcgatatctaagtacacagtaaaaactaccgatctcatgattttaaatgtaggcaggacattgctccactcaaaacaaccacaaaaaaaagttcttaacacatagcctaaggtcaaatgggcatttcatattattgccagcttttgttagacgcacaaaaaaaaagtcatttcacattgttattaggtctttcatgatatcgaggtgtaaataaattcgacttctgtgctgagtaggagctagtactacgtagtagatgtttttctcgtgacatcatagataaaaagtgtatatggaattaggaacattcgaattgttcctctgagaaaaggtgcggagaactaggaacgtacaaacgggtcgctggggcctgaggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagacagtatatcttcgagaatcagcttgattcgtt

SEQ ID NO: 161 - DNA, 1018 bp, Zea mays
  misc_feature (1)..(100): optimal_loci_349271_G1, chr10:144629678..144630695, Cluster 1
tcatgtctgatagcggtgtgacccattgtgccatgctccatcttacttgggctggactagtgtcgtgtcgtgtcatgtgtccatctatatctactaggaaggtgctcaaattacaaagccagtgtatattcggtcctatagacaagttgagaaggggattgagagggaaacacatgtaccattgtgttgtgatgaaccttagcctcacacgagtgttatgttagtaggctaccttttggagttagccataaccctaattttattggaacatcgtgcataactctaagggctactttacgataacatcattcatagccctaagatgttgacgcacctattcattgccttcctaagtgctagttcatgagccacctttaccttgatgttggcgatagtgacgataatgacaaggaggaaaattggtgtgggcttcacctcgtcaatatagctaatggcgagggggcaagttggtatggtgacatcccttagccgcaaactagcccttagtataggaaataaaaagtattcaagtggaacatcactcataactataagggctagtttaatggaacatcgcccataatacatcagccctaagggctagttggatgtatcatattatttcctttctaagggccaattcatgattcaacttctccttcatttcacagtgatccatcttagcatgatttctatgaaaaatatataaaaccaaataatagggatcgatgttaagcttaaaaataatggatgtccttgttaaaataacactaaacccaaatactttgagccgcgaccttaaatcctaaaccatgtacgcgttgttgaccacaagaaaaaggaaaaaacatgaacaaacatcattttctatatatcaagcttgcaattgtgtgtagggaatgtaactctatagcaaaggtatacaataataatgtcactagctgaatacacaagaatattgtataacaaagatttggtttctaatgtgctcaataggggaacgaggcatcactgttgt

SEQ ID NO: 162 - DNA, 1052 bp, Zea mays
  misc_feature (1)..(100): optimal_loci_349412_G1, chr10:145290497..145291548, Cluster 1
gtcggagttatagaggaaaaaacattttttctgtattgtttaatataaaaacacatactgtactagataaagaaaacacatagtcttccgttggtaattgattgagtgagtttatttttagaacaaatggtcggaaattatatgcacgacggtatgaagtccgtgacccaaggggaatggatcaggcttcccactttcctagtccacggcgcgtggtgcagtacagctacgggtgatagacaagtgacaacgatagttattactatatatatacacgatactttagtattcccggacgacaaaccatgtagaatgaatgatattgaaccgatttgaatacatagcaaattaaaaaatattttaatttattctaatacaatttaatttatatggaattgaaataactgaacaagaccttaatacagagcaagtaagtcgaaactagcatggcatgactatttggatttgccgtgggtggagatggctctttatttgtagccacagctggccactaggcaatgccgtcaaggccggcgtcaacaaaaataaaggtgatgatggacaatgttgccttgtcttggttgggtccctactgactaggacgtactgacaatgcagatgcaggcttgcagcgcaactcgtaaactttggataggaataggagagaatatatatccgtaccgagaagaaaagttgttagtacgtgatgaacagcgtcaacaggggcacgccgagccgtcctggtcctggtccaggtccagcccatgcttcgtcctcccgtgttctgtgcatcagacacttgttgcagagtcagcatgtgcatccatggctaccggtactgaggtacacgttgtaatagccatgtttaatatctattgcatgcgctcgcccccacgtacttctcgctcctgcaccaacactcctgtttaccgccacattgactatatatcatgatagcgttaaaaaccttatactcagacttaggaggtggaaaggagaaaatggggaagtgggccgcaggattaggagttgggccagaagggttctctctt

SEQ ID NO: 163 - DNA, 1301 bp, Zea mays
  misc_feature (1)..(100): optimal_loci_35783_G1, chr1:216573197..216574497, Cluster 1
agtaaatctgcattttcagtttattgcgataacggtcttatggttagatccgttgtcgatttttcttttatgcgttaatcatgttgagttagttcagattttctgttctattgtcatggataatatctgctagtagatctgggtttttcgttttatactgcattatcaaattaatcttaggccatgtgaattttccaacacttcgtccaccataacttgtcaatattttcatgggttgtcattctaccttaatttttggttgcgctctgccactgatcagcactcgtgtatatagatgaaacaaacttaccgctgattgattattggataatgaatctgtcatctccatttcgtgggctctatatataatagccaaatgtcacaacgacattggttatgtatctcgagagcgttgcatgggagccaaactcccaactgagacgtacgcgttgttgcggtttgctgtattttattgttgtttactgtattttattgttgtttcgttaaaagtacgttattacgttggcttttggatcgaaatatatcggatgctattgttcgttcgttcgttcgttattgttgtttcgtccgtacattctctccagaatctttgacaaccgacacgtccgtaccgtacgtgctaacgacgccatttcgcatgaatgcatgcatgcaacggttgacttttgatttcgtctccagccttatcttccagagctagttctcgagcagctgttgccgagcttaacattttctaattaaggatccatttgtcaactgagatcatcggtagcagaaggacaaactgtaggccagatttaatcccatccatagagaaataaacaacgtttgattaatttagttaggtcaaatcctgaaagggtttacgcctcctctgttacgaacagcggcgttcaattcacaggcaattcgatagattggagtcactaattcgttttgttcttttcttttcgtccatgtaacggaatgcagaacatactcgctaaaacgcttgggtttgtttgcttgttataagtggattaaggggggttgtggaggaaatatccccttcaatactcttctaaccaaacaagcacttctctgtgtagaggaaactcggatacttcgagaaaattttgtcgtttacagtttgaaccaaactaaatctgtagagttttggagggatcaactcgtctaaggccaccttcaaccacaccccaaaccttcccaccccaccccacgtagagtgccatttggggagagcaggccctccaacagctccaccaaccaccgcatatagc

SEQ ID NO: 164 - DNA, 1023 bp, Zea mays
  misc_feature (1)..(100): optimal_loci_37354_G1, chr1:224923320..224924342, Cluster 1
taagagaattctaggttgcattaacgcattaagaatgttctttttttttgtctataactgaccaagctcatgatactgaaatatatgatattgagttcgaatatgtttaagaggaaactaaaggtgtcgttgcaacttgcaagctaggacatttatcggcctcaaaatcagaccaacaaattgatctcattctagggttccgagttgcagaatatagttgtgagatggaaattgacgaacacgtatgcatgcgccccatttcagagtagcaacggcaaaactgtggctttgttttcactctggcagaatttcgaccagaattttgtgtgtgtggtgatttccgagataaggttgggtatatgcgagtgagtgcatgaatcgcaaggcgagaggagaagagagagataggggatcagcagaggatagtacactacgacgtagcttagtgctactgcactagcatggatcggagaggggtgggcatctgcagagcagagagaaggtggtggtggatctccgccacacacacacacccggccgcccggccctgcggctgcatgctgctgcccttctgttagtactgactgcatggtgaggtcaaatcaccaaaagtgaatgacgcctttgtttttcatttctgcatgcccttctctcttctctctctccatacgatacgcctgtgcagtattattattaataataatagcattcatgaatcatgagggcccatctatcacattgtttttggacacatacacttcatgaacagagcacgcgcccagctgctgctgcttgctggtactccctctctcttgctctgcacgcctggcctgtgacgactagctagtagtgctctcccggggccgcgccggccgccgggagaccaagcaagccggtgacggacggtgtatgaatagctagtacgtagcatgccgcagtagcacctacgtacgtactccaggcctccagcctccagaggcagcagtagctctccctcgatctctagctgctggctaagcccta

SEQ ID NO: 165 - DNA, 1237 bp, Zea mays
  misc_feature (1)..(100): optimal_loci_39485_G1, chr1:235814201..235815437, Cluster 1
tacaatttatattaattattataaacaattgagtatgatgttctactggttgacaacttcatctagtgtctcgcacccttcttccattaaggtgtgggttaaaaccctaactcctgcatcgtctcttcttaacataattcacttcatgtaccactttttaacataataacccacctcctacaccactttttaacattttacgctgagttgatttggaaaaaatgtatggacttttttataaaaagatgaacgttgaaattggtgtttaagtatagacaaagagaagggatatggatccgccacctatgaaagctcaggtataactaacctccctgcagctggcccggtctacgcacgcatttgcatggcgacgcgaagataataacaacagcgacatatttcccttttgggaacctagctagctcttggacgcacgtcggagcatgcatgtatgtacacgtatgatgcggtggtgatcacgcaaggtgcgtgccagccagtgtggcgctacgacgtcgacgagctctacatcatcctacatgtctcgaaaggcaacgcactgcagactgcagtcggtgtgtggtgccgaggtgatctcgatcggctaggggccggggcaggcgtgattgcatggaggaacgacgcgcgtggcgcgagtgcgggtgttaggtcggcgggatgatcggtcggagtggtggtggcacgtcaagcagcagctggagatagctagctagcaaccacggtgggtgtcgtcgtcgagccgctgcatgtgtctggtaacgtccgcatggcatagcgcgcggcacacggcgttcttttttgcgctgacgatatcgacggagttggtagaggctttttttgacggtgccgaccgtatccctgtgtcctgcgatttccagcccggcccaagtgtggtctgttcgtggtgagttcgaggcccataagggcagaaggctgtagctgcttctagtgaccaagcctggccggtgtacacgtactgtaggctgtagcttgtacgaagatacgtgacacgagatatggaaaacggaaaacatgccaataggcaatagggttcggtcaaaccactttggttccagtcgatttaaaactggtattattagtaatagatacagggccgattgtaaatccggagatccgtgcaagctaagtccctcaaccggtactaatattttatgtaattcggtaccgattcaatacaagaaccggaacaaataca

SEQ ID NO: 166 - DNA, 1113 bp, Zea mays
  misc_feature (1)..(100): optimal_loci_40822_G1, chr1:242426055..242427167, Cluster 1
caagatggttatttaggtgccactatgtgatagattgatcatgcaaaggtataggggcgcatggaagcttattttggtatgatacagatgttgtcaaagagatataaactcatgcatatacaatagacctagtgaattttcaccttagacaccactgacaaaggataacttataatctctagtgtttgggacacattagagttaagacatatgcaaaggttggaagaaatgggactaaaggatgcctaaagcatgtgttggaccctaattgacatgggcattggactagaacaatactagtctgatggttaaccctagtaattgatcagattggtcattgaaccttatgatattgtctagcggatggcatcaaaccaatccaagaatcctagtttttctctggtcaatttatgaagggtgtcagaccatgtgacttggtctaatgacatgcattggacctgccttacaagcactaggcattctctagttatttttggaaaaaacatcagatccaagtgctttagtccgatggttgagaaaaagggggtgttggactatatgggtgtattatttaccaaggcggtcccactgtcagacaacctgtgtgtctaggaatagggcatcgaactatgcgttttaatccaacgaagggcgtccaactaatgtgatgctagtggttgctctcccatcagttttttggaggcattggcccctatggtttatgatccaacagtcgtcgaactaggagtgtcattttactttacctctcttagctattgttgtggtagtataggaacactttaactcaaagtttatgattgtgttacgttgttgttaatcagatctcgttaggcttgctagtggtaaaagccacacctagctctagttactaggctagctagctataaccctatgatctaggaggcgcttcaatgtttaagctccacttgaacactattataatgtgccattagatccacacaactatggttggtagcccctcttggtgacaacaagagtccgcctatgtatcctgaccccatcgtctagtactatcgtagggtgcatgatcttgaggcctctctagatgagcatgcaccataatatcgtagg

SEQ ID NO: 167 - DNA, 1096 bp, Zea mays
  misc_feature (1)..(100): optimal_loci_42916_G1, chr1:253031866..253032961, Cluster 1
ttaatgggtcgttgttgttgcacaacaaaggccaatgatcagagacagttctggtataggaaaatccttgatgcccttgatgtattgagtcgtatgcagatagaatatttgggtacatatgctagatgtcaaaggaaaaaagtgtacgtataaaattttaataaatagaaattggttttcacctcgaaatcctagatgatcccattggtaatcatgtctctagtcaccaaaggcctttgctctacagaaagtcttcgacattcagagaaagagttgcaacataattgctttcatcctattgaaactacttgctttttaacattagcttccaccatgctaggccacatacaaatccataattccaccaaaaagaaaggccccttaaagggaagacctcgacaagtcggcataatgctcacaacacatatgccaaccctcttgacccacatgaagaaactaaggtcaaagagaaataagtacctctagcaaaccaataaccattctaataagggcaaccaattctggaccgaacactagggtaggtatttcagcaagtacaagctagcctacaaaggcttagcgagaaagggacaggttggtcgcgaacttcgctgtcaatcaaagagcaacccatgcctaccaaccaacaaccaaagtcaggcaacaacttgcaatcctacaagtagaaattttgagcatactgtcaaactctcctacatcaaacaacaatttcactaacccaccacaagccatgtgttggcaccaaattctgactagatttgtacaaccatattggttgatgagctcaataaaaaggaagctactcgacctatgcagagggataggccccacagaccgtgtatcttagatatacattggattagattaaagttagttagcgagtgcttaccacttcaagtccaaggactataaaatgtgtagttcatgataataagaatgagaaggcattcattcatccaagcagcgtgcgattcacatcttctctgcacatcgccacacctttcacaagggttttccaaggtaagcgccatgcttccctttagtctttaactttgtgggagcaagtaattttaaa

SEQ ID NO: 168 - DNA, 1091 bp, Zea mays
  misc_feature (1)..(100): optimal_loci_45568_G1, chr1:267173577..267174667, Cluster 1
attttttaaattttttatcgtcttgtccattttaatctggcccaactgtccagcccactcgccctcactcgctcgcgtcgcgtctggcccgcttgcccgcgtccagctctacccgtgtggccgctgcgtcggttccatgattccatcctaggcagccgtcccgctcccgcacgcagcgtgcctgcgtgggcggaaagcatcgagccagcagcgtcggcgggtggaccaacggagtttgcttctggccttagagaaattcgctacacgggcctaggcccattaatgagctctatattttacgatataaaatttaaaaatcaaatcgaatactttatttctatttatttttaaattaaaattaattaagtgttctaacttattgtgaaaaaacatttaggacagctgacttcctccttacccgtatgccgtatcgcctgtacgcctcgtttagacatccagcacaagcttcgttgatggagattgcttggtcttctagctgattgagcggacaaaattcaatgcgagtgatacctgttttgcatagcaagaaatgcgtctgaataagtagaacttgcatggtgactgactgtcgaatggaactacaacagtaactgaaatttataggaacaaataaaaaagtctgacttgtttcaagcttggccttttcggacgacgtaattcacgtttgtacaaaggtactctaattgtttccagctgatgctatataactatcatgttgttccagtactatctttcttaaggaccaaccaggagaaaccatgcattgtagtgctaaccaagcttttttttttgttggttgtgcaaatgatgctggtctgcgtaattggagctagtttttattacgatctgtcttctaaaccgcaaacttttgctctataattctcaattcaaacatgtatattattgtgcatttctctttaaaatggtatcatattgaatcttgtttcttgtttatatgcacgctgtcgtttttagctacaattttggaaggaaggaggttcacagcccgggtgaggaacgacatgcctctccccaggcatattaatcgatcttggatggaagtttcccac

SEQ ID NO: 169 - DNA, 1213 bp, Zea mays
  misc_feature (1)..(100): optimal_loci_46699_G1, chr1:273308074..273309286, Cluster 1
ctgtcaatttgaattaataagtaaatacgattgagttaggtgcaattcagtcacatctcacttgattgtttcatgaaaaagggactccaaacaaataaaatctcgaatttttcatgacaaaatagacaaacagcggatatttaattccattatcaacatgatctgattgtttatagcagaaatcccaagtaacaaattttcaggtcgagattcagagaccaccaacattgtagacattttccaaaagctacacgaatattatagttagatgacataatgatgacgtctcgattatgatggtatccaaaagaacaaaaattataaaacatgtatgaatataacatgagcaagacaatagaagagtgaccaatgtcaccatgccaggcaaagcagtgctgaatgcaagtagttaaacatgctgaagacttgaaacagaaaataaatacaaagtccaagggcaggcccttcagcagaaccatatggggctgcacataaatagctacagaataatgccactggtaacatagcctttgtgcaaaaaggcaaccatgctcatcgcttagttaactcatgttagaaacaagccatggttgctgccttgctggaacttcctatcgaaagataattaaagcatggaacctagaagggctattggactttgtaatcatacttaagtatgactaccctagtctatgtacgagattcacgacaatgtagcactatgcaatgaatcatgtaagtttcaaatgctcaggataaaatgtacaagtaattctctagctaacagactaatacccgaacgggttactgtttcccaaagaacaaactcaaactgattcctatgaactgttcatcttccctcccacaaacacgccagaatttgctcgtacgagaatacggtaaataggccaactatataacgcacgcaatctacatcgccaatagcgccctcgcgccgaccggaaaagggaaataactacgaaaaaattcgcaccaaaccaaagcaacaattcccggcgaagcgcttgctccgctacagatccgacgaaccgagcccactaacacggagcccaaagcaccaactcgaacggcaaaccaaaatctaaacaacgaaacaatccaatctacgagcagcgcggatttgtgggaagacgggacacgcgggaggagtagaggaggccaggagaggggtttggagagtttgggggcttac

SEQ ID NO: 170 - DNA, 1309 bp, Zea mays
  misc_feature (1)..(100): optimal_loci_4924_G1, chr1:25186688..25187996, Cluster 1
caacaacaattgcaacaaacacctcataaaaccatctcataatttttaggttgaaattggtaccaataaaagaatttattggatgttaaacaaccgcaaccaagttggcagcataatgaattactctgactaaaaaatgtgactcttaattctttaggagtcaaataaatttatatttatataacaacaataacaacaaaccactttattcacgagcaaattaagacagactgaagttaaaattcaacacaactcacaagttaaggtttagacgcatggataattggtaatcacgcactcctgttcaaataaagtatttaaaatttacataaacttacataaaatatattttttgtcatgacaaatagttattgataaataaattataaaacattttgtacaacaaattatttaaatatattactatcgactataattttaagaaagtttctttcgttctatgagctgcactttttggacggggagagcgtagaaaacacgaattggaacacaaccattacgctgctgcgtacaatgaacgaatcgtaatcagtggtatcattgtcgagcactcgggctgttctagaatttgcacccaaggacaagagtctttattacatgcaaggacaagtcattacatgcaaggacaaaaaaaactcccgcgggaccccagtgcctaggcaagccacatggcaccctgccgatcacaagaagcccagccaggctcccagcgcctcgagcgccggcgtgccgtgcggcgtgcgcgcctgacaccgcaccacatggccgccgtgcgtgggcagcgcctacgcgcccaggcgactcgtggtgccaggctctctgcggcttcggagtccgtgccacgccgcggggtccatggaccgttcctaggggccaggacgaagctgcaccgcacaacccgtgtgcgcctgacggcgtgatgcgggcgttccaggagcttccgccacgcccgagagcgcgcggggcccgcgccaccacgtgacggcgcagaagagctccacgcaaccaccaaaagcaaaaaggcgccacttgctgggtgggctcggcgagctagcgattctcagccacgcgcacgccggcgctcttgccttctgccccccgtactcccttgaaattctgaaccttcgtggagaaatttacgtccgcctcaccgatcgatgcagcatacagcctacagcctacaggggagcgctagcacgtcggatgtttccgcgttcttgcgttgcgcatgacatctcgtcgtcgtcttttcctcccttctccatcctaccacacactgacacaactt

SEQ ID NO: 171 - DNA, 1228 bp, Zea mays
  misc_feature (1)..(100): optimal_loci_52490_G1, chr2:3903176..3904403, Cluster 1
accccaagccactggagtttgttctatcttcggtgtcatctacagttctgtctcctctattttccatgttctagtggagacagttttataaggatccaagttaaagtgtgcctgctgcctagtacgtaactgagaattcaatttagtgtgtgaacacactcttaaattatacttaagatgttttggtatttctagattcatagttcttggcacgtatttagaagttgcttggaactgctctaagttttagtttcagcgtgcagctactatttataatacaaatgtaaatagtattaaaaacatttttaataaaaatgaattatctaaatgtcttctaaagattaataactctatctccacgagttttgtagctcctaatgacttgttcctagggcggatacaagcactggaccaccctgtctgtggcctagtgcatgatccgcatgtctctagttttatttattagttttagaccaaaatatattataagaatactatattcaatagactagcctagggtttgatcgaatcttggatctgcacctgcatgctccaccaactccactaaattttttaaagctagagctgtcccaaagaaggccttagacataacaataaaatctaggtgcatagcaaaagctatgaaactaaaaaaataaaacacctactggtttataggagtagatatcatttatattaaatttatccttgcattgccacaagtattgggatattattatgcatagtatatacgacaataaaaggtacaccatgaagggagaggtatgctccatgattctctagcttcaagcgctgatttttctagtagaatgatttcaagtgattctctagcaggagtgactctatctgatgaaaaacgttttgcaaatagtatgtaaagtgattctccgaggggttggagagtgggtagtagactgggagcggtgagtagcaatttttttgctcccactctctagtacaaaacagagactagattcactctgttcttaccatggagcaggccagtttttcaccatttgaatgcacatgagttattctcgttgtgagcgaagctgcgagacctctaccaaatgcccctaactcgattgagccataggttacaagtaacttgtatatagggtatgtttggtatggttccactacaccttagaataatttttctccaaaactttataaggagcacctctactccagagtgtttgagatg

SEQ ID NO: 172 - DNA, 1207 bp, Zea mays
  misc_feature (1)..(100): optimal_loci_52503_G1, chr2:3989247..3990453, Cluster 1
atcagcggaaggcctgctaaatttctggctagccaggccgaggtcgaatggcccggcgtttgggcccaattccatcgggctcaggtgggcgcttgaatggcatggccgcgtggggagacacggccggccacacggccgcgtgggcaaaagccaaaaggaggacggggtctctgtctgccagtgctcagtgcgtgtctagtgtcttgtctacctacatccatgaacagtagtagttctgggcttctggcaacggtcttcgtgggggctctactgtatatgtatgcagtggtgcgcctgctcatctgctcacctcacccgtggaactcttagattttatacgtactactacaactcctgtcaccgttttttaagcaaatttaataatacagacagctagttgcaaggattctagcagcctactatttattgtaaccatatagtagtaattacctcttcaatattaatattaatgcaggaccccttatatctctcacaatttttttaagttccggtctccaaaccaacagtaagtttatagtttatagttcgcttcttctctctcatccgtatagcatttagtgcatgtttggattcatatgctaaagtttagcactacatctttagctaaaaatttagcacttgaagagccaaacaggtgaaagtaaactagtaaattttagcatttataatagcagtttagctcttcaaggttcagcacatgatatccagacatagccatcttgcatcttgctctgattcgcgcatccgagccatttccctgacctcgcgatcgcgctccacagggacagcaagaagacaagcgggtagaagacaagcgggcagattagctccagatttacatattgatttcgctctctgctagctgggcagcaggatcacgtatcggagatgtagatcttctctgttccgttggagttaaggtttgaatgcccataataacaatcatgacagctttaatctaaccaaaaagatttgctagctgcatgctataggcccgggacctgacgaaaattaaagcaaccggaacgagtgtggcggccaccgtcatcgcctgcactgcattgctactagtccaatccatatgtgtatggaagattagctgatgacactgacacatactacgtgcagatcttaagactagctagtactgatagaggcatcataattgaggccaccgggccttatc

SEQ ID NO: 173 - DNA, 1030 bp, Zea mays
  misc_feature (1)..(100): optimal_loci_53448_G1, chr2:9100674..9101703, Cluster 1
accgtccactatggtcttctagcccttgccccttggagattccacctcggcagcttgtcgtgacatctgcgtgttcgtgaatcgtgatgatacaaaaagttttgacaggacactcatcctcgtgacgctgcaggttggtggttctcgggagataataatctgacagcacggtaacagtaatccagcagccaactctcggcattctccggtctgtactctatctgtctcttcaaagggttgggccttcaaagcccattgaagctcagcccatggtaccgttatctgcttagcccatttcaaatgcccttgcaagtattgaagtatcctagtatatctttttcatccccaaatgtccacacttgaatgtcttttcttatacagaacaacaagtcctggagcatccgcttccaagttccaactgcctagcacttgaagatgaggtattggttgccaggacagtatggatggtaatagatcacgatctaaatgtctcttcacaatttatttaagtccataatcaattatggttcaaaataaatacaaatagagtctaattctaatctgatctttaaattttgttgtgtaaaacttagagcccattaccacccatagagcgaggaggattaacaagtctgttaaaaagaacacatgagaaattctgttagcaataggtattgcactaccgcttaggtgtccgacattacggtgtcacggtgctgtcaagctcagagcgacactgtcgtatataaacggactttttcaagggtaaattaaaaatatttgtcaatgaaaggtagatcgagtaaattactagctttctaggccatgatgatgagatattgtctatatatccgtacttgcttagggatttgactatatccttggtttagtcaattggaatactaatgatttattatctgacatgcttagggatttttttttttgactgagcactccgttttcgtatagggatttgcttatcttcttcactgttgagagaaccgacaattactttaaatgtgtgttccag

SEQ ID NO: 174 - DNA, 1101 bp, Zea mays
  misc_feature (1)..(100): optimal_loci_53666_G1, chr2:10029215..10030315, Cluster 1
ccggaacgatgtggatggaggcgcaccgtttgccaacgacagtgtcggtgccgaaggtgtggttttttcacgacgatcagtaccaattaggacgagcgcaacattgggacaagtctcgtcgttaccgattattgcttgagcgttttcagtaataacagtcagtagccaacatgtcacattctgattgaccagcgttattatatccgtttgaatttgaaaaaaaaactctaaaatatggaaaaacttgatccaccttataaatagaggaggctgattgcgctcgtttacacagtttcatcaccatatctcaagaccactttcatgtacacactttcatctctgatttgatataagctggagtctcaattgtgaaacgttcacgcatttgctcaataagcgatcttcacaatgctccgagaaccctgccaatgttgggcaagtctttttcgattatctttctcctgtccaccatcaaggcaagagaaagttcgagctcgtccccgtggactaactcctcaaactctattttcttattcgtatgctcctcttcatattgataacgaccaagtgtcgatactcctccttatgccaatgagcctccaacaaatgacactccttctaacactaacgaaacaccctccaccgtccgtccgcccgatgctcgttctctacaacctttcgcttataagtattctcctccatatctacattaatatccacacgttgtgggtttgtatggtgctcctcattcatatgcacctctttatagtgctcctcctgtgtttcctccccttatgatgctcctcttatatatagtggtcttgctccttcacagcctcctcatgcacgagcagtcacatcgatgtggtctccaaccagtccatgtactccgatgcatcgtagttctaacgacgatgggactagactaagacagaagatgaaaggtttgtgagtacacatatatctttacgaattacatacttttttgtaagtagagaacatttttgtgagtttgtacatttataggtacacacgtggttaatacactccattgaacgaaaatgattggcatttagggttatatagcagtcacgtacaact

SEQ ID NO: 175 - DNA, 1184 bp, Zea mays
  misc_feature (1)..(100): optimal_loci_54741_G1, chr2:15854870..15856053, Cluster 1
gcacgacctagttgaaccacagcgagctgcgcgtgcattagtatataagctttgctccgagccaggtgtcgccgcgtcgtcgagcgccggctgcgcatgcgctccatgctcgtcagttcatgcaattgacgtaggcagtggcgcacgcttgagccggacagccagtcggtacagaatactaatataatactaatatatgtagtataaaaagtaaaatcaagtgcgtaaaatatggagagtgttggtagggtgagtagagtactagagtgtttgatccttccttcgtatatatctcccttgtgtgtgtcgagtatgcgtgcctcatgctgaagttggatgccatttttttagaacataaatgaattccattactcagaggatgcacagaaatcggaagctacaatgaatcgcatttataatcaaggatagaatccataagtggatcgtcgtcttcggaacactcacaccctaacgccgctagaccatgatctctgccccagttacatgatctaggaacagaagtatgaaacagtgcagccgggcaaagctcccgtatttctgtcatcaggatcctgctagcgtctggctcaatggcagcctgcacacaaacaatccacgatttccgcatgaaaagagtccagtatgtggtcgtaatcgaccccggccgaccagcggtatctccgtacgtcttcgtcgcagatgatatggctgttggattgaccttacctagtttggccaaggggttaaacaaataaacatgacgtaaccactctgtcttcatcggagacgcgacagcgcaccacgtacataaatagaaagaatgccgacgcatgaaccaaccctcatcggtagtcttatctcccgtgtgcctacactacacgaaacatatctattttcgatggccaaatcaacttttcaactgctattagattgttaactcagacgacagcggtgcagagcacgcgagtaggcgagcgagcggacgcaaggtgtcttctacacaatctttactgtacctagtagaccggtcgagagcgtgatcaaaaaatcctagaccgtatgggatggtagtcttgccgatggtagtcttgccgtatgtcaaaatagccgctcacctcacatgagaaaaaaaaaagtcaaatcaccgattagttcgaccctgtctcgattcgactcgtaataag

SEQ ID NO: 176 - DNA, 1062 bp, Zea mays
  misc_feature (1)..(100): optimal_loci_56610_G1, chr2:26114201..26115262, Cluster 1
gattgttttaaactgcttgctgctggttattgagccctgacatgaagggcaggagaccaaccgataggtggagccatgactagtcaggtcagcagtctctgtctccgtggggtcccaccaccacgtgcacctgctacccaccttctgtttgggtggtgtctggtctatgctgtgtgtattgtactggcgctgtgcatgcgaaacaactttgtttttctctctcgttttttaatatatatgcgtgtaaaaaatgccaggagaaaagtctagcctgtatctgcagttgtgcattgcatgattggaatcagcctccaagcaaggagaaggaggatgagatggaagcttcggaatcattgcagatgcagcgaacaaatgaaaggaagtgcaagtgctagtacgtatataatagtgtggtccaaactccaaatagcactggcaggccaactattggcccagccataccaaagccactgaaacgagacgagaggggcccaccaccagcttaccgctgttcgttccgctaaaccataataaacattattcatcccacccgtttctgtttggaagttgagtattttttctgttttcgaataatattgtagtatttaagatactattatattttttcaatatagtgtttggtacaatctttaaaatttttgttttcaaaactgcagttttagctatgctgtagtattttcacattttggaaacttatctctaaaccaaagttttcaataccgtggaaaaaaaatgtaagtatgtcttagcatttcaaaactatagtattctaaaattgtagttttcaaatactttatttccaaacagagcctttgctaattggcggatctagggggtatgccaggtatgccctagcataccccacgtacacagcgtatacacaatatatgtacaaaacaataaacaaaattaacataaaaagatgttgtgataatagtcttttaaattatgtttcctttgtatttaggttatggcctcatgatgtatctaataaattcttgaaatgatttgttggacagacaatacaatcataaattgacg

SEQ ID NO: 177 - DNA, 1079 bp, Zea mays
  misc_feature (1)..(100): optimal_loci_5728_G1, chr1:29174416..29175494, Cluster 1
tcctaaattttttctggctctatccctagctatcgaatggtataattagagtacaagaatggaagcaagatgcctccctgatgcatatagcaatatgggattacatattgcctaacttataagatacagtatatgcacggtagacaacagtgcgtagtttgttgagccataacttttgtgcacattttttaaatgggctgctcaatcggtttctttgggctaggccattgttagagcaaatgggcttgggaagtttgcttgggacttgaaagatgaagaccgtcctggtcctggaagacctggactggatgcaattgaaagaaccctacctgttattcaaactatatcttagcatgaaaaacgatagctagttttcccatgattgcacttcttctgtttcctatagtctgttggtaacaaggaaattatttcatgttcctgcgtttttctgaaaaaaaaactaattcctgtggaactttgcttcttaggggccgtttggaacttatgttcctgcgtttttttttcctcagaaattgaactggttctgtaaaactgttgcatgattctggtgaagttcctacgttcgttttaattttccgctgagggttggctggctcgtatctgcttccgcagccgagaggggttcacaaatcacaagacagcgatgacattaggctatcttgagcagcttacttatatttatatttaaactttactttacgaatattaaaatttataatacaaaataataattttagataaactataaatagactcctacatacggtcttactagatgctagggcagtggcagggcagcaaagcgacgccgatgcgccatcattctctttccgccggtcatcatgtgggccattcgcattggcatgttccggccctatcgtgctgtctcagtacacattgaaagctgatggcactacactaggccgtcaagtccaaccgatgagcgacaagatgggccctgctacatgtgtggctccaaccaactatttgggtttagtttggctccacctccacttgcagtcaatcggatccctttctgtatttccctcttattttct

SEQ ID NO: 178 - DNA, 1282 bp, Zea mays
  misc_feature (1)..(100): optimal_loci_61498_G1, chr2:54754638..54755919, Cluster 1
aatctcatgttagaggttaatgtgctaaaattaactggtaaactgtttgccacgagaatctggcttggattcggcggggagtatcttgggcgatccgtaagatttgacaggttctgccccggaaccacggatagcttaatgggctgaagcgacctgtcgtaccacaccatcggtcttggttgtgcactgctgctgcaggtgtgtttggatttggaccaaactacaccgagtgggcttggaatggaggccttgcgatatctctggacccaagcaagaattttgtggacggaggagctaggacggctgaatggttgacagtttccgtcgtcggcagtccggcaggaatcgaccttttttgggtgcgttaaactgacgaaatcgaccttatcgttccacatccgtactgtacatttgacttgtgcttctgtgcagtcatgtgagatgatttagcatatggctctactctatctatcttggggcacctctgctgctaaaactctggagtgcactgtagagttttagtggttttctgataggaaaaatagcttctaacttcagaaacaagggtttgtcagcgaaagtacatccttgctgcggttgttggcagagggaggggggcattgccggataaaccgagcggacacagaccgagatggagaattgatgttatcttttttatagaatgtttattagatttgataacttatttataattttctgttgatattagaatattttatggatttaattgcatacgtctatatagaggggtgaggtatggggaagctcactgcgcacgaacgtggatcgattttttatcgacaaacaaaacattctcttacaacattcaagatatactaatgtatttcttcaaacagaatcttattattttgaagcagtgaaagttgggaactcgaatgtccgaaattgaagtgggttcatttctcgttaatatgtatgtatatccttccgatctctgagagaatttgagtttttagactagctagttctaattacaggacattgtaaatatatagtttgcagtggcgctaccgtggcaagtgccttgtttgaattttagttttttttttaaagtttctgttgttgagatgtacccagcagctgtaccgcccgcggtgagccggtgagtaccttccgtaccgttcgctttggagccacgtgagcagcatgaatgtccgatttttttttttatttgaacccaatctatgaaaaaattcaagtttagatctctgcaagaattcatgtcagttttagactcttt

SEQ ID NO: 179 - DNA, 1386 bp, Zea mays
  misc_feature (1)..(100): optimal_loci_7700_G1, chr1:40243435..40244820, Cluster 1
ctaggatcactgtagatttgcaagtacgatcatgtacataatcaccctgatcctgttcatgcgaccttacttggctgcgacgaacatcccatcagcaccgcaccttttttctatttatccagaagatttccctcgcgatcgcgatacggttccaccagctacactggacccgtacatcctacctgtcctggcagtggcacgtgccgtccggccccacgtcccagaggaatctcacatccagggccccccacacgacgtgacaccccttccacccccctgtgcctgtgcgcgccgccctagcccaaaaaacttgcagcgcgtaccggacacggacgccgggcagttgcctgttttgcctcgccccgccgtcactacactcccgcaccgcactccctcgctccggctcaacaacgcgcccacccaccgtctcctgacccgcgggacccacgcgcaacagattcccttttccctccatcgcgacgcgggtcccgccgcctgcccggaagcccgaccgccaccacatacgcgacccggaaaccccatcctcatctatcgcgacgcccgcaacgtcgtcgcgccgtcagcccccgtccgggcgccgtcccgatcgtgtggccggcgcgcccgccacgccgccgtcgcggctgacgccggcgacccccgccccgacccacccacccagccatccctaaacgaggcgtcacgtcggggcatttttcaatcgcgcgaaataaaaaaaaacgcacataaaaaaacagggactgatccatcgctgtctttcggtttcgtgctctctctttctctcactttttttttgcccctgtgatgatcgtagttggaggctcggagcggatgacgataccaaggacggcgaggagcaacgaaaattcggaagcagcaacgaaaaatgtttctccttgtcattatctcttcttcttctccgtgggagataacaagggccacgaaaaattaaattgaatctccggccaagagtgaccggaccgggcggcggcgggagggagggagggataggcggataagcgtagggaagacaggaaccaatggcggcgtgctgggccgacacgcgtcggagttctttttttctgacgtggccggaggagtggcagatgggacttgcaagaaaaaaaaaacgctggtcttttcctcttgtgaaccgtgatactaacgagaaacgaatcgagaaacaaagatactccatttttatatttatataaaaatctaaaaatagtgtcactaggtacattataaaaatgtttacgtgtttaatatcataggtatcgctagtcttctttacaaaaataattcaatttaaaatagttttttttgaaagagagattttatttacctagacgatagatacgggga

SEQ ID NO: 180 - DNA, 1374 bp, Zea mays
  misc_feature (1)..(100): optimal_loci_77899_G1, chr2:158960100..158961473, Cluster 1
atctgccctatgttttcccatgtatggtcaaatgaggtgtttattcatacaaatctaaggcaatttattgtattactctcatgagttgatcaagtgattttaattgataataatttctgaggcaaactatagttcatacaattctggttatggtaagttgtttcttctcttttcttctcaagtgattttactctcatgatcaagtgattttactctcatgatttccttctcttttcttctgtttaagttgttaccatagttcatacaacactgaggcagttttctttctcctatatcttctattttcttctcttttcttctagcagttttactgtcatcaggaggtgtttaatgagaataactactagcagtttctgattgatcctgtttataaacattttctgtttatagttcatgactaccaaacaatgcatcatatgggcttggttcattttgactaggcaaccaaacattttgggttggctctgtagatgcgggctcccttgagcctggtcctctcattaagctaggctcaggctgggccaggaaaccaaacacatcctatagagttttttgagggtctctaatgagttcagtgaaaaaaatacgagaggtgagctattggctcttcgttaagagtctgtctttttacgacttttcatacactatatctcttagctgtatttatgatccaggattttaggattataccatgcaatctcttaatcgtttcttatacttagaaaattgaactagtgtctcagggttgtacatacacttagggcatatacaaaagcaattaataacatgtgtgttgagtcatgtttataggcctaatttcaaaaaaatgaagagtcgatgcttggtgaagccacgaccctaggtcgttcgaggctggagaaacgttacgttgtgtgcatgcctctgcttggttttacacctccgttgtcgcccccctccccatccgatgaacactgctactgctatgcctcatacctcatacgatggacgctgctactgttacaaagtgtgtggagcattaattaagatacaagagtttagatacactcctctatattaaaccctgtcttaggtgtgttttatacttagagaattgtgacgttgtatctgtattgtacgtgcccttaggacacacaaatattagcaaatatgcaaatacgcattcaacatcacattcaaaactttacataaaacatttgcgggtatgctagcatagaatgcaatgagtcctatgtctttccctttgacttacaagatgtacctgatgccatgatgcaaacttggttgtacggctgtttggttatggacctgtgcgtctccatgagtgtaagagctgatgctgcttgatgtaag

SEQ ID NO: 181 - DNA, 1006 bp, Zea mays
  misc_feature (1)..(100): optimal_loci_7857_G1, chr1:40897068..40898073, Cluster 1
ttaggtagtgtttggatgcagagccaaggaaggatgaagagagatgggatgaaattattttaatttgacccgcgtttggtttagagttccagagtcaggatcaaagaatattattcaaaaatggtggatgaggtcatccctcaaaaaataagggacggatcagcccagagttgatcccgtcacatccctcgttgacaccgaaccaaacactaccttagttctaaggaaaaaaaaaatcctagaagactcctttggttgttagaaaaaaaaggaaaacttccataggatttaaaagtaaaaagagctcggacctgatagaaaatttcctagtgtgaaaagggaacgctcccacgtttcgcctagtttcgtagtcacaaaatcgaacgagattggagtgactaaaattatcttattcaatatgtctctctgggtggcccgtgcttaggataaaaaaatatatttcaaacttcttagtttctttattttttatggtgtagctaaacaagtcttccactaaattccttttgtttttaaatccggtatggtgttctaaaggagccgttattgtttgtgctatcttgttctccctgggatgtgcagtttggtgcagaatatttgaccgcgcaagccgcgacgatggaataggttatagggtgcgaatctgaagggcccaacgacgggcgagcgtccgcatcactgaacggataggctctcctccagatcttcggaaagcaaaaacggcgagatgtcaccgccgttccttccgcgtgatagtatgggcgttgcaccacacacaccactgtcctaaccgaaaccaccgcagaatcgaagcgtgtgcgggacgcgtcttgatgatcagatgatgtgacaacggcaatgtgctcgatcttacgaatatcacaaaggccatgtaaaatgccgtaataacttgtgccaggtaaaatgccgtaataacttgtgatatatgatgaatacgctttgatatactcccactgcatgcgtgcca

SEQ ID NO: 182 - DNA, 1327 bp, Zea mays
  misc_feature (1)..(100): optimal_loci_7943_G1, chr1:41244616..41245942, Cluster 1
cgcaaaacaataaacaaagtgctaatctaaaacaataaataacttttcactagagaactaaaatttctacttccagtttgaatgtgagaactcaatagtgctaatctaatgctagaaagcgttagcatcggtaataaccactcattcacaggctggctgcagcagatggtgattcaccaatacataactcttttcccttgtcacgtacattgcatcattccatcgtaatcaaaactgcaaacaagacatttccatcacaaccaaaactcaaacacctgcatatcaatggtgtaagtgtagaagcacagggtggtcctcctagagttgtactcacataccagtccaagcctccaggtgagtggcggccgagcaggtgagtggcgagcgacgagcaggcgagcgcggccgagcagaggagcggcgagcaggcgagcgcggccgagcagagggcgcggagcggcgagcagcaggcgagtggcgagcagagcgagcggctgcgcgcggcgagagtgggattggagggagagccgccgccaaatgcccaaattttgggtgggattggagagactgagtcaggatttagggttttgcggattcgtgggcagccaggcaggctggggcagcggcgtttcctgctggctagagaatatgtatatgaacagaattttgctgttgcggctgctgctttgtgtgtccttcaaggtccaaattccaaacctactcgagagtttcagatacagcagggagcaattagcaaggcgactgatcttggtaattagcagcggagagtaggaagttaatctttcttttctgaagaaatctatgctaacctggatggctaagcacgcgtccggcgtacaaaacagccaagtctgatggcgaaagagtcgatgcacacgtgtaatttcttgttggagcatacttttgcgatcaatgagaacaggtgtgtactactggatctacatgtacggtatacgtggcactgtcactgtaccagcattagctccagcaggaaggtgttgagtccatagtccgatcatgttaggaaaacgagactaatctttctcaattgggcctggaattcgtgataaaaagcggcgacctggcttatttattatctttatacaagcactgaagcacgcgtttttcacctagtcaattcacttattcagaagtagttgaaacaatgttatgtctacgagagagctgaattaaacttccctaaattttcttatacaaattaaaacatgcaattaagcctaaattcactttatacgcttaaattgtttttatgtatcgatcaaaagttttacaccttaagtttcag

SEQ ID NO: 183 - DNA, 1382 bp, Zea mays
  misc_feature (1)..(100): optimal_loci_7946_G1, chr1:41247023..41248404, Cluster 1
taacacatcggaaatatacagtgagtacttgacctctcaaacacagtttacaaactatatgagtactttgtctaaaacaaaaagtgcacgaataccacataagagcacttttttattatcgcgatttaactcattgttttcagatgttccagaagaaaaggagaaaaacctgttcaaatatgacattgtttatacttctttctttgccccatataatagagttatttggtaattccaacaagaaggttcagctggcatatggcgtcactaccagatgctggaaggagatgagacaacgatttcgtccatgaatgtacattcaaatcctgtaccggtgctaccaagataaaggtcattaggcttctgaatagtttgagcccacacgccattatttgagtagacttcacctgctaataaaatttgttatctgatgaactgtcaactgtgcatgccattataaatcataatatattagcatatcccgatggatctccacggcctaccaactttccgatctaggacttgggaaatctgctgctacgaattacggaaagcgaaatgaggtagtagtcagagtatttcctaaggtgaactgcgcactgcacgtaattcgtattttagacacaactacacggcgcctttggcgtggtctcatggacgggagaaaagcctacacggtgtgtctcgagagaaagtttgtagggtgcctttgacaggaggatgagtggccattatcccatcccacgaccttttcgcagtatatctgcgcgcctgtgtgcctactggtactggtctctcccgatgatgatccattagcttagcttgggtccgcgatagaaatcgtattggatagcgacgcccacttcggaaaaagccagaaaaaatgacgccggacgagcatcattggtcgccgcgcatatcgagctagcccaactcttccagtggagactggcgtggcacacgacacgtcgccacaggtgagctttgattgggctgatgatgatggcagaattcacgaacgcgtgagccatttctgcaaatcgcacgcggtgctgccgtggtggtcgtggtggtaccaaccaacacctggcaaactgcaaagctactcctacagccccgccgcccgcctaaacaggcgtgcttaaattggtggcaagccccggccgccgtctcacatcacgcccgcccagcttagactctctccagcaacggacgctaaagcgtccggtacgctaaatttagcgcttgttaacatccgcaaggcatccaacaacgctcgttattgcgtccgctaagatagcgttcgtccctggctgccgctaaatgtagtggttcactgtgcatcctctatccacacagcggcacactattcctcttcgaat

SEQ ID NO: 184 - DNA, 1101 bp, Zea mays
  misc_feature (1)..(100): optimal_loci_80524_G1, chr2:174459326..174460426, Cluster 1
tgctcataagaacccaagggatatctatctcccatagttgtcatatctatgttttgggagtaggaccattatgcccttggctaactagtttagctctagaatatctagatatattgggaatgtgtaatagcctctataaataaggggagggatgcccccaaatagccatttttatattatctatctagtggtttacttttcatgccttttgtcttgtaggtctctccttttgactgttactgagattgatagaagttttagcaaacaaatattcatctatgtttttgccatggtggttcatggtgaagtgaaatatatttttatggtcctttgagttcttgaagtttttgctttggtttctctactcccaatctcctctctttggtcttttgttggatcttttgaatatgagttctagggacttttgggttgcataggaatgtgcaagggcctccatggattattctcacctagtggtttgggcagattcaacttaagcacgaaaatctaatcacttgatcatttttgagaaatccacgagctaagagcatattttttatttgctattaaatctttaatcttctagacctcaaattttgatgacgcctttgaaacttcaatggcaatctgtgtgtaaaacatcaactcaattggagtttctttgaatcgttttttaacttttggagctttggttcacgctactaacaccaagcaccacgacactaacgtgaatgagcaacactgttgttgcctagcaatggcagggaataacaatgttggctgtgagcacagcactatctctccctcatggacaactcatcgtttcgagtgctttgagagttttaggtgtatgtttcgtgatccattttgttttttgggttcttatataccctatgaactttcccaaagcatcaaactactatttgactgtagtgttttctatctaggctctttcttcattcatgttggaatagagagctcaatttttggattttggaaagtttcactcatgcatttggttttagtgggtttgagtgctccactgtgtctgtcggtcctcactaagaacatctaaccacttattggctccattgtttatcc

SEQ ID NO: 185 - DNA, 1174 bp, Zea mays
  misc_feature (1)..(100): optimal_loci_81833_G1, chr2:180848239..180849412, Cluster 1
ggtcctacaccactgctggctcatgccatgaaccggtagtcacatatcaatcctagccacaatattattgttaatttatgacttaaaccggaagtggtatctcattgtggatttatgctttgattcggaagtgatagaaaactttatttcttgcttttaagaacccttaattatttttgaattttaagttaaaattagatgttgaagattatctatgacgacggtttccataccgataataaacccataacaggaatccatactttcaacagtagcaaacaacttgattacagacccaattaatatccgatgcctacttcagctgtagtcaaaaggaaatcaccccccgacggattcgactcggttacttcttcctacgcatgcgtcgttactgcgggctgactagatttgctttcgcttggagctaggtaacccggcctagtgcatgcccaacaataatacaatagagctagctagctagctagaggcctagagctaacagattattattgcttaatgatcaatcggctgtactagtggctaactacgttgacctccgttgccatttctaaacaaaactaagcagatagcaatacaaacaaacaaaaccatgtaagcatgcaggccaaagttgggcgcacgagatcacgatccaacgtacgaaagcaactaacaagcaaagcaggccaaagttggacgacgcacaagaggacacaacccaagtcaagactggatttgcttctacgctctctctatatagtttaataatcgagccggtcggtcgatgatgcgtgatcttaggttgatcgatctctcattcatagatcaatcaagtgagtgcagacgtgtagtagaaaaatcagtgtgaaaccactcgcttcaccatcctcgctcgtctcgtctcctgctgggggtgcaattccagcccatggtgcaggtgttggcactccagcgccgcggcggatcccacgcgcgtgatgagaaattcggcgagctaggggtaagaaaagatctaacataacagtaaaacagtttttctaccagccgtccgatataagtttaaagttcgacgcctgtcagataagcgatcagatattaagagtatatttaaaaccactaaagataatagttagccagctaataaattattagctagattgagtcagctaacact

SEQ ID NO: 186 - DNA, 1317 bp, Zea mays
  misc_feature (1)..(100): optimal_loci_82315_G1, chr2:183554674..183555990, Cluster 1
aatagattgcgtcgggttgggggagctggggaatgggaactcgcccgctgctcattggcgtgccgctccaaacgaccaaaccctactgacctacctcagtataggcgtacgcgtatggcggcggcggcgtagcagcgagcgggtgtagcagcgagctctgagcgagggtcaccgagcgcgggcgtagcagtgagcgggacacggagcggcggcggcggcgccatcgagcgcgagcaggaacaggcaaacaggagctagcgcgagtgcgtgacctagggacctagcgcgacccagtgggcagcagcgtcttgacgtattcgtattcgatatccgaagcaagtatccgaatccatatccgatatccagaaaaaacgttcgaatatccgaaaaaaatatccaaatcattatttgctctctttggatacggatacggacgggtttacatccctagctggtgggcacgcggacgcggtggggtggggtggggtggggtggtggggtgcgttgcggtgcggctagacgggacggagccttgccgttaacttgagacggcggtttgataggatccgagccgacatggtgcgtcggatcgaaaccaggaccgaccttggtgtctcgttttccaggtcgaaacggctagcggttccttttaaaccgccgtcagcgtctctcggcgtcgtggcgaagaaaccggacgactcgtcggtctctgtgagctgtgacgcaagctactgatcaccatcacctgctggcgcggggacggcggcgacccggcctgcgacgggcacacgcccacacgcggacgcggagctgtttgctgcgcctgcgcggcaggacaccggcggtttggatgctcctgccacctgctcgccggtaggcgggcggcgcaccgcgcgcgtgtcccaaagtcagccgcaaaatgaagagaaacacggaggacgcaacacgtcgtcgacgcgaaggctgatctcgctagcacggagcacgcccatcatcatccgcctcgatctgctaacccgcgccatggccccatttcgcccgtccgtccaatgggatggatctttttttttttttgaacggaccccggacccggagggagtcgatcggaacgaggtacagtaacaggaccacatatgtgtggtctcgcagttccgataagaccagacaccggcccatctcggaccggacgtgctcctctacgaactatgggcggattcccgctttccggaggaagtaaatccctccgttaaaaaaaaactgtgcttgtattcctttgatcacaggagtatggacccgcttgtttcaactttagctttt

SEQ ID NO: 187 - DNA, 1007 bp, Zea mays
  misc_feature (1)..(100): optimal_loci_83182_G1, chr2:188421424..188422430, Cluster 1
gcaggccttgataatttcatgggccgagcgcagaaagacaggcaaaacatatattctcggaccaaaagaaaaataagtactacggacggtgataattaacagacgagccatcacgccgtctcgtttcgctttgggatcggaaggctctagaatccacgctacgacggtctccacgtggcgccagtccaccggacggtgatacaccgcgacggggcccgcgtggcagcggcgcgtggaaggcgtcagcgcagggtgcggtccagtcaccgttgctgacgcgcgatcgtcgggcaggactgcaggagggaagaaaacaacagatgacttgactcgtccatgcgagaccatgacctaaaccctatttgccctgaggcttttggctcttcatctgtgttcatgactgaacttttttaatatgaaagaggagggggtgtaagcttctactgaaattaactgttcataactgaaattgaccggcaagtctaagaaacataaacatttggctagcgtgaatccggttcaactgtttcgtggtttatgcatctacgacctgattggcgatccttcgtcaacactcagaacacagtgaaggataatgcttgaccatgctgcatgattgctctgctgtcgtcttgaacggctgttcgcgctgtccatttctgctcgatgcatacgcatacgtacgaatatatagagtggagagtgtagaccattagaccaagaccagggtactttcttcagactcgactcgagcgttgacaccaggagcgccggcggtgtggctcacacgactcaaagtctgcaacacttcttcacagaactgaagttacaaaaaccatcttattttactattaattaattaattaattggacgacgcatcgaaggcattgaacaccgtacaaatacagtaaacaaagagaataatgtcaagatctagccatgtatccctctatttcaaattataaaacccttttgttttaaatatataactttttattctgacccc

SEQ ID NO: 188 - DNA, 1083 bp, Zea mays
  misc_feature (1)..(100): optimal_loci_83338_G1, chr2:189214359..189215441, Cluster 1
  modified_base (199)..(199): a, c, g, or t
  misc_feature (199)..(298): n is a, c, g, or t
  modified_base (200)..(200): a, c, g, or t
  modified_base (201)..(201): a, c, g, or t
  modified_base (202)..(202): a, c, g, or t
  modified_base (203)..(203): a, c, g, or t
  modified_base (204)..(204): a, c, g, or t
  modified_base (205)..(205): a, c, g, or t
  modified_base (206)..(206): a, c, g, or t
  modified_base (207)..(207): a, c, g, or t
  modified_base (208)..(208): a, c, g, or t
  modified_base (209)..(209): a, c, g, or t
  modified_base (210)..(210): a, c, g, or t
  modified_base (211)..(211): a, c, g, or t
  modified_base (212)..(212): a, c, g, or t
  modified_base (213)..(213): a, c, g, or t
  modified_base (214)..(214): a, c, g, or t
  modified_base (215)..(215): a, c, g, or t
  modified_base (216)..(216): a, c, g, or t
  modified_base (217)..(217): a, c, g, or t
  modified_base (218)..(218): a, c, g, or t
  modified_base (219)..(219): a, c, g, or t
  modified_base (220)..(220): a, c, g, or t
  modified_base (221)..(221): a, c, g, or t
  modified_base (222)..(222): a, c, g, or t
  modified_base (223)..(223): a, c, g, or t
  modified_base (224)..(224): a, c, g, or t
  modified_base (225)..(225): a, c, g, or t
  modified_base (226)..(226): a, c, g, or t
  modified_base (227)..(227): a, c, g, or t
  modified_base (228)..(228): a, c, g, or t
  modified_base (229)..(229): a, c, g, or t
  modified_base (230)..(230): a, c, g, or t
  modified_base (231)..(231): a, c, g, or t
  modified_base (232)..(232): a, c, g, or t
  modified_base (233)..(233): a, c, g, or t
  modified_base (234)..(234): a, c, g, or t
  modified_base (235)..(235): a, c, g, or t
  modified_base (236)..(236): a, c, g, or t
  modified_base (237)..(237): a, c, g, or t
  modified_base (238)..(238): a, c, g, or t
  modified_base (239)..(239): a, c, g, or t
  modified_base (240)..(240): a, c, g, or t
  modified_base (241)..(241): a, c, g, or t
  modified_base (242)..(242): a, c, g, or t
  modified_base (243)..(243): a, c, g, or t
  modified_base (244)..(244): a, c, g, or t
  modified_base (245)..(245): a, c, g, or t
  modified_base (246)..(246): a, c, g, or t
  modified_base (247)..(247): a, c, g, or t
  modified_base (248)..(248): a, c, g, or t
  modified_base (249)..(249): a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
acaagggatttccttaataaaatcgatgagggcaagatcaccttgtgtgcaaatatagtctagagcaaacaatcgtgagataaaaataaaattagttattacaataaaaaacaaattgatccatactgttttcttaaaattataatacctttcggaactattgcggtgccgccgatgacgaatctctagattccgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggcaggcgggcctcaagccctgaacccaaattattacgttatcgatcacgagacggccggcaaaaagccgccacgagccggccagcccctgcatgggcatgggcgccgcagcgagaagctcgctcgtgcagtcgtgcagtgcagtgaacccgcgagccgttggtcgtgcctgcctgtcgcgatcgcctgagcgcaggccgttcgtacgtgtcgcgcgcgctcatcaggactagtgctgcagcaatgcatggcgctggcgcccctccatgcagcattcagctcctctcgtcgggacgggccgggatgggtgggtatcatattggcgcaaagcggcaaggttggcaatggcacaggcgcactggactaccgtaccgtggccagcaacgccgccgcgacgggaggatcacgcgtgcgcacgtgtacctaattacctatacggtgcatcgcgatcccgagcatcagtatcacgtccatgcatgctgcactattcagatagtacgtaatgctgcagctgcaatactgcagtacggggtctcaggtgtacaaaacagtagtacgtgtgagacggctggccaatttaaagacgtacaggtacaggccaggggggtagggcatcgtgtcgtaccgtccagtgcgtacgacggtattaacaagccattagattgagaaaacagtacgtcagacagcgctatcaagcacttagattaacatgcatcacgtttattgtcatgtcactctatcaaatacatcctactgatggttgtagctagactgatggttgt

SEQ ID NO: 189 - DNA, 1363 bp, Zea mays
  misc_feature (1)..(100): optimal_loci_8390_G1, chr1:44166772..44168134, Cluster 1
ttgtcgtgactcaccaatttatagtgttgtcgcctttcttcctcgatatctgcctgaccgactgcgagtccattactttgagcaacacaatgatgttaactagtagtgtgaataatggccactagtaattttgaacacacgggtcccttcgcaaggtgctatcttgtttctgaatttgttaattcagtggagttcttattagaataagcatgtttttaatgtatgtatccgttatgcctgtgagcagtattatttaacccgccgtgcacatatattgtcgcaattctactatagtatttctgaattaaatcaaacatgcatgaaaatacctaattaatttcctagcgataggaaaaaaaagtatcaatcatctacggaggtctaatgtatgcatgcaaaacacgagcatgtatatattccagccatctgtggcgatatcgtccataaacgagactgatgggtacgtacgtagtatgcaagtcagacagagtggccatggaaatcaaagggagcatgacctgcacggtaggcaacactaatggaatacacctcaaactcaaaggcgtgctaggactgtgctctctcttggtgtatccataccgtccttgcgtatatgcaacttcaatgttggaatacataatctcaaaaagctttcagcccagtcacaagcttgtacgacgactggtcgtcatcctggactatctattagctcgatcagcagcccaaatttatttaggcagaaggtaataaaggttgtgtttagatgatgcatgatgatcgatcaccacacatcgttcagtcagaaccgatcgagctcatcctctgatcctggcatgatcttcttggcgatcatatgcatgcatgtgagcggcctccagttttgctggagagacgatgaatgcgcgcgcatgtgcctgccgatgatgcatgggtagtagtacatggcatcatgcatagtcgcaagcgaatccagaactcttatctgatgcatgtcaaaggtctgcttcgagagcgtgacttttcccactagcgtctggagatgcagttgaccgacacggacttggccgcccgctacattgcaaactacctgacgcgccggtcagagctagcgtaggcccgttcggcacgagacagcgactgttcgccatccattttccggtctcttccaaaaacatcatatcagatcgtttttgaacaactaatttaagtttggaaaaaaaaaaggataagcggagggaaagaaccgctgggttcaaagacagggcgcgccatgctcgtagtcgtcgcgcgagcgagctgggtgctgcagacgttaggctctccacaataaattccatttttgagtgctaaaaattaaaataaa

SEQ ID NO: 190 - DNA, 1309 bp, Zea mays
  misc_feature (1)..(100): optimal_loci_84200_G1, chr2:194496890..194498198, Cluster 1
tttgcgtcacgctttgtatattagtaatacagcatgtttgcttgctgacctagctaggtgttgatatccaaaaattccatttcaccgagttgttaaagtgtgaaaaagatcatataccattgtgttccgatcctctctagctgagatggttaaaaaaaacatcagtctgcataaaaaaacacagagatctagagaaccaaaactattcgatcacaaagttactcgatagggatagtagggataagattacgtgcttctcgatagctctgcgaaaataccagagtcatcgacgtatttcttttttagcttcttacgctgtgtacttgggctatgtgctttacttttctagcctatgtcataggtttagaacgtaggtcgaatagatacaacaacacgtatagtcaaaatcgtacgtagttgtacatgcatgtatatatatagacacacgcgacgggtgccttgtttgcaaatatagcacggccccgtaatattattattattgttgcagccggccggccggggcggcagccggcaggtgacacgcggctcccggtcaaatcagccccctgctccttagcggcatgacatggctagtgcctagtagcttccctttagtgaacagttcctatcgcacagaagccgccattaacaccaaaccggagcggtccttagctttaaaaatcaaccaccgccattatatggtccctgtggcggaggagctagccccggccgggagggaggtccatgaccatgaccactgatggacggaggcgagccaaagttaaggccgctcgctagctagctgctgctggttggtggtggtggcggcgaggggcgcagtagtagaccagtagtgcagtcaacaatctgccgacaccagagctcgcgcgacgaccgtgcacatcgatctgtggcagactggcagtgcatgcatgatgcggcaccgtacatttgattggagaagtggatgcatggagcagagagagagagttggattgcctgtccagttgtgacagtctgcgtgccggggcctaacgtactcatgcatctaactaacgcagtacgtacgtacgtactatatattccagggtgtcgaaagacactgagactgtgttagttagatgcatgtgttagatgccacgtcgctctcgcgttccccagtagcaggctgggggagaagaagcccggccttctgcgtgcatgtgctgcagctagcgttctctctcgacaaggctaggccaggggaacgcccccacttcccttcgtttcccgctcccgctcgcgcgcgcgtgcatctatcggtcgcccc

SEQ ID NO: 191 - DNA, 1080 bp, Zea mays
  misc_feature (1)..(100): optimal_loci_86058_G1, chr2:206398745..206399824, Cluster 1
ggcaacacagatacagaatttaatctcactccggatgttgaccagagaaatggtcgagacagatctcatcaagcaggttagtaatttcttagattaataaaatgtgtgctgagagaaaaaaagaatatatcattcagagtctgctggtcctggttataataaaaagaattgatccataaaccacttgcctcataatagccatgattactgcaaggcgcacgaagtgcgcctcctgatctagtgttttgaaaaacgcagaagcatcttcgactctttgttgttgcacacaagtacagaccgtgcgcaccacgtcaaggcgccaataggctgtgaccggctgggaacatgcgtcttgctgattagtgactctttgatttgaccgggttttttttgacaacagacttgaccggttgaccctgctccgtgctaataatggtcgcctgcactgcagctcaggtcagccagagccagaggtggtcgaatctggcgccaagaaaaaaagatatatagtcagaactacgatggataaagacaaaatgttgtaaaagcggatagccttatataaattaccatcaacacgtctcactcgtacggatctataggctggtcaactttgctgttcttcaatgagcaaaaaaaaagagagagagagagttcaggttcttctcaatactgacgtacggtacgtgctgagaagattagcccggacagtggtgagattatgggaatatattagctttccattgcttatcaaattggaccgctcatttgtcatgtttctttgtccaatgcatgtatgtaatctgctcatttgttcaaattaattacgagcacgcctgcactggtgagtggtgagtgactggtcgtgggcggcccatcccacgcgacgggggtagcgttgcggggggcgcagagctgccaaatcctccgtgacgagcgggccccgcgacgacgcggtggcgcgggcgacacgtcgtccgcgatggggaccggacctctgcctgtcttttttcttgtgcaggcccgggccctggagggtgaacggaggcccaattattttatgcaagtgtcgtccgcgtg

SEQ ID NO: 192 - DNA, 1290 bp, Zea mays
  misc_feature (1)..(100): optimal_loci_86235_G1, chr2:207370816..207372105, Cluster 1
ctcgtcggttcttgctagggaccggagccagagacgtctccccatcaagcaacggctgcagaaatttttttcaaaaaaccccctggagacggtgtggagacgcctgagtaaatggcgttgtacacgcccttacgtcgatggcctgtttccgcaacatttatcagcgcggatttcatttcatttctgtattaattcagcagttccatttgtgagacagaaaactgagtagacgaaccgcggggatcttgagctgatttggatgatgagtgaaggacatgggccagcacctgaccggtaggaccgtaggagagcgcggttcccaagcgcagtgcatacgcgcgtgcaggaaggaagtactccgtgctctcatctcatctgcggttactgtgcgctgggcctggtttccggtcaaatcggttgcggccagactgactgacgtggagagctcctcacagctgcgagattcctgctcgcccgcctgctattctggaactgggaccggaaagaataaagagaaacaatagcagcacaggaatccgggtgcagttttgaatcagtgaaatgattcgcttaagcttcgcattcgcttataagtaaagtacgtacgtacagtgttggcttagctcactgtgctggggccaacacgtggcgtggcttaacgaacgaacgaacaatcatggatggatggagtagtatctcacaacatctctgcgtccacgggagcacggcgacggtcggattcgtcgtccacgggacggagtggccgcgcgtgtgctccacttgtctcgtcctgcttggccgtgacgtccatttatccgctcttttttttcttctttttttggtgctgcggggctagctggaaacttcttctcctgcgaataggatcgataatatttgcacctgttactgttaaaatcatctccatccagctcttgtggcgacaatgcatgcattgcccttggcgtggtgattggtacctcacttgtgggctttaccggccgttcaggtggtaacctttttcagtcagccagcaaattccccccacgaccgcgcactttgcgtcgtaagtaaatagcaacgtcaaatgcagcacgcgacacagggaccgtccaaccacgcagatagaccggatcgaggagtgggctttagttgttttttttttacagctggtctgttcgttttattaataatttttattggaagtaattcgcgatgtcggcactgcacattttcaacaaaaaaaaaagattgttcgtttgtgatgagtggattgaaggatattagagccag

SEQ ID NO: 193 - DNA, 1035 bp, Zea mays
  misc_feature (1)..(100): optimal_loci_87027_G1, chr2:210853904..210854938, Cluster 1
gataggtatatgctcgtgcgttgttacaaaatcaatatgataaaatacattgatatgaaaaaacactaattattattctctatacttttgttagcatcactaaaatggatatttacataccttaaaagatatagtaaggtgtccgtgcatttctacgactatcctctgttcatatacaaacatagttgtttcttaaattaaattgttcaagagtaatcaaagttatatgatatgcctattttagaatttgcatgatttacagagctagcataatgagataaggatatatgaacacatagaaagtttctccagttatatttactcatccccaggaatttaaaacgacaaagatgtcatacataggaagcaaaaaaacaagaagctaccaacgtactcactggcaggaaagatcgtagaaccaagtaggcattgcttgtgtcaacatcacagagaaatataaatcctagcaacgcacgagcatgaacaaataaaaaacctgacaatatagctcagttggtgatccctttaacatcaatcatatcctaaatatagataggaaccatgatattgaaagggtaaagaaacataggtattgttttacatgatacagtagcaattagatcctcgtgaggatcttccaacggcttcaacatgatccttgaggtcatattcctagcttggtcaaagtaatcctcaaacatattatgcggggagagtttccaaaacattagctcatatgctggcatcgccatcttgcatgtccaaaaccggcacaatgaagagccaaggctaacataaatgcaaccctaagtgcaatgtctcatccttccggtggactaaaattaactttataaccttattaaaattatgcatggaaaggcatctgccagagatgtgcatatatgttccaaggataagcaagcaaccagaattgatggatcgggtgcctcaccgtgtcactacaaatccgacgtcaatatatttgatcgatactgttggtgtagtgcgagggaaggcatgtggaggcaagaagta

SEQ ID NO: 194 - DNA, 1132 bp, Zea mays
  misc_feature (1)..(100): optimal_loci_89030_G1, chr2:222254038..222255169, Cluster 1
tccaaatgattagaaattttactaaggttttgaaaattcacaaattccatccaagagaacaaaaaatgaaataattggtctatattttaccagggtgaccggccggctgtagacccacaaaatgctagtttttgagtgattctatgttgacattctgaaccctagccccaataagctaggagctttagctgtctattttattacatcatatccactccatagcaccccctgtaaactcgaaaactccaaagtaaaatgcacttggagaaaggtcctgctgctaataatcaataccttgtaccaacagtactgatggaaacagaacgggagtgtttatatcaaaacaccagacagattagtagttccggcagttgcacattgaagaaattgggataaacttggaccattggacacgaggagctttggtataaggaataaggggaccatgaatcagaatgttcatcagtagcaagaggggaggccggaacgaattcaaagcagcaggttcagggcagtgtcagcattgatctgcaaacgccagcgtccatttgtggcacgagagacctccctatgaattggcagttgggatgcccaggtacttgcagttcaacgctcaaaatcggtgcagctgatccacccaatttctgaccataacatgcgtgtgatgtggtccttttttttatcatctgctttgacgacagatcaactgtttgatacatacaggtcgcagccaaccaagagaagcggtgttttattttgctcgtcgtcgttgacagcatttcttcatgtgacaccacagacgcatggttcccacaaggaacatgaaaccaagttgattgtatgtttttagatatgatataataaaaataatcatcaaaactacaagatcagacagtagtttttttttgtgcgaggaggcacatatgtcaaacagataaatatgttactgacgtttttatagaatgatgaggaaggtatcaaattggatggctacaattatttaactgttcaacctactcccgtagcatcaagtaaatattagtaactgttcaacctactcccgcagctccttaaatattagtaacatatctatctcactattactataaccggacgaatctctagattccgt

SEQ ID NO: 195 - DNA, 1026 bp, Zea mays
  misc_feature (1)..(100): optimal_loci_89225_G1, chr2:222969114..222970139, Cluster 1
ctcttggccttttcgtcgttcctctcacccgtggcgtcctactagcatatcccccactcgatgtacatgtacgtacgtatcatgcatgtatgccatgtcattgcccagtaggacgtccaagctaggacgagagacccaagggcagctgcaataattcatccatccgagacgagaacgacacacgtctcacatgcatgcatgctcccttttttcttgtcttgggattccaagattccaaaatcccaggtggaggttgcattggttgggtgaggcaccgagcgaccagtacaatgtgccgtggtggcatggcatgacagcggcggctagcggccggcagtgccaaggtcgcggcagggcatgcattgtcagcagcagtccagaggccctcctggtacgtgtcgtagtaccaataaaaaaagattccagccaattcctgcacgacggtttcattcatgactatcgatgctatctactatttcaaactctactatataaataatataaaaccatgcatatggccatatacattgtaaactatattactatattagtataacataggtacgttgtaacggtacaccaatcatatttgatgttataatgcaacaatcatttgatatccgatggtctaatggtaagccagtgcgatagaccctcttaaaaataaatttaaaactaaagtagaacctccctataaaaataaatttaaaactaaagtagaacctccctataaaaataaatttaaaattaaatttgacatatagcccacataccagatattaaactatgtatactgcaaaatgtatgagttgaaaagaatacatacccttttttatagctcgctcggccgctcgtcctacttcagctagtgacgtggtactatccaggagcgctgcatgtgactttatttcatattgggcttgagagttttctcatagcccatctaggaggtaacgacctcattgttagttgagacgtgagggacaagaaacatatctacgcgcttcgtatgtgacacatggcgca

SEQ ID NO: 196 - DNA, 1072 bp, Zea mays
  misc_feature (1)..(100): optimal_loci_94067_G1, chr3:9818777..9819848, Cluster 1
gtcaactcattttttatagttacttagtactaatataaagaataaggttatcctactaaatttaaggaatagacctataatataccacattattttggatgaagtgatttctcaaactaaacaccctttagtctctccttattagtctcctatacctgaaccttttcagattagctagcaactggaaaccaatccatcctcgccctaccgacaaaccaatacaaatgcaagtagacacaagtcgaagatagacacacactcaccccccacccctaacgcaacagcggccaaacgctgaaacttttgaccgcgtgcgcagtttacttcctttagctcatttagctgcatgacttgtttactagcagcatcagtttgccgacagcattttggttgtgaaagcaggaggatggaggccgcacagttctcacttctcagttgggtaggcagcatcccattcccatccaagttttaggcgcttctttgacaggacttgagttggcagaagcaatctctcgtcagagcagggctgttacaaaaagctggtgtggctgttacaaaaagctggtgcatgcattcttaacgttatcacctacacgtacgagcagagcagatatgttatacgcacattattcagagcattgaaaacatgcctgaatatgaggtgcatgcactaggagtaaatatatttgttgtatagtaacttttaaagctttgcagcactgctagatatttagatgagtcagaatcagaactctgatcatcgttgttgctccactcgggcagatatttgtcctaagtgccaactccattgggatcgtcatcatccatagatgcatgcatgagtttgagtttaactaaagaaatgggatcgctcaggtagtggggtaagtaaggatgcaagagagacgggctagcaaaccattttttcgcagcataattatgaccgattgatctctttcttggcaattacttcactgcgcaacatataaactaaattatttgttagattgcatctctaaatcccatttttctcttcgagtccatatcttgtctgaaacttactagttataca

SEQ ID NO: 197 - DNA, 1302 bp, Zea mays
  misc_feature (1)..(100): optimal_loci_94098_G1, chr3:10066901..10068202, Cluster 1
tcatattaattctacattttgcccctcatttatttcagttgcactaatgtcagagaaatggttaggggtatttgggtcttcttatgagtcatttaatgtgttattgatatttttagtctatgtagtgatagggtctaactctagtccgtgagcaaataggtgatccatttgctggactatttggatgtctaccactaattttagatcatttaaacagggtctaatgtactactggactagttgagttgaatactaaagtttagttctatcgtggtgataataccattttactcagagtattagaataaatcagagtgataaagagaaactgttttataaaccggagagaaagagaagtcggagtgagagagagcaagtgaatagtgacccgcggggcccctcttctgaaagcgacaaaaggagaagcgagtgcgggcatcttttgtgatcatcattcagaacagcagtagcttgagcaagaagcgccaaataagaagctgcagtggtcaggcacaggcaagcgtttcggcattttttatgttccgtagagttccgagttccaaaaaacacagagtgggagaggagaggctcacgggcatgtcgcatggtagcactgctggtgctgcatcggattcttgtgcagtgaccatcagcatcaggataaaaaaaaatagactcgagctgtggagccggaagcgacaaaagagaagctgcggcgcggtggtcactgctggtcagcctactttaccgtgcgatcggttcgtactacaacacttgacaagttctacgctacaggttttctctgccgagatccctcccgcttttttggcatttgctcgtctcgtgactcacaaggcctacattggaccgcagccttctcggaacaaataccatgcactgattggtggatgctacacaagaaacacaaacatcgtgtgtaatatgataatatacagggccgggccaaagaaatttgaggccctgtgctaaatctaaagcagtataatgtatgtttttattaaaaatcagtaataacaatctacaagttacattaatatatattgcaatagaatatctaaataaacatttctattttatttgaataacatcgttcttttggtgggttttaaaaaaaatattgtacaatatgcttatattcgatcttatccaaagcttcactctgctattgtggcaaaataatacgtcttttttttatcatagtagaacacaaatatgaatttagtagctttaatttagagaactttgttcacgcggacagatatgttaagatcctataaagat

SEQ ID NO: 198 - DNA, 1208 bp, Zea mays
  misc_feature (1)..(100): optimal_loci_97998_G1, chr3:31465161..31466368, Cluster 1
ttaggcatggcatggctagcattttacttcttgttgattccttgattagctaggttatatgtttcaaataaggtagttcaatcgtcatgcaaccaactggtcatgtgataaacataattagagcacaaaacaatatttaaacaaataataccagaaatgaaacactaagaatatgaataaataagatccatgctccaaacagagtgctaccatatatagagatatcattcttataaatagagggagtaaatgcctatataaatttgtggatctctatataaatagagtgctaccaaacataaatcattccaaatctgtggatgtttagtggcagatccaggaatagactaaaggagcctgattttctagtgacaaatgccagagacaacacaagctggtagggggctcatttttctctcttcttctttctcctcccttcttctctaccctccacctctttctctaatgtttatgacaaacctaaaacatccacctgtattttggaaatagagggagtaaatgtctatataaattttgtttatacccacaatgaggtttgttgatgtcgggtacatgtacatccctacgtatacctattgaccacattgatcgagtagcaaacattcttccgtgcgatgcctgctggtccataaatcttaattatttattaactgcaggtgccaacaatctcatgcgttaaagtatgcacacatccacccgcatgttccccgggacatcagtccagctctcgatcgggtcttgtgcaaacatcacatcaatagaaaaagaggagagcaccacacttccctttaaaggagctgaaagccaacagaaagacatctcgggagaaaagaaaagagtgattggaaaggttcaaatgtgactatggaccttttaaagccttccctagctttaagctttaagtacgtgtgcgcatacagattcttttcggaagggcaactcgaccgtacgtctgattaaaccggcctctggcagtttaacatgcatggttagatcaagatgactcagaacaacaaacataacgtaccatttgatgctatgattgcaaccttttgaaggagcttctaaccatcatgacctaatcatattatgctgtctttcagagtagcacaaggtcaaagcgtaataatttcgaactgtaacattgtttctcacaaggcacatggagatataaatattttcagttg

SEQ ID NO: 199 - DNA, 1070 bp, Zea mays
  misc_feature (1)..(100): optimal_loci_159525_G1, chr4:172518643..172519712, Cluster 2
ggccaaaccatatgcaggcaaccaaacgcacctataatggcacacaactaattaactcattattgttacccccgagagtatattataagaaattttatatatgaaattgtttgaaaaatatccatgcatttagcataaaatgacctcgaacagcctatgaagatgttggacacaaagccgtgacaaacaaaacctagctactggatttggccaagctttggcggtcgcttcgtgggacgcattgtatgcatgcacccacacccgcactactgcacacgttacagtcatcgcgacctaacatatcctagtggaaagatgcgcgtagctaggctcgtgcacacgctacattgcatgtacagagttggctacgaccagctgctgtactacatatactgtgtgcacacagcacgtgaacagggatgtgcatcgatcgatcgacggagcatgcatgcatcagccgctcgatcgctagctctctcgctctcggaaagctggacgagcgagcatgcatgcaacagtgtcatccgaatcagattctgatccccatacgtgcatgcatggtgttcgagcgacaatgacccgcgcgtgcaggcagagctagctagcgagctagccgctagctgcggtagaaggagagtacgtaggagacacagcatgccagcatgggtttgatgtgcgtgtgtgcactatcggatggaaccaaatcaaatcatgccccccgcgcgcgcccgagcccggcacacatgccgcgggggccgggcgcgcatctcggccgcctgtagccggcgctgtgcggcggcggacggcagcgcgggcgggaagccggctggcaccggtgccccaccggcgagatagggcgcgcgggccaagccggcagcggggatccggccggtgccacaccaacccacagttggtcacatcggtcacatcacatgcgggtggatcagcgcggctggctgggcgcctattttgtgcttcctctgggtacagttaccatgcatgcatttgggcgcggatgctgctctgctggtactcgacttcgtagcgtgcatgagttaggctgcaccatc

SEQ ID NO: 200 - DNA, 1128 bp, Zea mays
  misc_feature (1)..(100): optimal_loci_101170_G1, chr3:50101619..50102746, Cluster 2
ggcgaccatgcccaagctcctggatgggtcgacgtctctttcctttgaaactgagcaacgttcggaccaaaccaaccaccgagacgagatggtacctgccatggcatgcatgtagtcgacggagcctttcgttccggcacccgctcaacgctggtctcatctagtcatctgctctctagtcatcagtcatcactgtactctcttcctaactgtctggctcttggcgtgaccgaccgtcctcgatctcttcgacacgacttgcatgctattgctcgtcccgggaggcggaggtcaactaacgaaaaaggtatactagtgaacaagaagcaagtgcaaagacagagtattctttcttttttttccccttgtaaaaggttgcataataacacgcttggaaacgacaatgtagcaagtctaaatgtacgatggtcatgctaattgcatgttctttaagcttggtgggccgttcaatccacgccgcgcgcgccatgttgttttaattaatccgttaagattatctattcacacacacaatattttactcgataaattattctgctgttgacggtggtggtcagacgaaaaagtatcatgtccaataataattgtgtaatcgccgtgtggccaggatcgagaaatcaagcaactaacaactgctcatgtatacgtaggtagtaagggtttgttagagcacctccatctcgcaattatttgcgacagctcgaatgtgtactccctcccacttttttttctttccttgctctccccactatcttgtctccggaccggcctcctcctccccctcctcggccgttcttttggtgcgacggatcagctgaaccaaccaataatcccctgctgcatgcaaaattcgtcgttgcacgcctctgaaaagaacaagaatatcaaccttgctttgactgcgctgacgcttgcctgcgaccttatccgtcccgcgtccgtgttcacagaacttggaccgggctagctagtctccacacaccaaataatctatatttattattatattattactactaggttcattatacatccaattcaggtttctcccattctagcgtgaagtttgggcagactttgagtttccttcctggattcacataggat

SEQ ID NO: 201 - DNA, 1031 bp, Zea mays
  misc_feature (1)..(100): optimal_loci_10471_G1, chr1:56078424..56079454, Cluster 2
aaacaaccgatacaacttaaagaaaacaacttccaagcgattttttttaaaattgtgattgagtagtagggatgtaccaagagtagcaaccggctgcataatcatgaccattgctattcatccctacttgtgaacataatgggacgcaaacggcacctgagtgtttcttttctatttgtggagttttctctctctctctctcactattatactttctcttcttggaccaccgacgctctacaagctaccgtgttattttcaagtggcatctaagcctacgcgtggtctgagggctgaggagaccaccgtgtcgggcacgcccttggatgtcagctggaccaaaaaccaaacggcgtggtagaagaatagctgcagccttttgtagggctccagggagaaccaaggaaagcatgaaaagaagaaagagagcaaagatttaaacttggttggtcactgtccgcaggcaggtggatgaaaccaccatggcagcgagaaaccccccagggctgccatgccaagccaagccactgccctcgtctccaagcgcccggttctgttcgtcggggaacgtgttagcgtctcgtcagcgcagagaggagaagagaagaatcgggatgcgtggagaagaagaatagtgtagcgacgaggggaaatgtgcgtaagtatctgttcttttgatgccttgcagcctctcgttcatctctcttatactcccgtgacaacggcccagtccaatccccttacacaaccactcgggcctattaactctaacgttagtgtgctctgccttctcctatttatgcccctggttctcttcttcgggtgccggcctgcttggctgcttcctgtgtagcatggctaactgaacggaacagacaaggaagacgatcgatgggatatgggcatgggccagctactgtactaactgcgaagagccgaagagcaagggaagggcccatcagtccaacgcaaatagaggcctcgtttgcgtctctaagaagtaacctgccaaactttggctaacctgacgc

SEQ ID NO: 202 - DNA, 1161 bp, Zea mays
  misc_feature (1)..(100): optimal_loci_11169_G1, chr1:60141749..60142909, Cluster 2
tcctataatgaccatattatgtaatgagcactactatctttctatgctgatcatattacgtaataatcactactatctttctatgggacgctataatttccatgcgcgctgtcgtgcgctattgactagtgtgatgatgagtcgagtgttgaaggacaacaattcaacaagcgaatggcggaccactggggcagagcaggcaggcaggcagccaacgcgcgctgtcttgtccggactgcgattgcgggcgccgccggtgaggaccatgcgcaggcacagccgcacaggcaggaccgcgaccgtcccgttgaacaacccaatcgctgccgcacgccaactcatgagcaggaggaggaggaggacgacgaatcatcatctgccgcagcatcactgcttgctgagtgctgctgagtgctgactcatactcactaaaacgcttcgacgcagtgatgaactgatgatccacggaaacgcttcgacttcgacgcagtgatgaactgatgatccacgggctccctggcagcgcacagtccgttatcgatactcactaaaaaatgaagaaaaatgggatggttaaccctgactcccagtcagtggtcaggttatcgatggcaggatcgatgcaacatgtgccagtccatctaataatatttgaaccacagactgccttcagcgtccgcaagcgcttgcttgtccgatccgaaggctggtggctggcgcaagctatagccaagccaagtcgcgttggagtttggaggccgtgttggccgaccgcccttgcagcacgtcgtttcagagacaacgcatccacggcgtgataattcacgggctccctggcggcacccgtgttccccgtccataaaaagaacacgctaaatgctacctctaccagaaaaaagctaaaatttaggatgtcgtacacacttcacaagcctagaattctttattattgatctcgacgacgtctagctttacaagtagtttacagaaacgatcacatgataatagcggctttgttaaattatcaattgtctcctcagtgcggacatgctcgatatatatacatcttttcatctctaatgtactcccgaataatctgaaatcatctcgatcgcatctatatgtttgctttgatcaacaatggagttgtgtgttgctcgc

SEQ ID NO: 203 - DNA, 1402 bp, Zea mays
  misc_feature (1)..(100): optimal_loci_112632_G1, chr3:128098856..128100257, Cluster 2
ggcaatggactccttgctcctagcgactgacgcccccatggctggggatggtgaaccttctgcggccgtggcagttgcgttggcgactccggcagaggaagggtctccccctgcttcgctggttggggaaggtgaaccttcctcggccgtggcagttgcattggcgactccggttgaggaagattctccccctgcttcgctggatggggaaggtgaatcttccgtggctgtggcagttgcgttggcgacttcggttgaggaaggttctccccctgcttcgccatagccccttgctgcggcggatctaaggtgccctgtctcggccgtggtcgcggcagctgcaatggcaactctagccagggctagaatcgagactttattaaatgctcattgtctgtatccgtcaactcctctaaatatcatcactcaaggtgcttaggaaaaaaattatcgagctcatcctcctctgtcagatcattttcctcctttcccagtacccgtgagagagcgtcctgattgacatgcacttccggtttcgaaatttttgaattagcccataactctaccaagttatgaacaacactatcatttgaaggaaaagagaaacctaaaggttgcagcctattcaagataaactcagcagagataccacccgcttgcctgtaccattcgctgcagacccatgccaatccccgccattcttcttcttgttgttactttgatcagattcattcgttgggtgatgaccagattttaaatcattttcctttgaattctgcccctcatcttcaccaaaaccgatgtcatctaagtccataggttctggttctcttcatccatattttcctctactctaaactgcaactcatacaagtaatccccaatcacaacatccacaaactgagggatcaaactagcatcaaggaccatcacctataacctgcatatgtcaaaatctattggtgaacttcatatccactgcttttgttacccccaacattgatccaactgtccagataatttaaaactcccttagctcctttgggataccagaaaattgaatccaaaactttaggcaaagcagatttaacttccattggcagtactgtttcctctattatcatgtaagctttaaatttaatcaaaacaactcctcactctatcatgtgatctatttctaccctagaaggaaattgaaccttgaacatatccttcttagtatgttccacctcccacttccatgagctagacactaatctctcaagctcagaaatcacttgaggcacagagagtgagccaccagtcacactgattatggccaatttagaatcagattttttttcttctgggtaggcccatgcgggatgtaatagaatcctaaaccatcaaacgcataaccaca

SEQ ID NO: 204 - DNA, 1139 bp, Zea mays
  misc_feature (1)..(100): optimal_loci_115740_G1, chr3:147587936..147589074, Cluster 2
ttggatcaaatgcggatggatattacctgtttcatatctttttatattttttcttcggattcggatcagataaatattatcaaattatgtcggataaggtttaaatgtatgtcgacatcttaaatatctaactttaagaatacatatacgaataaatgtcgaatatatattgaatattgagtccccaaactcgaatatggatcggaactcagccctagtagatagatcgaattggacaatgccgctagagccgttgcttgacttgtacaaggtacagcgcgatgaggtcaactgatcaccagatacacgttataaaagcaaagaaggaaaccgacgcataggtgcaaaactacagtccaaacaaccaaatttgcatggtatttgtactctctattaactgtcgatcgttgcatccaaaaggcaaggcaagatgcatcttctgggattcgctttaggtccgcccttgccttggccgacagcacacgcgcgctggcagtatgtgccaggcaatggcaagtagtacacgcgctggagtaccagcagctggtcaagtggatgtggcttattggctgtcatgctcataccggaccagattcactgcacttgattttgggatactgctgtaccggacaccatgctaatgacaggtgaagccgatggttttcgaggctgtgatgtgagtacaaccacctgacctggactagcagcagtacgtacgtggcgtgtgcccctgcctgtaaaatccccggccaagaacaagtgccgcgaagataattgctccggcggcgaaaaccctagccgccgtctcattctctccctcccctctctgtctcgccgtcgccagagctagccgcagaaaggctcgcgtggcccgcggtgatggtggaggtggcctgtggcgatggtgcacgcgcggctggctcgcggcggcaggggctcccgctcttacccccgctcctcccgcgcctgcgtgggggtgctcgcgtggccaacccacggcgacggcggcgacggcgaccgtgcctgttcgcatggccggcccgcagcagcgacaatgcgcgtggtggctggggcaaggctggctggaggcggctctgctgctgccttcggtgggtttgggtggcggggctggtattgga

SEQ ID NO: 205 - DNA, 1003 bp, Zea mays
  misc_feature (1)..(100): optimal_loci_118038_G1, chr3:160930082..160931084, Cluster 2
ctgagagggagacgacagtaccatcatgatgaaaacaaattaatatgggcttaaggctcatctgacctagtttaatatattcgtacccatctttagaggaattattggagagaaggttaaaatccactcctaataaatattataggatactgctaaaaacatatttttgggagtcatttttgggagctcttccttggagatgttctgtgtcggtctttatatgtgcatattattgtacaatcgtatacatgtatatttgttaatattaatattagattatatcatcttaatttattttcctggctctttgtccatattttttattctggtatttccgtctatccagacttcgctttccattcctttttttcgaatcctattccgttttattaaaaaataaaaatgagaaagggattttcccgcacgtcttcgtccctatggaagaacaagtcccgtcatgctagtttttttgttgaagcataaaacggtcccgtcgtcctacatgcatcgctaatcctgcaattaataacatagcgaggacgtaatggtcgatgttcgtcagcgtaatttaggattcatatgaaaaaaaacactaacacctttcggggggaaaagtcgcccctaactttttgaatgcaaaagtagcatcccgttttttttaaatcttagagaaaatggcgcactcgttgccattggcgcgctacttgtttgatgcgcaaggattggacaggtcttgcagtcttgcagattctgaaggaagccaggcaggcgttacccggcgctgacgcaaatgggcggaggagaaagaaaggcgacggagacggatgggtgggttcgtgctcgctcggtggccgcgtgggtggcgtcaacgtcggcatcatttgggccaccgcttcccttatcccgccgcgagtgcccctggctttgcgctgagctgacggctacccgccgatgaagacgtccccggcattgtaccgctcttggcctctttgctcaagcacac

SEQ ID NO: 206 - DNA, 1111 bp, Zea mays
  misc_feature (1)..(100): optimal_loci_119569_G1, chr3:170778022..170779132, Cluster 2
tcttttgagtctatgacgtggaatatagaaacgagcaataattatttttttaattgtgctaatcaggattcgaactcgagacttctgcctctggtataatattaagttgcatgtaccaatcaattcaactcaaaagcttaaaccgatagaaatatagaaatatagaaatatgggacaattcacttatattatattctaacatatggaaatattatactctgcgcaaaaaactcaaaataaattaccttatttttcaactcaataatccgtttgacacgtttatcgacttggcgtctctctgcagcgaccatcttctctctttgttctgcgtttgagtaaaaaaaatcctgcattgatttcactgcaaagtttacgtgtcagtaaaacgattgccttcaacactacataaaaacagaacataattataattgggagcataattataaaacgattgccttcaacccaatttattgattacattttttgctcacaacaggaaaaaaatttgggagaagttgaagacttgaagtaaaacaatagaggtttacataaccaatcataaaagggagcatggacacttgagtttaacagtccaatcgaacaaaaatatggctggcagcgatcaacgatcatgatacttaaggtaatgtttgcacgcttgcaaagtgactgaaactggactgcagtcagcagagcacaactcaactccaacatgggccttggccaccaggcctgtcatcaactggtccaaatcaaatgtgtgcaaatggcacgcactgaccgcagcaaggatttgtaattaagatcgtccaccgcacttgttcgctaaggcttgcgcctgcgcggtaacagcgtacaggtggaccgcagctagctgaatgcatcgacgtcagccggccggccggccatggatgatggatccatcatccaacctgaaaggctgaaaagcagcagacacgtggtcacagatggagagcgccgaaacctgtctgcgtgctaggagtcacgctcctgccctgtcccatgcatggtagctgcacactgattactagtactcgatcgctaatgggccactagctaataataagccattcgcgttattagattaagg

SEQ ID NO: 207 - DNA, 1016 bp, Zea mays
  misc_feature (1)..(100): optimal_loci_119929_G1, chr3:173013147..173014162, Cluster 2
atcatgcatttgttactataactcatcggaagaagagtgtgccaatatagtaccattagctaatgtatgtccttgcatgccaggagcggttacacatctacccatgctcgttatgttcgttgtcgatcaatatcgcatcaataagaacaatgtctctatggtatccacgcgtgggatgaaatatcgcgacgcagtgagagaattaaagaacggtgtggcagtccaggtccccgcaaccctaaagaaaagaaacaactaggttacatacttttttttagtatgtcgatcacttcgtgtgtgtgtgtatacactattagccttcacatagatcatgattgcctcctagatatatataattaacacttggatcctactgccactcttttaaaaaaaacgacctgtttgctatgttggggtttggtattttatttctctccactccttcgcctttcttcggttccaaattacggtgtacctgctcggttggtgtccttgatcttctccttttcttatcagacggagctggacgctacttagaaaactgtcatttgacaatgatattgcattttgggagataaaagagggtgccattattagattccccggatacgtcatcgccacacaaaatcataggatcaggacgctgtgatgaccgatgccagtttgtcacgcaccacgctagctgttgtccaaatcaaatcctcccgcatcaggtccaaggtaattattaggtaaaccagcgcaatcatttctttcaagttctttgtttcgcttcccccctcttcatggtcactgtcgcgaccagtgaaacgacctgacgtagagcctcatcagtatacgacatcgtggtcgtagtagtagcagagaattctatcacccgatcgagtgtcggcagatccgccaatttatgcagacgctctactttttgaagaagggggaaaaacccttcagatgtgaacttttctgatgttggactgaatagagacagcaacggttggttgatgctaataacaatt

SEQ ID NO: 208 - DNA, 1151 bp, Zea mays
  misc_feature (1)..(100): optimal_loci_121745_G1, chr3:183252017..183253167, Cluster 2
gacgtgaacatagccaaatggtataaaactaaatgtaaaataatagtatttttttaaacatatgtaactcaatcgctcagataatataaacttgaaattctacaactacgtatacgacagtacctgacagcgatgagaaagaaaatgcgttcattgaaacaggattagccggttcgatgtacagcccctcgctttcggcacgacaaatccccgactagtgcaaatactgagatgctcgccgtctactcgctccaaatctccaacaactacatacacaactgttatatatataaaaaaagatacacacaaaaatgtttttttacagacaagcttgtttcctggaggatgtttcagacgctggaaccggtttcctttttcttcttttgttttgcaattgctttcgattcgaagcatggggatccgtcacgatcgcgaccgggtacgcgactatgagaaaaatcgcttacctaaccacgtaactcgttcggttataagagatgaaattccaccataaatttaatttgggtctgtattgggtgaattcataccacacactcaatcccaatacttaatcccaatagtgagattaaatccatcatttaatacatccatttctcaaagctagcattcttttgatccatggattataatataaacatgtgtaatatttttatggatttattcaatgtctaatgagctatagatagaatccatgtcttctatagtttaaaaaagttccaaatctttaagttatgatctaggatgaatttaaccgaataaaaaatttgagtagacttgcattattttaggacattaattgtgacatgtatttaattacaatccatactaattcagagctagattggggtgtaaacgaacaatacctaataaagtggctaaggacactcagaaacccgtttccccctgtcttctttaggcgtcggtttaaataataggcacacgtggactgtcctctgtccaacaataacaaagcactcggcatcactgaacatgatcctcacaacacaaggcactaagttgacatgccccccgcacacacgtttccatattctaagcatggtggccacaaaaaggaaacacgaaaggcgagcccccggtctgtgattggaatttgggttgcatgttcagat

SEQ ID NO: 209 - DNA, 1035 bp, Zea mays
  misc_feature (1)..(100): optimal_loci_122254_G1, chr3:185763092..185764126, Cluster 2
cgacagacagaagccgggccgaaaagcactcgagattttcccccggagccggagatggggtgactcgtggcactggccggcgcggccaaggcaagcgtccgcgtgcgtgcggccaaggcgtcgccgtcgccgcacgcaagcgcccaggaaagcagcgagcgagtcacggcgtgcgcgtgcccggccggccacctccgatttggtgccgcgaatttccttttgccggtgtcagcgtcagcgccgctcggtcacctgcatgctgatggaagcaaggcaagcaccgcacagattttactcgatcactcccggtgcgcgtatagagagagtatcagcgggctcgtctgacgacttctgcagagagttaacgaggcatgaaacatgcacgcggctctgtttgggacaagaaggaagtggtgagtaatgcagcctactactgacttcaggaaggcggacaggtacccgtggggtgggtgggtgggggacacagcatcagctttctcgttctaactagaaaaaagaaaaggacgagtttcatgtgatatgatatgatatgatcacaggagctcgtcatcggcttctaccaggttcttgacaggttcctcaggtttccagctatttggcttacgtgaggactggctactgaggatggaccgcacagtgcatttctgcttctgcatatccatgcgcacggcccgtggctgcagtttaccacttgagggtgtccaagggccacttcatttgagccagcggcctttcaacgaactagaaccagcagcgccctatcgggcgccatacagaagcatcaggattcaggaatgtgcactgcccagaaacagaaacattgtcttcttcttgcctgagctgtgctagatcgacatttccatttcatgtgaatagagattatgactgattagaaacctaatgtgtaccaatcagaaaacaggaaggcattgactggcacttgtcaaccagaggtactctataaaataaatatctagcacaagaacagaaacactgcaaagaaaatatataagt

SEQ ID NO: 210 - DNA, 1019 bp, Zea mays
  misc_feature (1)..(100): optimal_loci_122285_G1, chr3:185936368..185937386, Cluster 2
gcatttattcgatcttgcttgcttcagaaaccaagcaatatatatgatacaagacagagaagttgtataaagtggacagatatatatcaatatatgccattatgctacctgatttcttgcataatctattctacctgatccatttgaatgtacaaattgagcctcctttttcttcttttcttttttgttttgaacaatcatgaattttacttcatatatacatctcaacaagggttgtgttttcgaagaacgtatgtgtgtatatacatgcatgacgtgagttcaaaatataagaggttttttctctgtttaattactatagcatgtggagtattacactgtggttggatatagatattgaagtctggaattaggaattgtaaccaaaattatgttgtttggttgtttaataaagtcagagttggaattaaaccttagttcctcagtattggactataagtagaagttgcttgccacaatttagagcctacatcctctgtactggttgaattacaattccagttacatccaaagaatagatttgtattgcaactcattttcaatactagtgagatttggtattacatctgatttaattctaacatctccaatatctacatcaaaacgaacccttaatcattttctacttaaaagaaatgcacaaccttttagatttatttcatatcctaatgccggcagctgcgctaacaaagatcgtcctgcatgctttgcaacaaatgtttgcttcaacttaagcagacatatctatacccaccaatgcaagctttggtttgtttaagcacaaagtgaattagtccccgtgctgcccattatcgttacatgtagacccctgcactcgagtatcagtagcgcacacaccagtgcaccctttaaggctttttaacgtcttcttagaaagacgatgcctagctagctagcgcctttttttatgatcactctcgtctcgtctgggtacgttcatcgcccgccccactaagcttttgcaagctcaggagtca

SEQ ID NO: 211 - DNA, 1087 bp, Zea mays
  misc_feature (1)..(100): optimal_loci_12248_G1, chr1:66582903..66583989, Cluster 2
attggagttgctctcattaagctgaccgagcacaacttgctagtaattaatagcgcaaaaagcagaatatataagataccacgtgattatttaggggactacaattgcacatatataaaccagctatcactacagaccatcagtaggccgtgtattgagatgtccggtttcggctggcctagtcgcattgacctgtactgtacttactatctgaaagtatatcaattatcatacactattatgttggtggcagtttcttgtttgtggacagacgttgacatgtccttttaatggaaggagcatgatgtctatagcgctacatcctgatccgtggcgcaatggtagcctttctaactccagatcataaggttgacgatctgaaactttctttatttcccctggttttcaatcaatgtgacgacgtactttggaattttgaatctctcttttccttctttttaaccaatatccaatgtatatctcctgacgttcgaactcgccatcggaacaggtcagagatgcatgcaggcggctctctccctcctctagtcccgggcaccatcccatgtggttttactctcgccctggtgcgcgtcaaccaccctcctctactctgtccgcatgtactgggcggcggcgaagctgcaattaacctgcggcgcgaggccatgtgtgctcgatcgccgtcggtctccctgcgctgcgcggccccgccacgcacatgcgcatccttgtcgccgctagctgcaagcgaagaagccaatgccctgtttgaagggccacagctcccgtcgccttcaattcctctgggctccattagttggtgcaaggaatgcatatgcctcacgggggtcagggcagggcagctagcgcgtgcggatcgtatcgtatcgtatcgggggcgccggcccgtcacttgttgtcaggtcagcccccggtggcagactagcgaagccatcactgtctgacgtccgttccgtccaaggtcttctcttcagctattgtctctgactcccattcactgaaagtgcactcatctgtcttctcttttcttttcttttttcatcgtgcaatcgcaagtaccctt

SEQ ID NO: 212 - DNA, 1126 bp, Zea mays
  misc_feature (1)..(100): optimal_loci_124235_G1, chr3:196203076..196204201, Cluster 2
gtactgctctttttttttccgttcatggtgcttatttgatcctctgtcactcttatgggcacgcagtctctcccaacctctctatccacatccaggttccaggaagggtcatggtctcaggaaaaaaaaaagagagagttgtaatctaaatacggatacatatatgcatacgtacagccattgtgtcggcagatgctgcgagggttatccgcacgaatttccctagttcatgctacctcctgcaggccttcagcctacaggctacagaaaagagctcgagaattggcctatccttcgctacacgattatctgtactgtgcagagtgtgctttgtcctgattcgatgtcactgtgcttaatttagcaatgctggtgttagcctaataaggttagattacacgctagtggcagtattaatcacgcgaagcatgaagctaagtgtgagccgtatcttgcttttatccctgaaatcttcgatggccgaatctattcctgctaatccagagcgctcagtgccgtcgactggtccaggttgcagcgccggagcacaaacagctttcttttacgttcggcgaggttccatgcgagctcccccgattccccccctaataaaaacctgcccactactgaacaaaaagaaaacgctcgccatgcttatcttgctcgatcaggggtcacgaacagatgcctcgtttctctgcagatcatgcatgcatcatatggaactcgagctgaattgctgctctactcacggtcacgaacggatgcttgagcgttccggcggccggtcccatccaactaccctaccccctcggcggcatgcagtcgcacggggctagtagtccgccggccggccggaatcccgttcccgtcgctttttctccggcgatctaaccgaatttttctcggcccggtacggagacgtcaccgccgactttccaagtcaccggccgcaactttcgtgttggaggaggcagcttttgcgtcggacggccactcccgcctgcctgcctgcttttcctccgatccagcagagatgcaaagactttgaagtaaagaagtgcgcagagaaccgggcgggtctggagtcctttgggcgacggcgacgcgagcaggcgcaacgctt

SEQ ID NO: 213 - DNA, 1163 bp, Zea mays
  misc_feature (1)..(100): optimal_loci_124583_G1, chr3:198378272..198379434, Cluster 2
caagaattgaattagaatagtcacatttcgttttttttttggatgtagtgtaggactgtaggtggagcagctgatgaattgtacagaaggacccgtcgtcgatggagatttctagggaaaacacacgacgatcaatcaacagcagccgcaaaccaccacgacgagcggaacccaggggtggaggtggagccgctagtgccggcgtgccgccaccgtctagcagctaactagggttaggttgcagatgcttgggtcgtggacggtagaaaatttagaggtagagaatgagaatgactgccgttttgttttactgagtgaggaacaagacaagttgggtataaataaatttagcgcgcgaaaacacagcggcggcatggctggcgtgcgcaagggaacacagtgaggggtggcgaaacagaggctggcgcacacaggacttgcggacacgaactatccgatttcacatccgtattagaccaacgtaaattcggatatcagaatccacattcgttttcgctaaacggattcggatactttgactttgacttttatatgaaaaatgaattcagatacggatatttttcatgtgcatcttttactgggtacggatatcgtataatatgaataaccatttccatttttcatccctggttggtactgtgtttttttatctctagatttttactatatggtacaactactattcagcttcagtagtccttttgcccgtcacagcgtggcgcccgcaagccgcaggggaattaatggatggcaaagcagaggctagcgagctactcaaaaagcatttgacggaaattgttacaatggaccgatctcagcttcccagcgaatctaaagtatgatggtcatttacatacatggtaggcaaggtgtaggcttaggtagaattgataaaccgagatgaaggattttcgataggctagttgtctattttttggtagaatatttggaaaaaagaaatagaattttttttaaaaaaaatccatgaaagatcatctcgccgttgcttatctcatcagagagaatgtcatgcaatgcatggcggctcactctacctttatttagaggatctctttgtcgcaggatggttcactctagctttgtttaaagagtctcttattgttgtgtgtgttttttttaaa

SEQ ID NO: 214 - DNA, 1038 bp, Zea mays
  misc_feature (1)..(100): optimal_loci_125639_G1, chr3:203889903..203890940, Cluster 2
aggagaggggttgacggcggtgtggatatgaggacgaaagggccgaaggatgatctaaataatattgtccattaaatttgagtgtacaaaaagatgatttttttcaatgatctgaaccgttgatttttatgttgtgttaaatatgaatgcaatttgtttgatagatttagtaagattatgagtacatggattatttggttggatgagttttataaaatataaactagtgtattatattgtgatatatatattaaatattaggcccctattacttttgtatcccgggcctctgttgcatggggtcagtgccggccttgcctttcctgcacgcagcagtgctgcacgcgccatatcgtcactactcactactctctcgagaggcaaagcagagcccgtgcggaaagcgagcgcctgaaccttgagcgaatgtcgtcttttccaaaagtaggttcctttcgtcggccattgatcgggatacccatccttttcttttgtgttttctacttttatctgattctaaacttgatgcgtggcatatgcgagagataggagaagctaacagttcttagggcatgtttaagatcaataagaatgaagggaaatagaggggctaaaatcatctagccattctattctttttctcccagacaaatcttgattgcataggtattggaggggattaaggcagataaaattcctcaagtttctctgatccttacggcgatgcgggactgacccgtgaagccagcagaactgtcaccgtccacaaaattgatttggtagtgtttggttgggatagagccgcttcgctctaattttttgttttaaatggattttatgtaggatagagtgattttaaaaaaactaaattatgcccaaatgttaaactatatgtctttctaaaaattttcggatagagctgttctctaaaatggagttgttctttcccaacggactccgaaactaaacactaccctagtggacaactgcgaatctgcaaatatttgagtgtgacatgtagatcatgctcaacagatc

SEQ ID NO: 215 - DNA, 1010 bp, Zea mays
  misc_feature (1)..(100): optimal_loci_126290_G1, chr3:206841194..206842203, Cluster 2
gcatcgatatcaacatcgagaaacccatgcgctcaaggttcatgagtgtctccttgttcatgaatctcccaactgatgtgcaacacaaaccagtgcaagtattccatgccctcaaggttcatgagcatctcctagccaccaagaacaatccattcagatgatacgactactatgcagaagtacctcacaatggaagagatttcatctctgatggtgaggtcaatatccatggcggtggcgccgttcgacctgatgtagcggctcaacaggctgcatgtcatggtgaagctagtcactttctccccaaatttcttagatgccatcttcaccgtaggcctcgaatctccactagaaatagaagcgaaagctttcgaacaaaaacaaaacctgcttcattttttggaggggcggtgagcgcgagaggaactcttcgatagggtgagggagcaagggggaaaagattatataaccccctaaactatatagtggtagatacatcgaacctcgacctataaaactatattgtacaccctaaactttgtgaaaacagataaataagcctctctagtggttttggtgtcccgttttacatgtgtggtggtctaagctggctctccttgacaccgtggcacttggtctttgcatgttagcggcacaacaccgtgaagaacatcgagcgcagtcacaagaacccacactaggtgtcctcgacatggcggcgctcgtcgaggcacaggggtcatcgagacgtggtggcctcgacgcggtaggaagaagacaccatggtagtattgtggctgtgtagcggtggtagtggaagcaaaaggatagcggcccttgctgatcgcgcatgatggagcagcggcaacgaggagctatatggggttgctggcgatcgttgtgatgtcaacgagcattatccccatctcctacccactccaacgctgctagaagtggacctcaaggtgaaaatcctctacaaagatgacgaagcagtagacaaagtagtt

SEQ ID NO: 216 - DNA, 1393 bp, Zea mays
  misc_feature (1)..(100): optimal_loci_126854_G1, chr3:209625156..209626548, Cluster 2
accaaaacagttgttgccactccccggctgatctgatcctgaagaataatagccactaaaaactagaagttattctctaagtctaaggttacatgattctctttagagtgatgtatgctactcagaatcatgaactcatttgtcttaagccggcatttgcattagcttattataattatgacatcgaataattattatcagcagagcagacataagtatacctacatagtaagcttggtccaacccaactaacttgtaaattacaagttacaagttatctgtgaccaagcttactatgtaatttacaagttagttgggtttgcaatgtaatacatccaaccatacggccatacgggcacataagtagataacatattgctatatttaacaccaaactgaacaacacttgagggatgccatagggcttacctcatattgacatctatccgtaaaaactccccatctgaactcctatcatcgatcacagatgtggtagtattgactgctaagtagctgctatactcctgcaatatcaaatcatcattgtgttagttcaaaactcaaagtccaccattgaaaaagataaagctcgcagaacttgaatgaaaaatcaagtcaacttcaaactgctagcatgtaaagcacattgcaatatttaaaaaatgtcaacccacgatgtattggattcagagcaacaaatatttaggatacaaaatgtaactgaaatgtttagtgtgtctaggtggaatattttggatacataatgttagatgtaactaaggctacaaaagtcaactatgctacagaaaaccaaatgataatgcacttatatctgcaattctacataagcaaaaggagtcaatcatttcccaattcatttccatacacttgtttaaaaccaccaattggagcatgaaagaatacctatcatgctggcttttaattttttggtgctatatatttttgacagaaaaagaagtgccagcaacaactgcaactgattacagacgaaactgaggggggggggacaaaaaacagaatttatggccacattgaagtaataaaaaatcactactgaatttttaattactgccatcaaacatctgatcatcaggcccatcacagcttggagagtgatcgcctctaccatatgtgcatccatctctctcagctttatcatgttctttgttactgccacggtcaaatttcagacgactgtccatgctaggtctccgtcttcctgttgaagcacctcctccatataatgttttttctcttgcagatgataaaattgtttctcatagctgtttgcttgcagttgatgggtgcactgattttggcgtgtgattattaaccaaaacagtgtcattaggctgattattctgcatttgtt

SEQ ID NO: 217 - DNA, 1137 bp, Zea mays
  misc_feature (1)..(100): optimal_loci_127340_G1, chr3:212029200..212030336, Cluster 2
acgacgagaccggatgggacgtgtgagtgctctgctgcccgaccccgtcaaagcacaaagatccccacgccacaccacaccacagcacagcaccacggtcggctgacccacaccagaggacggacgggcagggggggcagcaggacgcacacgcaacactccactccgacgtcccgtcgccaccctactaccatcacccaccgccagcacccgtggtagtagacaagacaactcgtggctgggcaggggcccgcgccgcgcgcggtagccggcagccacgcggccatggcccatgcggccgagcgcggggattccctcggcgccgggaaagcggagccgcgcgccgtgccgcagctgcagggatggggtcagccgatacgacttgcctctgcagtcacgcgatccgtgcctgcagtccgtccatcacagatcgaacagctactagcttctatgtgctttgtccttccacagctagctcccggcctattaactcccggcccaatatgtcattagccacggctggcgctgaagctaggtatttttggcgccggttctgtttttttatttttggcgcgatggtgacttgtgccacagctttggcgttctcttatttttcttcccatgagaaatcgaattaacttggaatcgatcaaagggatcatcaacttcagcttgttgcataaaaaaggaaatccgcgcatctgaaatggaaggaaatcagcgcatctaaaactgcaaagcctagaagaacttggttggacaaaaaaaaacatagaagtgcaaagaaggacatccagcttacagagaaatagagagcctgacacttgttaacggttggatccacaacaaacggctcggatgaagcgactgcagaggcaagtcgtattggctgactgcagacgatcttgttccacgccggctgggcagcgcagcgttgcctcccatcagcatcaggtcggggcgtcgggccgcccgtacccacgtacgcggtgctccaggctccagcggtggcgcccggcccacgcgtgccatgtagacgtacgcgtctgctccccgtccgagtccgacgttgcagtacactgtgcaccgaccaaacaggtgctactgaactgtccttgtaggagtgggcatacagga

SEQ ID NO: 218 - DNA, 1059 bp, Zea mays
  misc_feature (1)..(100): optimal_loci_129063_G1, chr3:220648253..220649311, Cluster 2
gtaatctacaacataactctgtaccatacaaatgataatagtctttatattcaacttacagttgtaaaaaaggaaaataaaaaatgctaatcgcatacgtatacatgcatcctgtatagaaaaagagaagaatgccaatatggcctacactctgcaggatataaagtttagcgcacataatgactgagcaatttctgtaaaattagttaaccttatttttaattacatagatatgtagcttgtagctagaaaaatgataactattaactaatactaaaacattaagaatatctaaatgggtcctgcctgagctatcatgagctcatcatgatcggacggtagtagcggcactgttgcggctggtcgtctttcttgacgatgagtaaatgcaggagatagtcgccaaagatatccttgccgaagagacggaagcggggctgaacgaacgcccagacttgtcgttcgccttcaacccgcactcacagatgaaatcgatgtacccttgcccctttacgattgtgccgttgctgctctcccacccgcgacagtagcaggtccttgttgccggcgtcgaggttcaccagcttcacacccagcccgctgtgcactttcccccgggccttggatttcttgatcttcttgctcccggcggcgctggaggaggcgtcgttttgcggttccaccgcctcgggctgcggctgatcgcctgaccttcgtttcggtttcgtggctgggaggaggaacggggggtttgcgcgaggagtggcgggcacggggctgcggtacaggcatcgcatggctgggcaggggcgggggctgcaggacgcggcgaggggggggggggggggtgttacgtgaggaggagtgatagcgtcacgaggatgatgaggtggacacaaggagagggaggtgtgggggcggtggcgggggcgatgatatgggcaggatctacgtcgtggcctcgcgggggcggggtggggcgcgagatgggagaggggcagggaccgggataggagaggggcaatacgaggagacggaggacggggaagagacagcgcc

SEQ ID NO: 219 - DNA, 1335 bp, Zea mays
  misc_feature (1)..(100): optimal_loci_129243_G1, chr3:221561982..221563316, Cluster 2
agaggagagagaccgagacgagacagccgtagaggactagaggtagcctggctggactagaggctaatgaatgcttactagattagagaggactagtactaataaaagtgtaatgagtcgatctgggtactcactggcagctgtgagtacgtgagacaaatccagaggtttttttttttaatttttgaacgggagaaaatctgctgcttcttctgtacggagtggcagctggtacgggcttcctcggcctcgcttagcagcttccgtactcgtgggtggaagccgaagccgaggaggccacaggaggccagggcggtcgaccggtcactggtgcacggtgatccgggcggccggcggcgtagagccattggctggctcctagccgtaacctagctgcgcgcgcatgcagcgggtttaaatgcgtgggatttgaccgcaccgccatgattgatttttatccttgacttgactgggctctcagctgccagtgaagtgagagcaatgcacagcaggcgcagtggcagggcagtccactcactcacgctcgccttttcggtccctgcagctcagcctgcttgctgtgctgtgctgcctttcagcatgcatgggccttctccctcctgcaatggcaatgctcatcaaaggcagccgccgggaattccccgacggaccggccccggcctgattcattagatcaggaagaaagaaaaaaaaaccgaaatccgacatgcttgaccccagcaatgttcctgtcacgaccttcaaaggttgcgattttcttcgagattttggcgaactattcctatcacaacctgcaggatacgaagagctagtacgagtcttcaaacgctgttcaggtggccacagtgcaggacagcaggaggagcaaatgcaccgccagggctgcgactgcgactgcgaccgcgaccagcgccagcagtgattcccgtctccccctctgctcgaggcccaggggcaacaagttccaacgcgcaagtaaacattcctgtctctgatccctccacacatgattcatcaaattacccgattctctagggctattcccatcggatatttcatttttaattttatcataattaaatatcctgtcatatataagcgggcaagatgacaattattagtattaagtattatctaattataaaactaattacaaggataaagactaaaagaggaaagaaattattaaacctattcgagcctatatttaatactcataattgatattcaaacattttatacgacaagagctaaactttagccgggaaaacaaaaagcttcaaaatttaaatataatatttatcttaaaaagaa

SEQ ID NO: 220 - DNA, 1009 bp, Zea mays
  misc_feature (1)..(100): optimal_loci_129396_G1, chr3:222578357..222579365, Cluster 2
cattggatgcatgtgccttgagttggatgaatccatttaggtaatcagatatatagtgggttgttatcttgctgtatagagtttatgatatccttgtttgttttggttttgagatgatgccttttgaaatgtaatgagtagttaatccttgatttgatcccatgatcatattgaaagtggtttcaaggaattataccaatcatgtgtgatgccttcgacgaccgcgatgaatgatttcatcaatgctatggtatctcctactaaaacaatcattgtttcatagctcgctatgggagcattgaacatacccgtgtttggctaaaaatctctttctattgaatgctcccaaacaaaccatcataggttttgggcttgctggtgtcctggcatgattttcatcgggtgggatttgggccatggaggttttggctcgcggagcttgggccacgatggagtggaggtggctgcaagtgctaatattgttctcgatcgcagagaagaacagaaacacgggcacgcatggttttggtttgttggagtggaggtggctggaagtgccaatattgttctcgatcctagagaagaacagaaacacgggcacacatggtttggtcgtacgccatggccacggtgggaacatacatcgggccccactcacatgcagcaggctaataatgatattattattactatgtatatgaccttgccacagaagtaaaaataattagtataaaacgtaaataaaatgtaaaatccatgtaacataatatcaccataacactaatattatattaacgatataaatatataatcttattataaatacacgataagacaggaaggagacgaaaaagcaggctgttttgaaccaactgtcaattggagaataaaaaaatagatgatgagtttggtttgaaaaataagcaacatatgtaggaaggcaaccttggttcaattaagtaacaatctctgtgttggctggcagcaagtacaagcatacgagccggtg

SEQ ID NO: 221 - DNA, 1335 bp, Zea mays
  misc_feature (1)..(100): optimal_loci_13456_G1, chr1:73970226..73971560, Cluster 2
tggaaacaaacatctcgtggagaaacagctgaaccactcgtaacattccacctgcaacgagaccaggatttgtagcatagaatggttatatggtgtggggttttgcaggaacacttgtggggctcctgtcagtcctcaccaggtaataatttctcatgaatgaacttcttgactgagtttttttagttttcttccctttcttgaccacactgttgttcatcataacaaaacaaaccagtcacggccagttcctctgaatcatcatgatgtggacatatgtcgacaacactgcttatgacttgtagatttcatggtcttgggcaggactaattggcttggatcaggtaacacgtccacacaggtctagatgcgatgcccaattgtgtctcctacatgacaatcgaatattccaaatccagtctggttaggtgctgcctccaggttgtgttgtgtacatactacattctgggcgaattggggctttgagcatccataggtcactatcaccagacatctcgaaaggaaaccaaatgtgaatttcaatccctagatttctgctgttcaacgtggtgggactggaaacgaagatgcaaccgaattccatcgaaagactcttgtgggaaaacagaaaaaaccatgtacacgcgcacccgcgtggattctgtatggggcgagggaggatttctgggagcaagagagtagcaggcagagcagaggcttaggagagttatggagataaccgtagtttgctgctgcggaccttgaagcgcaccgcagcagcaagccgtcgttgctgctcaccgccgagcgccgacaggcgcgctgcagctgctcctgtcccaggccactcaagcgagtgctcggttagtcggttgtgagttgtcgtccagacggcgacgacgggccggacagcggcggcttcgtcgttcctgttttgctcaaaagtgcatatggccgtacgaggcccgcgacttcgctatttaagccctattcgagtcctttacgagcataggccttgtccagtaagggtgtcgtatcgggctcgttctgagcttttggcctttcagactagcacgagcggatccatttctaaacgggttaagactcgatctatttaataagacaaatattataaaaaatctctattttttatttaaaatctatcatttatttgtgaaatgtgtattatttgtaatatatgttattgaatttagttatatccttcaattatgatttaaaaatatattcatttttttatggtggtctaattttaaacttgatttatacgttggcaggcttgggcatacacggtgaacatttttaggccagtattaa

SEQ ID NO: 222 - DNA, 1297 bp, Zea mays
  misc_feature (1)..(100): optimal_loci_137801_G1, chr4:31570935..31572231, Cluster 2
atccaaataagctagaccgttgaatttgagtaagagaaataagaggtttagactaatctcgtctcttggtttcaaagatgggatggttctaggtgcatttgtttgggtggctattacaaagttcaaagtgatgctttatataggggtatagatatacattatgtgacaaactcagttgctaaacatctttaacatgtgccttgcatcattgacacgtaacatgagtatcattacattgcatttgaattgttgaattatgtttaaatggtaccttatgaagcaactcaaacttttataatgaagttgtgctatgtttataacattaaaatacgacatgagaaaacatggttttacagtatttttttacaattttttgggaattattttgtcagcttacaatttgtgggaagattcaaaattgggatgaccattcttgatcaaaatggaatcttgttgattttatcttcccaacgattattttaagaaagttttagagcaacatgtctcaactttttggatttttaaaagtttgcctcttctgatcgatgctatggacccgcttgtccgccacggggcactcctccttgttcctctcctcggccattgtcactatgggcctgcacgtcagcctctgcaccatttcttgttctcttcctcgcccactattactatagtcttgttgcacttcaatctcggtgctcctctttcattcctctcctctctactttgcttggatagtagtcttggcggcgctcaccatcgatgtggacaccgtggtgccagacatagtaaaatctgcttgtgcacctgcctcttctcctctgtaaagcacatcgtcagcctctcatcccctaaccccaactctatctgtcattctcccattacctttgtcgaagctttgagccactagccacaattcctcctccccatcggtcctttctctagtctgccactgcccgagcttcccctcaacttccttagttttttcctcctcttttccatccttcccttattggatcgagctattgtcgttcttccttctcgctgacgtatctctctccatcatctgccatctttcggtccttctccgcccaattatttgctttgatgaacttcccatggcgccactcgtgtctcttctctaccctctttgtacctccctctcattagtcgtatctcctcgccaccgcagacactgtcacacacatgttggtgtgcgctctcgtgtgctcgcggatgctttgatcgggtgggtctttaacctaggtcgactgacagcatggcctaaagcccacgt

SEQ ID NO: 223 - DNA, 1070 bp, Zea mays
  misc_feature (1)..(100): optimal_loci_144083_G1, chr4:70846267..70847336, Cluster 2
taaccctaaaagggtttgtttggtctatccactctgatgttgcggacatgttatggaggtctctggtttcctgctgtatatggttgtgttgcgtttcgtcctgaaatgctggtaatcaccagtgcacaatgtttccacccatttcgtctgccccgtatggaatgacgtcttgttattttgtcagtaaaatctcgcgcataaatagggagttgatgtccttaatggtgcacttcacatgtttcttgaagtgctggcacatgatgatatgctgaacgcaaaggagctggtccaatgggagagtggcttgtcattcaatgacatagcggctaggcaggggattcgcatccgcaggcattgccacccaccgcctccttggaggagatagagaaggagccaggagcccccttaacattctagagatcatttgggataaggatattgaagtagccgaggtatgcatttgcaactccgtgcacgtgttggactttcgtggttcagtttggtagcaaagttcaatggccaaaggtagagagtgatgttgcgcaaatacagataataaagcagtgtgagcattatgtcttatagacaccggttgttcacaaggctacaagaactagatggtgtgcatgtagagccttagcccttaggttagtacagtagtattggcataagtaatctgcaaattacagcttacggtagtatttggcacaaattctcttgcccatgtagagaagttagatgatattttctctataagacagatacacaactctcctgtgtattcggtaaaaaaggtttaaaaactatgattccattttgggccagagttacaatgcaacgaaaatcttttttcagaaatgataaaagccaatgttagatgctaacaacgaagaaaatcaattattcaactccaaatgtgtagacaaaaacgctaggtaagctgtaagaaggcagggacatatgccgatgcactccatatatccaggcgggagttgctcattgtttacaatggcggagacaaaggggatgaatttgactagattttgaaaaaaaatctttactgctggccc

SEQ ID NO: 224 - DNA, 1241 bp, Zea mays
  misc_feature (1)..(100): optimal_loci_154391_G1, chr4:143080657..143081897, Cluster 2
gggccggggcacgcaacgcaagcggaaacgggcagatgagatctgtcaaagaaggagacgtggcgcggcttggttccttggacggcgccctcgtccggcacgccgttcgctttggcgctattataagcagttggcccgtcctgataggccactggccttatttgtccaggggcacgttctgtgcacctgtgccatggcgtccgcgatcggcttcccctcacttccagagtccagactcgctcaatggatccgatggaacaaagtagtttattgataagaatttttcagagtgtccgatatactaaaatcaacgacgaagagccagatttcggtactaaccgcacgtcaagaagtgggaatgataaatattttaaaaacaaaatttgaatgttacgatattaactattttagaccgaagtactgctatataggagtatatttttttaatgtctaggaatctttgaatctcagatgcgcgcgctcgtcggatgatgattttgtttcggggaaaggggaaaaaaacttaatcttcgccatattatagaccggacctgttgggcgggaatcacgcaacaggcttcgatgatcgatcggtgcagtcctggtgagtgctaccacgcttcagctgaacccacgtgatgagcagagactaccatgggtccggtccggccagccaataatttccgtaaacaaaaggtgagtttggttgcccatccctttctgccgcaaaacccaataattcccacagatcggctgtcacgacgttcgctggcggcacgcactcgtcgtcgctagccagggtgaggccgtcagggtgctgagagacgccgtaccattattacccaaccgggtgcagcggcatcgtatctatcggttgtgtttgtttgtgtgcgcgtgtcaagggtggtggtggtggtgatcaagacgatccaataattaatagccccgtcggagaggtagtgcgtgatgttgagtgagacggagaccattaatacccgcgtactcatccattgggtcgattgggagtttcgttctcagctggacgctatcgtggtgttgagtgagacggagaccattaataaagcaattgtaaccgcccgctgcgacgatagggaaggttgtcgctctacgaacacgtagttctccctgcgagctgcttcgggttacgtgcgcggacgacgggagggaggcccacgggacacgacacgttgcgtgcgcatgagtcgcaacgtgcaggcccg

SEQ ID NO: 225 - DNA, 1156 bp, Zea mays
  misc_feature (1)..(100): optimal_loci_156884_G1, chr4:156478057..156479212, Cluster 2
aagggatatagatatgaagatgtcaaaattaaattagatttaatatcaaatctgcctagtattagaaatgtgttgcaatacaaatgtaactggaattgcaattccagccaatacagagagtctaggctctgaattatgagaggcagttggtagttatagtccaatactaaagaatctctactataaagcatgaacttctactatcgttgtgcttcaacacttttaagaaaaacattatatttcattgtaatcaacctgtggtccaaacctccccatcctagctctctcctctctcccatagcgacaacgcgaccgttatggacatcactgccaacctcgtctgcctccgcgagcgctaccccttcctggccgccaggccgcctgtctgccccgagaaatccccgatctagtggcgcgccccgacgacctagcgctcaccatgtttgtgctatcctggctcgatgggaacccgcccttcctacatgcttatggccctactgtcagcgttgttcccatccctccacgtgcacgcacgccatgtgcgagcactatggctcatcacctgagcgttcatgaggccacactggacgaagaggtagccgagtacaagtctacctacgccatgaagctaatcaagatatggatgatgagatggagaggattcgtggcatagggacaaggaagcgagagaacggaaggagaggaggatagacatcggctcagagagagaagtggaacgggagcggaggaactagagttgctcggaaaaatgccgtatcaagaaagaggagatggtgaggaagctagagaacgagtgcagcaagcggcaccactatcatgaccatgacatcatgtacgaattcgtgaactattgtgtacgcaagtaaaattgagtaagtacagagaaggtatgaagaatatagttgttcgtacaaatagattgagtcactcataaaatgattatgtcatctcacaacacattggcttgtactagttaagctttcattttaactctaaatttattagacaaccaaactacagaattcagaaattctatttacaatttccaataccatactttaatatacacctgcaaacgaggtgtaaagctacaccaaagtccaaatttggtctaagttacttgtgattatagctt

SEQ ID NO: 226 - DNA, 1320 bp, Zea mays
  misc_feature (1)..(100): optimal_loci_157544_G1, chr4:159912743..159914062, Cluster 2
cgcaaaaaatatttgagcagtgccatcccttttgcaactgcaacgttgctcggtcaaaaaagggcaggaagtaagaaacaacaaacaatgatatggttcaaccgtgcagagcagatacaatggttaggatttaataggcgtcccatgacgtgtaaaacccaattaagaatatttgcagaccatgggtcggaccaccatcctatgctaggttccgccgaaaatggaccataaacctgcactccttttgaaacactcgcgcactgtcattcgcagctgtccggctggtggttttacattgttttagcaaagacctagtacaggagatgcatgcctgcctgcctgcctgaacatgcggagttattgagtggatcgatcgttattgagatggtggccacccacgacgccacaaagcatacgaacggagcggcatggaatggaccatggaatgggatggatatgctctcgcgctccgagtgtgcccatgtcgatgccaccaactgaacgcggaaagagcaagcgcgcgacgatgcccatgagcaacccaacaagagctgtcaccctcatctaagggcgcaagcgcaaccagccctgcccatctgctatcatgtgcattagctagaggctcggtggtgtcgttgctggtcgtttgattcctgtctgttcttcttccctcttccttttaataataccccatcttcctaatttctaattcgtttgattttttttatgctaagtttacccggctcatcttattcaaaaaataagaaattcaaaactatagttagagtatactatatagtagacgatatcatcgtaaaaactaacaatgattatgaaacaaattaataaaatgagtaggtcaaattttggataaaaaatcaaacaaattataaattgaaacaaaatcaaacaaattataaattaaaacagagtgaatacttcatatataccgtgtcgattgactttttcttcgtagtgtcctctccacgaatctgagcgagtttggcgctttgatcaggtgagtgcttaacttgttagatctatgacgtgatttttctgaaaaagaaaaaaaacatgtgacgtgatggctggtgctagatacttctacgtgtagagaaacgggtacagatgagcagtacgtacagtgtaaaatccactggaagaacgtgtggagagtttgtgattcgacaggaacctttatttgttatgtataaaaaataatttatcatgtgtgtttatggccggccactaactgatatttttatcaggaagtcaggataagtctactatcgtacctttttcagggcagagagagatatg

SEQ ID NO: 227 - DNA, 1186 bp, Zea mays
  misc_feature (1)..(100): optimal_loci_159527_G1, chr4:172520053..172521238, Cluster 2
ggtcatagatatatgacgcatacacaccatcgatgtatgtagtggtggtgacctagctcgccgccggtccgcgagtaaataaagccagcaggtaacctccctgccccctgtccattgtacacaacacaacaagacatggatagccgttgtagttgtcatcttacaagtagtcattagctactattcctaggttgtatagatgtatgtagcattatagctatatctatgttcatacctacatgctatattgctattaaaagaagaaaaaagtgttcaataaagtaatttgcacatcttgcctcaatacccatcggacgtgtaaagtgcattaggcatctgacacagttaaccactagtttatagtcgttagagttatagccattggaaaggcatcgaatgtgtctcgtgcaggaaactacggtgcaacagacatatctagtgcctttgatttctgtgtttcaagaggtaaaggtcagatctcttgatcggtcttggctggtaaatctcgactctatatatttatcaacacctcttaagggtacaaaaacatatccattcacgtgtagctcattttttgtgagatattggaacattcttggtgcattgcttgtagtcattgttaattgaggggtcaaaatgactattaccccctactttttcgtctgtcggtccatcccactgcacttcactctccccactccatttctgatccaaatcaaccagtgggccatattttcaacctagttagcacaattcaaattcaacatgagaccacatcaatctcgattcacagtatggagatcgattataatatggaatagatgacgcaatcattacataaatctttatactgcatgtttgttagtataagggtctgtttggatcgcatgtgctagactttaacaggggtgctaaagtttagctctcttaaatagagagctaaagtttagcacatggatattgtatggatgaaagtgctaaagtttagcacatgggtatagaaagatattcatacctctaattaatgtgaggtgggggagaaagagagtggggtaagaggggtaatagatgtcttttctccatcttagatcacttttagttgactttagcatatctggacgagctaaactgttaatgggtattattaaggtttagcgcttcacttttagcacattttagtactcct

SEQ ID NO: 228 - DNA, 1293 bp, Zea mays
  misc_feature (1)..(100): optimal_loci_160593_G1, chr4:178593437..178594729, Cluster 2
gagttgcaacgtctgcccacggcctacttttatacatctctggggataggcgctcgataacaataggcgatgtggcactaaatggcaaacagacacactaccgcttctatccgcctggctcgaccagcgaggctgcagcgccaagtagagctaccgaagtgccgatttgggcttttcctcttttattttacgcactgctaaactgggcctattagccgaagccaagattattttttttgcatgggctttaatggtctggataacaaggctgactcgaacccgtgcttttgcctgtgattctttgcagttactccggcctccgtgtatcagtgaccagcaaccttcccctatggtttgaagcagcgaaagatatagagaatgctgatgaagagaagctggaagaaattcaagaatggtagattcctctcggtacaatttgcgataaaaacaagcctacacctaggtttgttaataacgtgatttcttactgtcacagggaggtcggcaatgctagttgaggatatgtttggtttgagatcaaagtgtgataataaagtgggtgcgacaccgttccctcgatttttaggttcataccaccacagagacatactatggtgtttacctcgcttttacgtgactttcatccaaacgctatataaattatagtcaccctcttctatccatccatgtatatccaaccagacaccacgactaactatgcttggcttcattgtgcaagaatccgtaactcgtgccgggcccccatcgacaatcttttgacgcacctttcggacccgttcgacaaaaatgccattcacacactctcctcctcctaagtaatcgtcccaaaacctttgtttgtataatgctacggcacataatggtgacaataatgttttttctgacagtaaatggaatttgttaggtctgctcgttgcaaagttttctatcatgaaaaatgaataaacaccccgatagctctgacgacgtgtactgatatatagatcatggtagggggacggaagataaaggaaatacattttatcattctttgcgattgatcatgataatcctcagtatatccgctcacttttcattttcttggtcgattctttcctagttcaatcatgctataatcgcataaatagacgctacaagagatacaattaattcgtatggtggtattgtgactccatcggtcttaaagtgcctcaaacatttgtgtagagatgtcatttcatgttttgtcaaagagtatatttatcgtccgactattgatgatcttaaacgact

SEQ ID NO: 229 - DNA, 1235 bp, Zea mays
  misc_feature (1)..(100): optimal_loci_161183_G1, chr4:182741929..182743163, Cluster 2
attcatagctatacatattctagatcactattatatttgatcacgttttcctcttccagcagacgaaaaatatatataaaaaaacaatacatattagctctttcagaaggagaaaaaaatacaaaaaagacagtgcataatgtctgagcccaggttcgaactggggacctttagtgtgtgagactaacgtgataaccaactacaccacccagacatgatgttgaacaatatctccggcataatactgtaacttacgttctaatctttagttcttacataactctttaatgaaaggttacattttgtattgacctagcattctggacgtccgctccgcacgcaactaaccacccagcgaatctgacacgtaaccaaagtcagatccatgcaaatactttacttggggtcttgggctgatcagcagcagcaggaggcagatagatagagagagagagaaaaaaaaggcgaaacaaaacaattcctttcctccctctccagcgagtacgcacggcataatattcctcatgatctatctatcgaaacgaaaacaagatcgtggacgcgccaaccgagcccacgcacgcacgcgacacatgtttagaagcggtcaatgggtgtcactgccacgagaccagcaccgtccggcgcgagcgcatccccaggccccagcacacccttggtttcgttttcctggtccaagcaagcacaggaagggggcacgcgacgggaagaaacgaactagaacgttcctgttccggggcacgcggcaacgttctactgttcccagaaggccagagaaccgtgccgtttcctgccgagctagctgcttcgggaccggacggaagcggacccactccaccggtgtcaaagtcggtctcgcgcggcgcaagattctccggtcggtcaagaaaccccggtttcgtgtagctagctactctcgactccgactcgatataattaagtttgtggggcaagattcaccgtgttctctcgaggttaacatcaccatcttgcggctggtcaagaaaaccccagttttatgtagctattgttgaagataaaaaaggcgacagtgatctcatccggaagtaacaagaaggctccagaagattaccggttattacatcttcccctaatcctaattaagcataatatctctactactctataagcaggtaaggagggcgtccaccacggctccgcccggacgtcgcatgagcccccgcttcccctgg

SEQ ID NO: 230 - DNA, 1034 bp, Zea mays
  misc_feature (1)..(100): optimal_loci_161989_G1, chr4:187591718..187592751, Cluster 2
tttttaattaaaattagttaaggctctaaacgaaccgtgaaaaacatttgaatcatgatttattatgactcctacttgaaccatcaaatacacgattgcacatgatatgtcccccttaaatactttcagaatctatactataaaatatttagttttcttttgtgcgtcatcacaactgttagattcagtttttattgaaatcttatgggcatcagcagtcggcaggaactctcctcaccaaaataattgcgaccgctccctcccctccactccgttgtagaattgtcaaaaatcaatggcgacgcaaaagatgatccgtgccaaggtgcaagtgcatgtccaacacgggcctgaggccattggcgaggagtgcatgctgcagctggtggagggtgtcggcggcgtcaaggtcctcgccgtcatcatcgtagatctagctcggtgacgaggaagtaggctcgtagggcctgatatcggctacgtcacaccaggcaaagaccttgtcatcgaagtaggagacgaggaggtagccatcgtggccagtgtggttccctccgacggattagatgaggcccagccaagtgtcagcgtactcaactagaacggaaacggaaggggagaaactgggaaggggagcagagggaagagacggaggaagagaaggggagcagagtatttttcttaggggtgttttacagagcttccacagctctgttcacatagagattcactcctacatagttaaatagtaaaaatctgaattgctcaacggtgaaaatgaagtgaatctaatctctattttgtactataaagtgaaagcaaaaaacatgtttctcaccgttcccaagctgctccccactctctagattaacttcacagcctatttgacaaacgatttttttcaaataaattcatttctgctaaaaaatcactcgaaatcactatattagagaatcggctctcggagctaaagaatcacgaagcgaagctatgccaaacgagctccacacgaccacacctattccttccagaat

SEQ ID NO: 231 - DNA, 1019 bp, Zea mays
  misc_feature (1)..(100): optimal_loci_162738_G1, chr4:190978100..190979118, Cluster 2
tgtgttgtgtttgttttctttgttttcctccttgcctgcgttgtgcttgcagttgtttgtaatatgttatgtgccacaacattatgtaaaggttaccttgtttcctttaaaaacgaggtcgttgaggtgtagcttagtcataccaataatcaatgaaaatcagctagggattgtctatccccgttgacgattaaaaaaattaaaacgatgcacgtctgtagtacatctatagatagatgtacacacgttgtaaaaaaccaagattcaagcttattttctactgttcatggggctcgactcgctgaaattaataaaaatgagcaaagctacgtacttttaaagtataatataaatgaattgtccatctcgtatcagattaagtttttgggttaaactgattgatgcatgcaaccttaatatggtatcagagccagagatctcgagttcaaatcttagctagcacaatttaataaaataattgttgctcacccatatattccacttcagtagggtaaggtaagaatgaaacactcatgtgctctggtctgtggacagtcaataagagggcttccgctttctgaagccaaaacacttgcgtgctcgcacgtcttgcctaatccgccggctaatgaaatgtatctcaggggtattaatcaaattagcagtgcaacgacatcaatcaaagaataataagcaatacttgcaggcgcaaaacctgcgatacgtacttgtttatatttatggccaagtaaaagaagcatttcggacttcggagtcaagggggcaaaggataataattaacctaacctgcatgcaaatctgcaacaaaaaccgtgtatggtgcccagcgcccttgcgcatttcccgtgcaccgacgccgacgtgtgcaggcaagacataggccatggcgggcgtggattttcgagccggctagtgtggattactcccttctgtctttgagaaaaaaatacataaatatatatttttaaagcttgcgtaagagtactgcttggcttcaa

SEQ ID NO: 232 - DNA, 1163 bp, Zea mays
  misc_feature (1)..(100): optimal_loci_16548_G1, chr1:91871188..91872350, Cluster 2
agagtcgacaaaaggctactgttgtatggtacgtggtggtcaacaaagggcgcaacaagtgatggaacctgcctaagcctaagtctgtggcagctggagcctggatgggaatgggatgattattatgcatgatgggcatgcaatggcatgtccatgccgagcgacgacggttgcgacagagcacgtaccggtgcggtcacatggcgagacataagccatcattaaaaagcgcgcacaaccaacggaccgaaagcaaaaacaccggcaacgccaatcaaggctccccccgaccgttagccggtcgttatattccggaccaaccacgggggccgcgccaccatgcaccagtaacggccgcgcccgcgcgccacggtggttagtggcatctatcgtccggtgcggtccggtccggttcgccgtgtggacaaaacgggcgggccgagcgcgacgggtgggcggaggagcgcgggggcacatgggcagccgctccgtcgccgttttcacccttgaatgctggctggctggctggctggctgggggagttcgccgctacatacgtaacgtacctaggccgtctggtcgatgctcgcgccatgtatcgtcaggtgctagatgttgctgttgcaggtactggactggtcccggcgcccgggccttctggcacgcacgcaacgcatcgtcagttagagacgatccagtttggccactcgttgacacgtacgtccgtccggccggcaccgggcaccctcgctccgagtaatacacgtttgccttttagcacgggaccattattgccccggcagctccgatccgtagcagatcgacttgacatacagtaggtagagttgaaccgaacgtacggtcggcatgcatgcatggttctggagcgagcagcgaggcaggtagcagctagcagacccatgcatgtgagccggtgagaaatttccaaacctgacacgatcagcgtgtgcgcaccacatcacatcaccaccggcccggcccggccccctaataataatcggccgtcacggggggtccgtgaccaacgagcacgccacgcacggcgttccccccctgccgcccgcggcccgcccacgcacccgcgcgccgaagtccgcgctcccccgctggttgtggtgtgcgtgtgtgttccttttcttcac

SEQ ID NO: 233 - DNA, 1136 bp, Zea mays
  misc_feature (1)..(100): optimal_loci_171355_G1, chr4:235167661..235168796, Cluster 2
gtgcatgtggtgaggcttgggatgaaatatatgatgatgatgaaactttttctgcttctctgggaaggggtgtaggtccctcggtccttctcagtctgaactctcttcataccttaacagctcttttactcctacacccttgtgagcgccacgccgccacacccaccggcttcaattcgcaggccggccactccaccctgcacagcacagctcttttactcgtacagccgtactgtacatacgtacacgtactacagcaccattcatcgcaacaatctcacatgagttttactggtagtttcactggacagtgccgtaattccacgtgtagcttgcagtgcagttttacaagttacaacaatctcacatgagttttatatatatatatataatcccaacacttgcatagtacatactgttgtacacgacgtcagcatcacatcagtgtccccatgatgagtagtacgttcgtgactgcctgcatgcaccggaatttatggcgccgtacttaaggatcgacacattcattgtctccagtgactgtctgtaatttgcagcagtctctgaatggggtcaagtgttgagtgactgtacgtacgtgcgctgctcaattacaggatcttccattttatggcgtcgctggcctggcctggccgtcgaaaagcaccgcctgctcgttccggcgcatgcatgcatgtcgccggccatcgccagaacccagaaggcggaggagcatatgcgcgccgcgcgcgagaaggccgaagggtccacgggctttctattgttatatcacaaggtggaaaaaaaaaacgtctacaggggtagtccgtcacgtacgtgcatccgtgcgttggtcgaccttggtccttagcggtcagccgtagcgcctcgctcggtcgcgtattacctgtccctgcaggctgcggctctgctccatgaaatttctccgcgccatacctgcagcggtcaggcacggcgtctggtacgcgggtcggcgggtgaagatggggctttgcaaggtgaagtcggttgtggctcggcaacgataacagctgacgaacccccttcttcgtggatgggattgtttcgtcgtacatctactaggagtaggatagaggttcaagctcattggtgaa

SEQ ID NO: 234 - DNA, 1403 bp, Zea mays
  misc_feature (1)..(100): optimal_loci_173223_G1, chr5:4922804..4924206, Cluster 2
ttttgtgctcccgactcacccgataggaagtaacgggacggcgggagagggtcgaactcgaacagctgccgggcagagcgtctcccgacttggatggtatggcgtgggggcggcgggcggcttggcagggcggtcgagcgtcgacggcatgcggcctttctcgccgccgttccaccaccattgcacggccggccagtgtgtcgctgccgcgacgcgcctgcgcatcaaccgcgatcaggtgaggagggcaagcacatctccagctcctcctagcgagcaggggccctgctagcgagtgacctactactcctagtcctcggcctgttcgtccgtccgtccgtccgtacgcgcgcggatcaacatcaacttgctggacccaagcatgtggatgcggcgtggcagtggctcccgaatcgatctccaccagtacatgccgatgccgatccacacacgacgagcaccagaccgcaccgggcggcggtgggaaagagggcagcagatgctctcgcgccgtggctgtgcacggtgatgggttgacggcgctgcgcacccgcgcgccgatgccctgagctgcgaccgacggacggggacgtgccggcctggcattgaccttgagtcccagagcgacccaacaggcgatggcggatggtgtggtgcttctgctgtgggctgtggctcggccaccgtactccatccgaggctcgccatccgagttggcgtggtacgggcggggacggggacaggtggccgggggacggggacagggaacggacagacggccatgtgaccgtggcgggctcgccgtcagcgagcgagggacagggagaggccgcccgacccaggggccagggccaccatcggcagagctcgtgagttcgtgacgccgttgccgctgccgctgcccgagactcagactccgagagtggttggcggacggatgggccttgcttggtcccggcactgcagcgtccagcgcgcccttgtacggttgttcccatgcgcagccggcagctcagcactcgggcaggaaggagagggcagtagcgcctttctcgttctcgttgctcgccgctcgtgcgtgattctttgtggcaagtggcaacgcacacgcactcactcacactcggtggctcggtgccccgcccgcgtgtgcttgtttttctggctgtcgtgtagcgcggctccaagactgatgagtcagtgggatcgatcgatctctacttttaggagacagttccctcttagccactgaatcttagggcctgtttgagagagctttgcttcaaaaacttcagctttggttttctagtttcactagtttcactataaaacagcttcagcaaatcgttaaggtgagttccaggagcgtttggtttgtatatggactccaacttctatagtac

SEQ ID NO: 235 - DNA, 1230 bp, Zea mays
  misc_feature (1)..(100): optimal_loci_174499_G1, chr5:12520777..12522006, Cluster 2
gcacctttccgcatctcttcctaaacaatcttggattgcctcgaacgcgggctggaaggaggtggcgggggtgggttcggtggcaactgcggtgggagcatggatggaggtagaggcggctttgggcaggcgcaggctgaccgacgacgcggcaggagtctgtcttacatgccaccgagcatcttgcccaacctagggtttggctgcttgagtgaggagagatgcggtttggggaagaagaccgaggcccgatttgattcaggcctctatcactccatgtgatttctcctctattgtcgccatactcgagtcgacgcgctagcaactgcgcctcgtcgggtcactatccagtccattccaccacttcacatgcgaacaagagcaaagcccgaaatccttctccgtttctccccctgcacgcatgcacctgctctctcgcgtgtctcttgtgtccttactgtctaagtgtctagtggcgacgactgccactgccactgccactgccgccgccgcccgcgaggggccatgcccctcatctccacctttgagcgcttcgcccaggtatgtctgccccgcagttgtcgtgcttcacacagctcagtccaccgtcttgaaaccttgtaaaatctgcattgtggagaaattccattccctctggacttggattggattgcatgcatacaacggatcaattcaatagcgcgtctattgtcctagccagcaaatcaacacttatttgtgtagtccagggaattgcagtcgtgcctgccatgactgctactcatgaaaacgtagctttaatctcttcatttctttctttcttcaaacgacataaagcggcttacttccattattcttctggaaaacgcattactgcacacactataaattagtatgcatttggtaagaaatgcaaatatctgctttgacacaaaacaaggcatcaattgctttaggttcagttcttaaaaccggagaagatgggtttcctccggactggtgcgttgttcacttgtcatctgccattcccgttgaggcaaactgtcatacaaaaaaatccaaaaaggccattgtttcttgtatttcttacaattacgaagacatcgatgccttcctttgggaattgtagtaataatctatttgagcttcaaaacaaaaatagtggcctagtaactaaggcatgggcgcatggcaatttaagtcaaaggtgtgttggtcatatgcagacta

SEQ ID NO: 236 - DNA, 1039 bp, Zea mays
  misc_feature (1)..(100): optimal_loci_174953_G1, chr5:15083100..15084138, Cluster 2
tatttttttagctatgctcgtgctaccaaaaaaaacccgatccatattctcggcactactcactcacgatgctagcctcagctgtgaccacgaacaaacttggctctacagaccctgctctctctctcgtcacacacgcaaactaataggttgtgtaggcaaacatgtttcatatcagtatctgatgctgggcacgtgatcagaatttttcctgagacactgttaatttggtcagcggcaaagttgaatttgagacacgatataataataaagccttgaacgtatatcacgaataatcctggtagctagcagccagcgactaaggcgggaactgtcgatatcaacaataattcaagcaaagaattggccggatccagttgaaaaaaaatttgaccagatccaattggccagggtcctcatctgagtcgtttcttagccgttgatcgatatatacagggtccacagttgatggatttgttttgtttagtgctttctgcaattcatacagatagactgaagccgctctgatgggctagctagctcgcctcgtctgtctctgtcagtctgtcgtccacgggcgttgtttcttgtcctgctgctgctgctgccatggattcagcaactgggacgcgagccggaagtgccaggcaccttccttccttcctcttccgcggcacacacatctttcagccgccacgccgctgcttctttcatctcttccagagttctacttccagtccattgcacgccacgcttgccttggactcttggtacatgaacgcgaataagcacgcatttcttccgttggcccaaacaatctctatttatctgatttttctagttggtgcttgtcgacgataaagatcagcaatgttgtcaaatttttgaaaaatagggtttgtagcatatacggtaatattttggtctatttagttttatcgtaatgatgttgtctttatttttatatcaaaaccatcaattatataggttattttttataggcacataatgttaattataagctctgtagcttgttcac

SEQ ID NO: 237 - DNA, 1298 bp, Zea mays
  misc_feature (1)..(100): optimal_loci_175636_G1, chr5:19127993..19129290, Cluster 2
tgcccgggccctggccggcccagccagacacatatagttggacatgtatacatgtatacgtggcagggtcgcttgggaggcaaggtggggagggagagggatgagagatgagtgatgagggatgattcaaataatattggctattgaatttgagtaagaaagagagtgttattcaacaatctaaaccgttggttttgatgatgtattaagtctgggtgtaatttgtttggtggatttactggaggttatgaatgtaggagtgattagttggagacgtcttacatataaatatgtcaaaatctaaactacaatgactaaattgcagttacatgtcacgatcaacaaccccgagaatgtagaaagatttatagtcgccccttccactcaaaaatgtctacctgagcagctgagctggcttatatctctgattttttatatgaaatggataatgcatgttaatgcttatattttgttgcaccaccagccaataaccctcgcttttgtgatttgtatggaaatacccaatttcatctaatgaaggcgtacgattctgctaaaatgttaacgtaaccttgactaactcgaccaaggctggaaatgggcgaaggtaaaattcacaatttagtttcttaaaactggcagatgttcttgcagtttctaaggtcttgtttgggataattttaggttccagctctagtgtagagcggtagtttataataccaatttaaatagttttaaaaatatatttaatctaaataataaacaaaataatttatttaaatgtatttaatgtagtacctaatgacctgcaccaccaactctattaaattttttggagctgaagatatccaaaccgcctaaaactctgaagctataaacgcaacttgtttcctagacaacgggcatgctttgcacacagtctcgagtaattcctgaatgaacaataacaaaagtagcagtaggagccctgccagcgaaccgcctacagcatccgttcctcaaaacatctccctactcatgtcatccctaaaccatccgtacctgaagctagcagctgtcggtaagcaagaaacgagcgcgcgtcaggtttactcaccgcagtcatcttcctcggcggcggccgcagcctcaagcgcggagccgcctccactggcgagggggaaggggcaaccatggtggtccgcgaccgcgaggccatgagccggaggagctgcctcgagccctcgacggagatggatcctttggattactcgtgtggacccgtccctctctcgcacttatgtaaatcttcggagcta

SEQ ID NO: 238 - DNA, 1263 bp, Zea mays
  misc_feature (1)..(100): optimal_loci_184936_G1, chr5:76434219..76435481, Cluster 2
aggtgaggtgaccgacgctgcacagggaggaagctacgaggccaaaagatacagcggaacgaacgaacgaacagacaaaaacaagcaacgcaacgtgagcgtatcgaattcgtatcgtaccatttatatagtgattgatttacgacgaaaatgataccgtaccaagcagcacgactggagtgactggctgtggccgtcacaggcgaggcgagaatgacggcatgtgcgtgcctctccgttgatgtgtctacggatgctgagttccctctcctctcggcgcagggcgggaggaaaaggcgcgcacatgcagccattctcgctcgtgattcaccctacatggctacatctcactagagtgccgatgccgatgcatcatgcatggactgaatcactggacgacggagagcctctcacttctgctgctccggtctcccaccgtggcgccctgccgccctgtgtctcggtggcccgcggcggccatgtcggtggcccggccgcctgggcttgggcggcagcagcagcagaagcctgcactgcatgtgcggtgctcctggattagtgtgggcccaaccgcccagattaaataaaacaacgaacccccaaactggcccacccgcggcgcacgccgcaccatcatcagcccatcaccgtcaaggcgtccactcggagatcgctcgtgtttgagctacctacgtctaacgtgtgtggttatttaggcctctggttcagctatatattcatgaaaaacccgagattatagacacgagccgtgagaaagctgttgcggctgtagagaagctaaaatatgtttagttacaacatcggtaggttcggtaagcgtgtgatgatagcttggtaaacggacgacatggatctgaaaaaaaaatccgggatacaaaggtggttctgaattggactaaaaggaggattatgtagatttttagaaatctattctaatgttatacccgttcaattggaaatcgagattttttttcaacatcaaatctggttaagaaagcccaacgaaacacgtcttagttctctgacccattctttcttcgtgtaggtattcatcctcttgcaaaaaaagtaataccccatccagatctagattataagtcgtttcgacaaggtttaagtcaaactttataattttttagctataaataattgttttattatttatttttgaaacttattattattattattatcattattattattattattattattattatgcatcgttttatcttaaaa

SEQ ID NO: 239 - DNA, 1128 bp, Zea mays
  misc_feature (1)..(100): optimal_loci_1901_G1, chr1:9908833..9909960, Cluster 2
aagtggtctcaacaaagtgttcttctggatgactaaccctttgttcacctcactgcaaccaaaccaacattgctataggtgaatggtacagtttgaaacaaaaatagaaatcctatctgatggggagattagattcagattcaatgaaacaattgggatgttggggatcaatgagacgtgggagattggctgtgggatccggtgcgcaacacatagcaacgacacaacacacaaaccaaattattggttaaatgaaaagcggaaagcagaaggtaatcaacaacatgccttcttaaggcccgagagtgatcagcgacatacataccgatgatgaggagcaccttcgtgaccttgtagcgattgcggcagtaatagactcggggaccctcccacttgtcgttgtccgcgtacctgcccatctcgcagtaaggcattacatctccccatcgatcagggtcggctcatggttttgaaaggacataggcccatctaaatatttgggcccttaatatatattttcacttatgtatcatttaaaatgtactttaatagaaagctgtaaaacaatgatataatctgtgtgaacacctcaaacttgtaaaattcgacatctcatttaacactatagaatgtctctcaaaataagtaacgcgttgagcatttcttgaagcaaaatcattaagaccaatatttagatcaacatttaccaatatatccttctcgatcgaacatgtaaaataattaactctaaaggactctatagatgacactgattcttcttcgttccatgtattcatgtttctcatatgctcaaaactattttcacgctatttgatcctcccactaagatgcttccagtccctcaatccatcatgtgccagcaaacttttggtctcatttgatttaaacaatcaacaacaaaaataataaactttatccacatgcttagaataaacgaatcactttctatcaacaatctcagaattacttaactttctttggtagaaggtacagaaaaaatgcctaccaagattgtctttagggaactacatattcaattctctcataggccccttttcaattaagatgtctattcttttatggtctagattatcctatgttttagga

SEQ ID NO: 240 - DNA, 1028 bp, Zea mays
  misc_feature (1)..(100): optimal_loci_195_G1, chr1:1034771..1035798, Cluster 2
ttacgagattatcgaaagtaccatctgtatgtgcgtcccaatgcatgtttgcgaaatccaattcgtgcatatgtgatttgaatttctcatggtttccatactagctacctcttgtttttcacagatttgatgatagtcaaagtagtaataggcttccaaaaaatttcggatacatgtccaaagtaaattaaaacatgtatttgtcagctggggcctggggtagaggacaacaagtgaagtaaagcaagccacacaaacaaaaagcaaagcgccaaagtggcgacgactttggatttttctttgttataaagcacaaggatacaaaggcaggatggatgtatagatggagtgccactaccaaagtgaagtcacaagtgaagtcacctctaatatataatatcccaagtacagaaaaaataacaatgacagacacaaattcctgcattatttaaaaggattttttctagatttatctgtaccttttctcagcatacaagaagaggatttccaatcctatatgggtgccatagcacaatcacacatcacaaagctaaagatcaagtaaaaagagaggatgaaaagctgtggccaccaattggacaattgggtattggcaccactcctctccctctcaatctaaaagacatgcagcaggactttgagctaccatggtgcacagcagggaaggaagggaccattcttgtctctattcctttaggcacacacgtcacagacagacagaagcaaagcaacaaacataaagcaaaccaaattgatatgagtgctcaaagtagaaagtatcaaaaaggcaatccacttattcctacttaaaaaaaaagaaaaagaaaagaaaactaccagtatgtttgtcgtgtttatttattccccgcactgaccatgctatatgaaacaactacatttggaactcagaatcatgtatgtaaaagatcaggtgtatccacctgcaagctgaacgaatgggaacacaacaaagaaaaactttcaaactttccgtgcaattgccacac

SEQ ID NO: 241 - DNA, 1060 bp, Zea mays
  misc_feature (1)..(100): optimal_loci_197377_G1, chr5:158692022..158693081, Cluster 2
tgccctcccgctgagccgctcacgcccccggattccccacgacgaggccgccctgcatgttcctataccaatatcaatgatcgtgaccgtgccttttggacccctcctccccacgcctcgtgtctagaatgttttgcacatccttgactagctagctcagtgcgtcggtggggtggaggccagaccacatctctgttgtcgtgctcgggctgctagactgatgaggtgccttccactggctgcgtcgttgtgatgtgctgactaaattcgggtctatgtcattaagacacatagctttagcttacttttggggtggcaagaccgagcaaacccgtatctcacgttgggttctgcgttcgtctagcgtgttggattctgggagtatcagggaggaccgtcgtggccacaatgttctagcttgccaggggaagcactgtggtcaactatcatcctccataatacgtcgtctagcgtctcgtgccatggctcgcgcacgcatgccacttcgtcgtggctgcactgatcgttgctgtgcatatcccatctgtcccttggcaagcgctggtttcctcgagcgtggcttcgatgttggcagcattttatgtgtctgggcaagatgcggtggggcagatgctgccgtgaacatcgacacacttgttggggtcccttcaaggcttcctgcgctcaggatgcgaccttcatgagcgttggtcatgaagctctcttgtgaagggtcatggctgccctgccgggtgggacacgatgaggctatagccagaatccgataggaggaggtcatggaatgaatccctgatggggttgtccattcccacgaactcaacgtaattgggtcttatcggaccttgttctaggttacgcctttgagggaggtggagttagagccccccaaaggttccacgatgacatcgacatcttctgacaagggggtgtgggcggtaggagtcctgaccttctttccctcgtcattgacaatgaagacgaggatcccaaagcaaatgtcgctccgaggaccaaaacgacatcgtgactggccatctag

SEQ ID NO: 242 - DNA, 1361 bp, Zea mays
  misc_feature (1)..(100): optimal_loci_199394_G1, chr5:170248680..170250040, Cluster 2
tccaccctgacagtacgccctacgcgagcaggtcctcgaagaagagctggtggaccatctcgctgcggtggagctgacgccatcggtcgcaggctaggggccgtcgggtcctgcaacctctgcgccctgctcatgctccacgacgaggacgtcctcgcatcggccggtcgcaaggctgcgaacgcagagcagaacatagcctcagcgagggagagcgggaggcgatagtaccgcacgacaagcaggccacaggcgagggcggggaagaaggcgctgtccagggtggcgagctggtcgtcggtggtggacttggccatgaggagcacctcctcggcgcggtccaacgacagaccaaggcgggtgacgatggacgtgattcccgcggaggcgatgacaagcttctagtcgcggtaggcggaatcagagttattgcagacgagggaggaaacgcggagtcgcaatatgacgctagcgccgcggtggccggtggacgtcgggacgccgtcgctacaacctcctcaagaccgcaaccttctccccaactgcgactaagcaatcgacctctcgtcggttggatgttgggccaacgtcacgctcgcctgggtgcgagaacttggttgccatcatgctagcctggtggccgcgtggagctccgtcagcgagaactccgacgtggcctggtcacggtttacaaaaccgtttgacccgcgacaaaactagccggtttgacaaagcaaattaatttgaattcaaacccggtttgacaaagcaaattaatttgaattcaaaccggtttaccgacgaaaaaccgctagaaaccgccggtgcttattatgtatttgatagtaagtgttcctaccatttgaaaacctactttaggtgtttattatgtcttatgtacgcatcctattttgtgcttgtcatgtctctggtgctctgtatttgatctcttcgagtccttgcataccccaagcaaattgattgtttttatgcttcctaatctagagacataaattgtaccttaggggagaaaaatatgttatctacattgcacagcttgaaacaggcaatcctcacggctcttgattgattattccagtcatcagagctactgttccaaagctggacttggacgatgcatttcaggagaagaatgagatcgcaaaagcagtcgagaggagcttgaaaaggtttctgccaagcattcactttttgtttaattgttgtttgaattcctgttagagcatgagtaatattttgattgatttagcttgtttgtggaacaaagatacgatgattcttgattactgaaattgcccttcatatactcttgttgcattttacgccaatttatgacattt

SEQ ID NO: 243 - DNA, 1064 bp, Zea mays
  misc_feature (1)..(100): optimal_loci_200139_G1, chr5:174352985..174354048, Cluster 2
ttaagatttttgataagccctccatggccatgcttagaaagggaagggtcaaacaacaatgatcgacacgagggtggagcaggttgaagggcgatgagcaaggcgctggtgtcgctacagagctggtggaggaagataaccagatggatggtgccactcttgggggcgacaaggttgcaatcttttattcatcgactagatttaggggtgggtagggatagagcagcgagggttggcatccaatgttgtatgagccaacgactggggacaacactagtggttggaggtggggtcagttggtacggttcgtcgaagaagaatagtagacaatggttagagacaaggaataatgtgtgtgagagagagagactcatgcgtcagatgttgtagtagcacgtgcactaattaagacagatgctttgctgatgccatgttgactaggtgttggagaatagttgttgtcgactattggggcatcttctccattaatcgctataggattcaagtggccctatagaaccttctgagtagcacctccattctatattgttcataaccacaactttttgatgcatgtgtaaactttctatagagccactcctacctccaactatattgttctttaatcactgtctggttgtgtggtctctggtgaccatcagaagataatgtgatcccctctttctttgtgctttgtttaaattgtgcactaaactctgttctttccctctcagtgcctcaccgtaactttctagggagtgcaatatggctagaccaatccatcttcttgaacggtgcctaagctccggtgcccttcttaggggcatcaatagagaatccaatgtttaaaatagtgggatatagcaacgctatagccccgctatagccttttgaaggacctaaagctacgatatttcacttttagacgctatttcaactacaaccgctatagcctgatttagcttcgctaaatgtcacaactttagcgctaaatagccacactatttctatttttcatggtggaccaaaaaataatgaatgtaacgaaaaggatgatgaatccc

SEQ ID NO: 244 - DNA, 1386 bp, Zea mays
  misc_feature (1)..(100): optimal_loci_200324_G1, chr5:175709277..175710662, Cluster 2
tgggcatcgctgcaggcgtgggacgccccccatacaggcgccatgcaagggcccgggagggccagcggtcaccgctgcagccagacttactggtactaacgctgctattattttagtactagtagagtactaatcatctcgctgctagaggtggagcaattggcctgtctctaatcatctctggcggcctctgtttggagtgagtcagatgcgcctgaaccatccgactgtggaaacgttggttaagctgtctaatctggatcgggctaacctgaccggctgatgacccaccgacccacccgggcaccgccagccgtccaaagagcaacgaagaaccctgctgctgtttgcaggccggtctacgggtcatgccccggggcttgtacatgtccgctcctttttgtttgcacgctgctggagccattgctgctgctgtttgcacactgcactccccgtcccatagcaagtgactacagttaagtaaggaaaacataatcaagtaaaatacaaatggttacagtttcaactatgattaataataggtctttcaccgacacatgtccgtgagtatcaggtactctaatctccatcttcttcttcttttgccagggtaccgtatgatgcttcataggcttcttcctttgacctatatcccttgtacgtagcatgctcccttaagccattcacctgcgcacacacgctctgcccaaggtggagaaaattgatgaaccacgtatctggtcatgacaactcaaggtaaacgcttggcaacaatactaatatataagcaccggctattgtaagtagttacggtaagaataatcatcattagcataagagcataagctcagtttgttcttaatacagagatggcggcgttgttgctggcaaccgctcagaattaacaggaacagagtataaatttatttattttcataagagtaagaattaaattaaataaaaatcagttgaagttcacaccacaccactggcataagggcaacgattcagaactaaatcaaatcaataggttcacagtcagaaccatcaagttaacaccacaacaaccatcaaggctgatccatgagtttcatcacaggagccatatgcgttagtttctgatagttacatagcacaaatgaaatcagtccaacaggataatacaagtagagcagagagacggcaccaatgaagcatgtcaccggatagaggaggcaccatatatatcaggagctgtgtggccttatcccaaaagccagcaaaagatatgacactactagagcagagcttgccaactcggccgggatgcgtcacgatagcacaagcctctcatcccacaaaagctagcaaatgatatgacactactagagcttgccagtagtagga

SEQ ID NO: 245 - DNA, 1194 bp, Zea mays
  misc_feature (1)..(100): optimal_loci_202236_G1, chr5:186799127..186800320, Cluster 2
cgcagcacgctccggcgctccgcgctgcaggctgcagcagcagccagcagagcagctcggtcctcgctcgtcgctcctcggtggctgggtactcgcctgggggctggccggcgctgctctgcgcctctgctgggcgctgctctacctgctctagcctctggtcgcggtccctgcgtgctccactgaccactgctcgttccacagaatatggcaaagaatatggcccaaaaaagtatgtctctaattctctatattatgtgaacattgaaagagaaaattttaaagacgggaccttcagaaaaacaagaaggcatttcaaaataagaaaactagacaaatgcaattgcctagatctcctagaactagactcaactaatattcttattttacttgttcaacaatttttacttcaatttgtcattcgtaactcattttttccttttttacagaatttattcgctatatgacatttggttgtaaatggattgtaatcaagatggctattaaataaggtattttcaacatctattacttattttatagttacaaattattttaaaatgtcataaatttttattctttgttgcgttagcaacacctaaatttttcggcgtcctccgccactgcaatcaagcgaatagtaattagctcaaatagtcaaatgtaattcacttgtttctctcgtaaagttttaaaatgtttatggttcagtctgctccgctgccctctattgatctcagcatgcagttgctacagtcatttactttacttacgacacaagataaaattaaagctcgcatagcacgacgctttaaacattgaaggcacccacacgtgtatgtatctccaaaacaatctactggtacacaatggaatactgaatttttttattgatgatgaaggaatttgctcaaaatactcctgataataagaccagtgctcggatagtcggatctatgtagatagcttcagggttcacaatttcgttttaagtcaaccgaatttcgttttgttgaccaaaacttgactttagtatttttatattttgaatcgaaatccaaaaccggaccagaattcactttttcgcctagtagagaaaacgaaaaaaaacatcgggttttagtgatttcggagcgtgaagttccgtggatagcttccgccacaaacaacccgacatggtaaacaccttgtatt

SEQ ID NO: 246 - DNA, 1170 bp, Zea mays
  misc_feature (1)..(100): optimal_loci_202528_G1, chr5:188494294..188495463, Cluster 2
gacaagatgggatggacatggactgcagctagctgtcgtgtgggtcacgtgggcgcagcgtcattcggccggtacagacagacagcgtggctggccgctgtggattggcgagaatttcttgcgggattccccattcccatctgcggcttggattccggggccacagcgccccggtgcagtggacagtggactctcggcctcgtgcccctcgtcggcatactcctggactgcttccacggaaaagcggttttacgagagaccgtatattttaagcttgtatatatggatggcgttagatcaaagttgagctatgagaggtgagtaggtgaccatgaagacggtgaccatctcgttattaaccgcttacaagccttaccttcgctttactgcgtagtaggtgtaatttacatcttcgtgtatatctgatgaacaacaggctataacaagtgtcggtttatgtgctggcattttcggtgtctttataagcctttgttcggttacatgagatgaaatgccatcataaatttaatccgaatatggattgagtgaatctatatctcacacccaatctcatggtgggattaaatgccaccataaatttaatccggatatggattgagtgaatccatatctcacacccaatctcatagtgggattaaatgccaccataaatttaatccggatatggattgagtgaatccatatctcacacccaatctcatggtgagattaaatccatcaactaatccatgtatcactcaaaggtagttattattttgatctataaattctaatgtaaacttgtgcaatatctccataaatttgttccatacctaataagctatggatagaatctatgtctttcatagttaaaaaaattcacactcttaggttatatattctatgatgggtttaaccgaataaaaaaaagttaagtagccttagattattttgaaacatagattgtggcatagatttaatttcaatccttactaatacagagccgcattgtgtaaacaaacaaagactaaattggcggtggactggagagtcctcggcgaacaccttaggccctgttcggttgccttggaaggcttctagaccagaaacggttccagatcaggaaacagtggaccactcaatccagtccagaatttgatccagatggta

SEQ ID NO: 247 - DNA, 1064 bp, Zea mays
  misc_feature (1)..(100): optimal_loci_203172_G1, chr5:191897776..191898839, Cluster 2
aagagtgcgttcatttgttctagaatcataatctagaatcaatctaaccaggaatgcttacctaatttgtataagctttaagtatcttgaaccattcctaggctcaatcctgaacaaacgaacgcattctaatgctagccacagtccacagatgttattggcctcgtgtttttgcaggacgagcatggcgagtgaggcagtcaccaccaccgttgtgggccaacaccaaaaggccccgagcaaaacctgcggcgccgtggcgtgcactccggtggcaaccgcagctccttcccgtctcgcggtagagggtaggtagtagtatagcggggaatcctacacggtacgtgcgtcgcggtgagtgggcaggggaacaaaacaggaatccaattccattcgcgctctcgtggtgacgttcggttgttcagcaggaaggcaggtcaggggcccggctccggcaaagccagccacgagtgtgcgcaccagtgcagtacgtacagttttgttccatggcttttttttaacccgggaggaagaatagaggaccccgggccccctgtacgattgtgtagggggggtcaacttcagtacggtgcaaaacagtgggtgaatgttattactcctaccgtcctacgcgtagcatagttgcttctgtactaggcatccgggaacaattcacagtgtgctgcctgtggcaaagcatctggttgggggtgggctgcgctctagacctctggcccccctgtactcatggtcacagtcacagtgcacggaaggaatgaacatgtaggcttgcttgtacaggtacaatacacacctattcatttggcgatgtaatgtaaccctagcatcggagaaaaattttggtcgcgcgcggaaggaacttgacgcgtgcgtcgggagaaggacacgggcaacagtgcgagcacgagatcggagtagagatgtacatttcgattggaccggatccgtgggagactgggcggctggttagctgtcacggtcacaaacccggagttcgtgcacccccattcgatcgctgtggctctgctggcccggcgccccgc

SEQ ID NO: 248 - DNA, 1149 bp, Zea mays
  misc_feature (1)..(100): optimal_loci_203174_G1, chr5:191907413..191908561, Cluster 2
cacgggccgcacgggacacacagcgagggacaagcgggcaagacatcgcacgatgatcggatgacgcaaccgccaacgccggccggcgctagccgcctgcgccttcaccgtccacggccgctgctgcccggcggtaccgcttctcttctcgttgtgggccttgcggctcagccaggctgacgcaagatctaaagatgccaaaattattactgcttaccttgtttgcttctgcaaagtcaatactgagagcaacacctacatgctcctaaacaacttgcgctccccatctttggctagccctcggtgatgaaaagaaaaacctcgtgaaatcagcttgcatctgcctcgccattgtatctacctcggcatcggctccccatccctagacatctttggctagcccttaggactcaccatctgctccctcctactcctgccggtgtagagattgacatcggctcaaccacttcgtagcagaaaagtcaacaaaggacacccgataatccatcgataatccattgcgaacacaatgaaacgtcacaacatgcttcgagatggcattcgtgtggctacagtaccctaacgaaaatagtcatccatgatgtccctcgtccagcaggaaccccaaaggacaaggagctacacaaccgtatccgaccctttgacttatgtaacgggatccttctctcatcttggtctataaaagcaagggaaggaccatgattcaagatgcaagcaaccacacgtactcattgccagcacaagtcaacatatagcacttgtgtgttgatatgaagcttgaattctatgcaacgttagttttttgatgtcttgattgattttatcatgcagttttcttggtcccatgaattcttgtctccaactgttccctaaaatttgccttttttaatggatttacctcgtggaactcgagtctttgttttttttttttgcatacaagtatttttgttagagtgcccatgggcagctaaagaaacatttatggtcttcccactacttgataaaaggatcttgtgactatcactaaaaatgatatttccctcgcgttcggctataacaaaaaccctctcatgcccccaacttagggggtacgaatttgtcgagtttgaccagtactataatcccaag

SEQ ID NO: 249 - DNA, 1060 bp, Zea mays
  misc_feature (1)..(100): optimal_loci_203198_G1, chr5:192155390..192156449, Cluster 2
ttctatggtattacactttaaattgaatttggaacctttttacacaccatttgcattgtgacatcattagccaaaaaaatctagatccgcccctgcgttcaacgtggttagcagcagctgtgaacggagtgctacagtacgcggtttgtaggcaaattgaaaatatgagcagtatgcctctctctccgttgaattatatatgaaagtacctgcatgtggctagttgtcgagtacgaccggaggaaattcgttggatataaattatgcttaaatgaaacatgttttagaatctaaatcaaataatgacccagaacatcaacgtctttcacacttcccatctgaacttcgaatctctataatataagctcatcaacgccaatgctgtgcagcagccagggatatatagggattcggaaacatatcgttttttttttgttttctttttggttgatgaaatgggaacatgtcagcaggcttgcaagttgcaacccagtaatttgaggacagaacttggacaaataaaaccgtcggcactcagactcagctcatcaaattgcagttcgttttcattattggcggaaggcagcacagccacccaccaacagccagtcagagggacatgaggttttttgtccacggcgaaggaggcccagctcccggggcaagcagacgacggcgaaggcgtggaaccgcagcaaggacgacgggaactttcacaacggacgaaggggctgtaccatcgtgcttcgtgtcccggcgccgagattgatatccgcttcacacgtgtttgttgaagtgatctatgagaatcagataacccatcctttgcttactgtgctgaataactgtttaaagcttatttactgtactagtataattgttaaggcttgacaaagatcctgtttagtataacatcacgagtagaggtgctatctcccgtgtgagccgactgagacgcaagtatagacccccctccagcagctccgttgccgttgccgacgcccgcaggtcgcaggccgcagtccccagccttgctttatttttcttgctactctcgcca

SEQ ID NO: 250 - DNA, 1110 bp, Zea mays
  misc_feature (1)..(100): optimal_loci_204380_G1, chr5:198814799..198815908, Cluster 2
caaaaacaaaccctgtacagcttggaagaatgcatggcttcaccttctgaagatttcatgatttgtcgtcagtatcaccgctctccccacgaggagcattaagaaaaaaaatggaaaatttgaggtcctagtatggaagcattaagtaaagatataatgtgttgaaaaataaaaaaatggtaatgacatcagctacgttcaatcgggggagtatatatatgtattggccggctcatattatttatatctatccacatgacgtagtatactgcagccctgatctcagcatgcagctcgaacccgtgttcaccaattccattttccaaaaactatgcatcatacgatataaagtcagttgtttgaattattgcagctgtaataacaaaacactaaatagaagtcagatgctaatcatgaacctctcttggcctcctctgttgtctcgcaacggggtgcgcaagtacactgaatcccggtcgcattccttatccaaagtaaaagcgggggcctgtccacgacgcgagcgattcaaatcaagcatgggcagcagcgcggccggggcagcgaaaggccgacgagtccaatggtcacagcacactctcctctctcgctctcgaaaacgatggaacctagctaacctccaacaagcaagcagtgtgattatgtgaaacgagcaacacgtcacgtcgcgaccgactcccgagtggtcctggcccacgaggtggaagtggggcaacggcacacggcacggcgaggtcggtctacgtcacggcggcgaccgatcggccagagcttgcgggcgcggaatggtggacggcagcaagcatagagcatagcataggggagggcgggcgggcgttggacactgggtggcaacgtcaaacatgtcatggcggtggcgtactggtgggcggtgatcgctgattggtgggaggtgcaaagttctgtgaatgaggcggtggtggtggagacgcgccggacgggacggaccggagcatcttccaagccggggcagaccgctgtcgaagcagccagtgagccagcagaagctttcgctggggccgctggtggagagcagagacgtggtgctccaataaatgcgcgatgttg

SEQ ID NO: 251 - DNA, 1116 bp, Zea mays
  misc_feature (1)..(100): optimal_loci_205028_G1, chr5:202291159..202292274, Cluster 2
ccgtgacaagcatgctgctttgctcgtttcggcttatatgagctgcatctatctatatgcgatttatccatatcatccttcctagtggcaagtatagtttcagtagctgatttgttcaaagtggagtggtaaacgtaaaacatgagtatatacgcttcaagtattagcttaacgtgaactataaattaagaagcttaacgtgaacctatatataaactaagctcccaccttttgttgtagcttacctagctaagatgcccggagaacgttctttatacgctcaaactcctctattttaataacaatcatacataaatgtttttttggcgtatttttaaaaataatatatacaagtttaacaaatattcaggcaaccctgtcaagagccaactgaaccaagtctagcgcacatgaggtaggcgctggtttaggcaggcatggttgccatgccagccgcacaggcacaggtgggtcacatgtgtcttttttggttgctttcacgaagacaccgggtatcaatcgcccttttgcacttaaagtgaatctgttgctaatccgatcatttgcacatggaaataaacaaaacatacaggaaagttgaaatgtaaaatgcttcaaaactcaaccgaaatgcgagaaacagctagcaaaagtgaactactttatcaagacagaagcaagtggcattagctataactaagcctataacacaatcccgcaaagtagggtgttttgaaacaaagcatttttagagttttaaggtaaaattattgtattagagaataccatattatcttgccaagagatgtttggctacaatgtaaaaaaatgttttgaataccatgttatttttggagtatttgaaacttcactccaacctaaagtttttgtctataactagccctgtacatgtatactatatatcatggtttgaaatatatacttagtctccaaatatgtagctaagagtggtataaaaaatactacgattatatatatatatgtcatgacatcttaaactgtagtattccaaaaccatggttttgaaatactttgcttctaaacacgagcaattctaggattgctcgtgtttagaagcaaagtattttaaaacca

SEQ ID NO: 252 - DNA, 1037 bp, Zea mays
  misc_feature (1)..(100): optimal_loci_205293_G1, chr5:204080789..204081825, Cluster 2
cggtagtgggtgagggaagaataggatcacgggaggtgacgggatggagaaccagaactagataaaacgtactccgctctcgttttttcagggccaggtccatatgtggtttcagcagcgtgtgagcctatacaccgtgggactatccctgaccaccgtccaggcaaacaaacatgccttaagtattcgtcgagctgaacatgccacaagtttaagcggaaggccaatgcaacgttgattataaacattcagagctagtttggaagtccaaaaaccaaccccccccccccccccccccccccaacccaatttcattagctcatcgtcatcacttcacagttcgctcgcacccggaaaacgaagaaggttggttacacacagacagacagcagacacgcaacatatttgaccttgctgtctttgcacagcaattttccctggatcgcactccaccgatgtcatcacttcaccgccgcatcagcgatctgcgcaggcttcttgaaagaaagaaagaaaaaaggtggaacaaaccgacagccgcagtaggcatggccagtacaggtaggcaagtgacagcttacgtgggcgtggggccccgatgtctgaaaccttagaataaaataatagtaccagacagaatttggaacgcattggatccctgcaacaaccgccaaattgacagctacctgaacgcgcttgcaccaacaatgatgtccgcccaaggaagagagacgacggcccatggtttggttgccaggtgggcaaataaatcactctcactgccgttgccatcacaagaccgtggatgaatcctccctccctccgtctccgtccctcccccgccccgcttttctcgcggcgcaatcagcaacacccggcggccggcgcctttcgcttttgcctcgggggccttccgctttcgccgcgacaggctggctgatcgggacgcgccgctgggtcaccgccattcatgcacccccgcccgcctgcctctgtgtcctctctgccttgagacaaccaacccgccggggcctaat

SEQ ID NO: 253 - DNA, 1007 bp, Zea mays
  misc_feature (1)..(100): optimal_loci_205761_G1, chr5:206564855..206565861, Cluster 2
ggtcgccatgaccaacgaggtcttctgaatcagctggcccaacggcgaggccgagggccgcggcctgctcaaggtgctcgtgtgcatctatggctggagtgtcaagatttttttcgaccacgccgacgaggacagcaccttcgagtgcatgacacgccacaaccagggaccccgccgcttcgcgaatgtcgatctcgacagaagcaaactgaccgctgaactaaactgtcctactgctcatttcaacgaatcatggagaacgtcagctggaggagctgcctgtccccaactccaacgttgaacgtcagctggaggagctctccacaacacgtgggcaaataatgggtaaccagaagcctgtcgtttgtgttgtgttgtatctcgagttgacaaatctaaaagaggcaagcgttcaaatactcttcagtttgtgagctgcattaactgactccattgttctgagtttttagaatatgattggaggatcaagcgccctggcatggactaaccccctaacctcctcgagccaacaacagacaaaatggccatgataaaatcattagtttgtgtcatttgaggtgactgttctataagtctacatggttgatgagagacgatggctgaacggttgtagcctcaagccatcagctaagatgaatgcaggcagggagtgttagtacttattttatttattttattgcattgactaatagtcctattatcttaaaaggattatgagaaccttccctcaagatcttggaagaacaatccccagaccatctttgtttattatgcaaatatccgggttcacctttttcaaaagaaatatttatgcttagttaccaatgacattttaaattaattatatactctttgatccaaatacattatatttttttgaatatcaatatattttatcatattgattccataccaactcacgggcaaatacttagatctactatctattaagacgatagtgtagaccacaaccatgcccccgcctc

SEQ ID NO: 254 - DNA, 1062 bp, Zea mays
  misc_feature (1)..(100): optimal_loci_206564_G1, chr5:210738061..210739122, Cluster 2
agctttgtgcaagtgattccacttgaatcccagaataagccaaagatcgatccccccatcagatcgacttgcgagcgaaccagtgcatggttaataaaacaaacaaaacgctgtgacgtacgtacgtacatgcagctgtgcaagacggacgtatctatcgaaaccactgccgcatccaaccagagagaccggttcgtcgcacaagaacagaaccagtgcacgccaacaatcgacggctcaccttgttttttctctcggagtacggcaacagaaccctagaatattctcgcttttcagcaccccaaaagaaccccctttttaaaataaaaaaaaaataaaagacgacgaaaacgttcacgtccagacgaatcgagatggagctgcactacagcgaaagcgccgtatcaacctactgctgctgctgctgcttccggaatgaaacgccgtatcgaactcgctcgcccttttggaaccactaacaggcgctctctttctgtttgcgcccctgagactgagagaagagaacataaaaaagtgatataaagcagaggcggagctagaaaattttgccaatgggttcacttaggaatatatgtataactataaatcataatgactataccacaccaaactaaatggtggtggtctatcctttgcagccagccatgttgcacgaacaggactgaccacaagtcagttaatgggttcgggactaaatttttattgggttcaagcaataaactatatacattaatccttggtttgataaaaatcattggtgtcaactgaacccaatggtccctatgtagctccgccactgatataaagcgcacccattagtgagtagtattcatgttctttttgggcctactacgtactcttgaggccaggaaagcatcccacaagcggctggtttagatattttttcaagcggaatcttcggtgttttgaatcattgatacggcaatgccagctttcgtggagggagatggaagaatacaaaactggctgcacaagatgtataagagaagggtatgtcttctctaaaaattcttacgtaga

SEQ ID NO: 255 - DNA, 1219 bp, Zea mays
  misc_feature (1)..(100): optimal_loci_207249_G1, chr5:213745055..213746273, Cluster 2
atttggaaactctcgctgataggggattctttcactctcatttattgactcgctcacaacatctaaagacatgtataaaggtggattaggatcaataggatagaactcccacctaaacaaagtggaaaggggaggtaggaaatcatgacgcttagttgaaacttgagcttgtaatctttttcacctttatgttcatcagtcaatgagtacaagaggacatagtggattacacacgttgcggcctagctaagactctctaatttgtttatgtgttggttttttgttgtacccatgttgaacacatcgatacttacgctctgactctctccaatctcttctttttggtactttacatatccgatgtttgtccactgtgacacctatgaacctgagattattataactttatcactttgtttttaatggatatatggataattatggatgcattatgtatggggtatagagtgtcgaccattgatatatggcgtaatagtaaggtgtattgttatacttgtatatatgttatgatatattggtttacgtttgatttaaagctatttaatgtgttacttttgtatcattgctactactactataaatataactaatatattttatatatttttttatcttgactcacgagtttagtaaaccaacttgagttcgtaaataagctcaactacgctaactttttaacttgtttcagataacgagttaaaaccaagctagcaagctagcttattctaatgaacaaaagacgacaaagatggcttgtttatcccgtcattttgcgggcagaggtcgctagcgccagctgcgtgcagagcgccaagcctcgcagcagcgtgcgtgcttgcacaggttgcacatgctgtgctatgtggcggctactggctagcagaagctgcagcctcgcagcagcgtgcatgcctgctgcccccctgcaactgcaagcctacgcacaacggcacaaacatggagatctgtgtcgtcgtcgtctgcatgcggtgagacctagagagggcgagcgagaagtcatgcctctcgcaaggttccccggcccagcggctcgagtgcacgcccgaccaacagcccaacgacgcttgtctttcaatcacagcctacaggctactacgggcatgtgtgagatgagatcaggacgcaactgggctggttgtctcggcccgttaccgtcattccacccacaaaacggccc

SEQ ID NO: 256 - DNA, 1350 bp, Zea mays
  misc_feature (1)..(100): optimal_loci_207251_G1, chr5:213754669..213756018, Cluster 2
ggattttcaaagaacggatcctaaaaccagatctagttaaaaattcattgtcatactaatggcatctgaaattagatcctgcaatacaaatgtatgtttaccggacattaatacaaaactcaaacattgagtacgatgtctgctctacttcggcgtgcggggaagtgcgggtctgcttggcttcttggcgaagcagtaccgaggtgactattttttgctaccgttgcgaacgggcttccttccgatgcgcttacgacgcccacgacacgagaagcgcctaagtgtgttatatgtgggaccaagtactagtgagataaattactatttttattcttctattatctgtacgtcatgtagctatttgagaaaaccatcgtgaacgcccttaaaaccgagaggagggtagctatctgactttttcggttttctctcataaagcagagcagagcagagaacagaagcaacgaattggttggagggggtggtcaagattcggtcaaaagtgaagcgaagcaaagcaaaggcacggaggacagtggcgactgactggccatggccagtgaaatgatgagtgactgagagatggctgctcatgcagggctagggcgaaaacgaccgggtgagccactgtggcgtgggcccgtcaggcatcaggacctggggttttgttctgatgatgtcctccatggtcctcttgtttcctgtaccaccgaccggcatcccaaccattgtaatgtaattggcttgccgcctttctactagtgtttcacttcagttacttcgctgctgcacatattctttctttggttgctgcatcgaagtgacccaggatgatgacactggcaaagaaaagagagctggcacccgacccgagtgacgaaaattacagtgaccgtgagtttcccaaatcgacgagcgcagtgcttcggaggcttgtaaagtaggccaggggcagtgggtcacaagtaaaatcatttaaattcagtaaaaaaaaatagtcacatactcattcgtatcagagtactctcccctcctctagtcctctgacggtctgaccaccccccacacacgcccaaaagaaagacgtcgagggtgtgccaacgtaagcatcggacgtagcatcactatggagaaagatgacgccgtcgtggcatcgcacgtctcgaatcatcagcttttggtgtgggtgtgccaactgccaacgtagaaagacgtcgcaaccatctgtgcgtacgcatccactatacggcgcatgagcaaactataggagcagtgacagaaccatgtgcaggcagtgcagccaccccaactccactccccatccccacacccacacccctgttgcacctc

SEQ ID NO: 257 - DNA, 1311 bp, Zea mays
  misc_feature (1)..(100): optimal_loci_207414_G1, chr5:214848526..214849836, Cluster 2
ataacacttgagtactctaccattgttttatgcatccagtggtttaggttaagaacaagcctaatttcttctaacatgatcatcattagataccagtgccatagcatctatcgtcctcgcggctatcaaaccagataacacattttcaatatttgtatccatattttaaactgaatatatacaaatatagattcaatatcctcgaatatgaatagttggataattcggatcagacattattataccgttcaattagatcatattttatttgaataagtaaatattatttttttatcttatgacaaaaatgcaattttcttatttgcactccattagagattgagatgtatcacatgtatagttggtatggcactccgcactcctctatctatcatccattttttgcggtcatccttgcgctcggaacagagccggtcttgacatgtactgcaagtacgtggtaactatggagtagtgagtagtgactactggtacgacgacgacgacgaaaacggcgactatattggtgctgtacaacgcgagaagccggggaggctagcagccggctttaatcgcaggcactgttggtccggcgagttaggtcaccgtcaagattccggtggcgccaccactacgtacgtcgatcgtgtgtatgcgtcatatgtctacgaccagtaccccatgcatccatccagggatacgatcgcatatataataaacgctacgactacaagcagcatccgatccgcgcacaatgcatggcaactgtacgcagaggaagcataaataggcgcccggccaggggcgcgctgcaagctggcgcgctgatccacggccgccaggcgccgcatgtgaccgatgtgaccaactggggctgctctggcgccgagcgccggccggatccccgctgccggcttggcccgccgtatcgccggtggggcaccggtgccggccggccgcgcgcgctcccgtccgccgccgcacagcgccggctacaggggggcgatgcacggtggtggtggccactagcgccaccccgcagccggtcgggcgcgggccagccagccgatccctgcctctgcacgcgactagacggaggggcgcgcgagcggcgtgatttgatttgatttggttccatttggcgcggcctagtatgtctgctgacacaagtagagaatgtttaggacaatcgagtgacagtggcggatccagatatataggctaaaggggttaattttctagtgaccggtggtagctagatagatgcaacataagctggtaggtaggctaattttacctcttttttcttcc

SEQ ID NO: 258 - DNA, 1093 bp, Zea mays
  misc_feature (1)..(100): optimal_loci_207501_G1, chr5:215073222..215074314, Cluster 2
aacagtttcgcatcttcgtctgaaacatcatgcatggatacacacaccaatctttcctctgccaggagattggcgatcaatcaacggtccatgcatggcgatcctcatcagaaaccaaaccgacttcacaacgctcctagttctaacttctcagactttgcaaggggaaaaagaaaagatcttgaagaaatcaaatggttgacaaggaggaggagaaggctttcacggtgcaagaaacctgtctgtgtcagctccttttctacatggttcttcagctgttactttcatgctactactactactataaaaaaaattctctctttaattaattggatctcccgtgtaccactcacccgcgcgccactgaaaaacagagtaggtgcatcctctttttcgcgataagttggaccaagagaagagagataatgtatcgagccaaagctttcagtgggcaccagatcaaaagatatggacctgatttgatgatacaatacaacaaggcgccgttctccaccctacttagtcatgaagtttcatggtgaattaaaaaaaaaagagggtgtcttctcagattctcagaaggtatcgctagctaccttgtaactgtaggcctggcaggcagatgatgtacactggatgagggaattgattgcatgggcgggcggcctgacagatgattttcaattttcaatgaaagagaggagatagtataaaaaggaaaggaattgttggagcccggctagaaaggaattgggctcgcggccactttgtgcctggcactggcagccagacggtgttaaagcaggccgggtctgccgcaataagaaggcccaggatagtgcgaatcgagcccaagtgatgttgtcggttgggcggcctataaacagcgggatcacgcagctggggctcgtcgaccccgacgcagcttgttcatgtggccatgtgggtatcctaaacatgaccctcttccttccatggcatgcttgttcgttccctccacaataatcaagagagcatgcggtgattgtttgttgggccatgcacgccgatcagctgccacgtatactgtgctgctgcagggttttaggtacta

SEQ ID NO: 259 - DNA, 1044 bp, Zea mays
  misc_feature (1)..(100): optimal_loci_214039_G1, chr6:38266720..38267763, Cluster 2
aaaaatataaaaagctcaagataaacgataactaggatatttttgtttaatcgacccgaatacaatagagtttgtgatcaaatttaggatcgatggtcatcctattaaaaggagagtctagttatacaatttggtcacctagtactactagttgttgttactatatgtattgcatataggtctaagtgacacacttgatagcaagaagaaaaggtttcttgacaaacattttaaaaatggtaccttcgcctctaatatgtttgacaaaacatttagtagttagaacactcgagaattaataatggaaattaccctttgtacagatttacataagataccgaataatccgatggtacagtagacatgcatggacaccggataagaggggatggatgatggagtggagttgagggaaaatatatatatagatggagagagcatacatgcatgaccagttgtccactccaagttccttgcattgcctctctacgtgcacctatttgaagttccttgcctgtcgtgtctccaagagaaagaagacgaagaacaaagttccttgcttttagggcagcaccaagaaagaaagaagacgaaggagaaagttgcttgcttttacggcagcatcgatctatccgcactggtagcttcacagagaactgtgtatgtgtagtccaggtactcaaaattgcatctccattccgttcgtcgtcgccatagctaccttctcctttgttggcatcgcgagagaaagagaaaaagaaagagagagagagatgagcaacgccaaaaccgccagatttgggcctgcggccaactgggaaggataccggcgccagccgaactacacggaggcaatgaaggagggcatggactgcaggcccgtgtcgggacactacgctgacggtgacggcagatcttggagctggcatcagacgtacgcgccgtggatcaatcgatatcgaccgatcgtggaatgcatttcaataaataagatctaaattattagacgaatctttttaagcgcttgaattgttgtattatatg

SEQ ID NO: 260 - DNA, 1309 bp, Zea mays
  misc_feature (1)..(100): optimal_loci_224259_G1, chr6:105089776..105091084, Cluster 2
ctagctagaaattgtgttgtccgatcactacttgtagtagctagctgtgcagtgatttgatggtgctagatgtgttgaatcggttggacaggtataccggagtttatggcaccagagctgtacgaggagtacaactagctggtggacatctacttctttggaatgtgcgtgctcgagatggtgacgtttgagtacccgcacaatgagtgtacacaccagatacatatctacaagaaagtgatctctgtaagaagatccttggacccgatgagccatttcacaacaattgtgattcaggttgaagtttgaaatgattttcctgatttctgaaaaatatagtacccatggattacaccgttgcagcgggcctgaaaattgatcttgcatttacagacgatcatacagccgacttaatttaatcgcatttgattaacaacttatacataacaatgttttattatatattacaggtttttagtgcacccttctcttccatagatgtactattttttacaaagttttgtagttgaagcgtcaattcaactcatctgtcactaagtgaaaaacaaccttgtcagggtgccttcggtttatagccgaactgatacaggctgttacaacattttttgcactttcttgatggatatatgctgcatcgattcttactaaattttgttagctgcatttaagttttaacatgtgaagtatcctagctgtatatatatgtatctttgaataacactattgatatagggccatttatgagtatatagttctttgcttggcactttcatgttccttgtgttgtttactaaatttaggtggacaaacaaactgcaaactagactttttgatgtttgtctcctccctgtttggcagcttagatggtagtgctagcttatattgttggatatgccctgagagagcaaagaacgaagtttgtctttcattaatcttcagtcaatgcactacaatctgcagcccttgagatagtttgattacagagtaatacgtgctattttagcaattcgcttggtttatcgaatgctccttatctaaagtcaattgatatcatgcatgtatttcatttatccaaccactgataactgattagtttatttactttgtccatgaataacatagtatttttgtttgaacttactggtatcaacatattgtttttatcctgtgtaagcataaagagtagtcttgcagcttatgcatccattcctctttgtagggcgcaatgcttttggcccttttgataggctaccaagcactggtaatttttactcctaaattttgtaat

SEQ ID NO: 261 - DNA, 1191 bp, Zea mays
  misc_feature (1)..(100): optimal_loci_224263_G1, chr6:105101479..105102669, Cluster 2
taaattaaatgatgcatgactaggagtatatatatatatagagagagagtctcaaaaagattgagcatgctatcacaatcagtctgtcgctgctaggcctcacataagagcttattagccgagctctagagaaaaggatgataagtcgcgcatgtgtggtatgataagctgatagctttgtgaaaaggagctacgcttaaacctgatcacttatcgcccgatcccatttctcctttccatttctaacgaaaaaccgtgtttgtgagggcctcactttaagaattacaacttcaatttttcagcttgaccataaacaacttcaacgaattggtaaggcttgcacttagactccagcttctataatcgaattaatttgtgtgatttttcttaattacccttgatgattagttggtagagaaagagatctaaatcggtaggtcatgtaaccaatgacatgataggtaatttttacataacttcatgaggacgtatgaaagcaccatttgaggagctttaaaaaatttatgaaactggcctctagtttaaggtttttttgaaactagagctcgtggagctagacatgtttagatagaagaagctgaaatagacttgaaattattgaagtaaggatctcccaaacagggtgggagggcttcacttcaaaaattacaacttcggtttccagcttcaccttgaaacaacttcaacagattggtaagacggagttcaagattgtttggcttgcacatagactctagcttctataatacaattaatctgtgtgattttccttaataacccttgattattagcgggtggagaaagagacatgaatctttaggtcatgtaaccaatggcatggtaggtaatttttgtgcaatttcatgattaggtatgaaaacaatttttgaaccagcctatgaggagcttcaaaaatttcataaaaatagcctttagtttctgttttttttaaactagagctcgttgagctggacttgtttggatataagatgctgaaatagacttagaattcttgaagtgaaactctaccaaacatagcctaatagttgctactccctctatcctaaattataattataatgttatcttgacttttataaaagtcaaaacatctcagattccactaattttatataataaaataatactattatgatactatataagtat

SEQ ID NO: 262 - DNA, 1115 bp, Zea mays
  misc_feature (1)..(100): optimal_loci_224473_G1, chr6:106060534..106061648, Cluster 2
ctatgaagaggcccttagttgccatcacagtaactttgcattacgctgatcgcatgaaggagagcactgtgtgtggaccaataatacaagtccagtgggtaatgggttgtggagtattgggccacgtcggcttcatctagggcctgaggccattgtataaatacaactatgcttaaccagctgtcggttacgaaatagatctccatcttctccactcagtttgcattgagttctgatccgaaatctgataattgaccattggttatcagatcaatgttgaatttgtgtgaattttttttctcacggatttgaagaactctatgctcaatgatcaccgaagcggagaccagcggagtcacagtatgacatggcgacgtcgtttgaagaactctatgctcaattcgagaacacgaccaagaagttcgttgggtttccatccatgatgcgtgttgcgtgagattcttgacaagatgagcactattgtccagtcatggaggacggcctcggatgaggcgctcggcaggacagacctaggataaaatatgactgagtgcatacttgtaaggagagcaggggcatctaaattgaactgagcagaggtaaaaatctagactttaatacttagaacaaagaaatgagcgggagttgtgccctcactcggccctacttgggagttgggtccacccctggcgctcggcacttttgattcatcggacagaggtggtgaccagtgatcacgtggatggtggaccgggcttcatcgtggctcgacagcgtgggcgcgtggccgccaccatcaccgccgccgctgccaccactgtcatctccccagacgaaggagctgcaccaggcgtacgacaccacatccgcccccactgaacccgtgttggatggatctcaacttgtgtgattcggtgtctcattcggttttgtgttcgcacccatttccaaagttggagttccctaagcttgatagctctaatcatcgtcttcggcgtgatcaccgtgaaatgttctttgagttgtacgtggttcatccttcgttgcgacaagacaagacaagatcttccacctggctcgtgacagtggaactgggtgctgttttctgatatggt

SEQ ID NO: 263 - DNA, 1059 bp, Zea mays
  misc_feature (1)..(100): optimal_loci_229242_G1, chr6:130588288..130589346, Cluster 2
actagccctaaatatgttaggatacaactaggaattcggctcatgtagtggttctgttaatctatttcatatattcctcgattgggtcaataatacaataattcactgcgcgttagtttctggctcactcgtatcattcaactgtgttcgatggaccggcagtggaagggccactacgatagaaacccagcaagaccaaaaagtggcccgtccattccgcgcgtgcgcgtcgtccacggtcgtgcccaaatgtgcaaaaaagaagccccaggggaatatgtccacggcgccggcctgccgcccgtcgcctcgcctaggcctaccaccaccgcattccattccatctctggtccccggccccctgctggtgcggtccagtaccagtaccagtaccagcaacagcaagcaactcccccctagccgcgtcgtcggtggcgcaccgactggatctgtcgccgggtttgctcccggaactacggtgtgtcggtgccaacgacactccacgagtaacggcgagtcagtcagcattgcatgcgctggagtttcttccacagttccaccaaccgtgcatcaccgtgtggcattggcagccagttgttcctcatgagtgacacgtatctccaatgccgtacgtggacgcgacacaggcctgaggccagttaaataaaatacaatgattcattaaaatataataactacatccgagtacataattaaataaataaaattacatatttcataaagaacaactaaaaaatacatggcttgaaaaaaaaactatatgattcataaaaaaatctaattgctatggtgcggatccaagatatgctctattaaatcattttttgtagctgatcatatactagactagcaaagactacgacctcaaggtaaaggatgactgcaaagatcgtgagtgcctcacaagtgattgtttatgtggcaacagaggactcaattatctcataatggcccacatcgtatgctcctccatgcttatcctcaacgatcatatcatgtagaatgatacatacacacatgatcatacaaagtacttga

SEQ ID NO: 264 - DNA, 1121 bp, Zea mays
  misc_feature (1)..(100): optimal_loci_229339_G1, chr6:131207625..131208745, Cluster 2
ctcagtggacgatttaataaaatgccatgcatatcctcatgtgcatatttaaagaacacaaccttagtcatgataaaagcacacctacacaaagccttttgatggtgtaattatattttcctgtgttgtagatttacatgcaagcctgaacacaacgcctaagaaaggagaaaattttagaatctgctgaaaggggaaactgataagccgcttgtgtgttatttttcagtctccccctatgtagaaaattagcctaagaaacggaatcaagtgtgtagtgtagttggtacaatcttctctctgttgttcaggacacatggcaccaattaataatcttctctctgctgcccatctcctgctttctctatcattttggaatcatgccgctacaattgtaccatcttggtgtaaaaggaatgccaaagaaattttcattggacacataggctgataggcatgagtttctagcaatatcagtaattcagaatgcatatatgtttgaatagtaggaatcaagtgttaataccgtgggttttgacagtagctaagttaccctggtatatgttttctactcgtacgtactgtatgaagtatactacccttgattggtagttcgaactgtgaacacatctcccactctttccctccgtccctccctccctctctctctctcaaaaaaaaaagagttgtgatgataatcgatggtccatatgactataccgaaaaggtgaaaatgatccagtaaccaagtaaaaaacgtaaacaagccgaaacgaaattgtaagagaaagctaggggaagtgaactcaccgccaaaagtgtcagtgaatttatcacatcggatgttaaatcctgaaaataggaaaggatgatcttagatcgcaagagaagttgatatgaaacttgcacaccctaaaagaaaatgaaacagcaggaactacacataataatacagaaggatgatcttagatctcaagagaatctgatatgaaacattcacaccctaaaaggatatgaaacagcaaaaactactcataataatacataatgtacccaacattcaacatttacttaaattaaactctcaacaatgagaaaggaaatctctgtgtggtcgcata

SEQ ID NO: 265 - DNA, 1016 bp, Zea mays
  misc_feature (1)..(100): optimal_loci_231404_G1, chr6:140703982..140704997, Cluster 2
tgactaagaacccatgtctttatattaccataattcactactcgacacgacttctttgtgactcggcaaaggttcaaaagcactcagcaaaaccttgtttgggagttgcttgtttagttgcactcggaaggccacatttccgatagtgattctaggagatcgaacagtcgaagtaacgagtgttgcttgtttagttgcatgaagatcagaggaaactgagggatatataatctcttgctagtcatttttgactagtaggacttatttgggagctagggaaacagaggggattggagttgaataccagcttccgattctcatacaactaaagactttgttatgttcgtgccatcgaacacttgggtgctgtttggttcacgaaatataatataaatggtaattgtttacactcgagtaccgacagtaacaagtttcaataggacgatatcaatttttagtgtgctatctaattacggttagactaaaataaacatggtttaacgttatcagttatccattatattataaatacttaaaccaaacagcaactcagtgtagtcgcataaagaaaagcgagacagagtatgacgatggcaagcaagcatggtcctgacttcgctccccgcaaccgtaccacgtgaaccagctggttgttggatgactaccttagctttatgggaaattccaatttggaccatcatatatataatctattcaaagcagaaagatactctagcagcactgctgcagtgtgcaaacttaagaaagttgagaggcacatgccccccgcttctgcttctcgcatcatcaagacaagaaaccgtacgtgcgtatagatttttaggatacgcatgtacggagtatcttgttggcgaattcccagccagaaatatcttgctgggaactggccgacattgcggagcacggcgaggcgaggcctgtgagcaggcgaaaggacaacaaaaagaaaaaaaaattgcgccctattatgcagcattctctcggacctaaaaaga

SEQ ID NO: 266 - DNA, 1089 bp, Zea mays
  misc_feature (1)..(100): optimal_loci_232524_G1, chr6:146410386..146411474, Cluster 2
attacccgttgcaacgcacggtcatatacctagttattatcataaaagtatatttatttgatgagagtctaatgatttgtttggcaccgtcacgccccacccctataattttatcttgcgtatcgcgatactaccaaatggtacgtgccaaccgattcgttcagaacctagacccatacgttgatgcattgcatttacggccgcccagacctatctagcggaagtccgtgcggtccaggggcaacgcccggcgcggccccggccgctcatccgcagttccgcaccggcccggcggacggcaaccacgttccccggccgcgtgcagtgggtgcgtgtcgccgtcactagtcagtactcagtagtcactggccgtggaggcgcgcgcaggtgtcgcggcgggatcggccggtgccccccgcgcacgtcgccggacgggtgggtcttcgtccgtcgtgccgcgccacttgggtcaccgcgccggcccgcgcgcactgccgcgcgagtgcgacgggacggcgcctggccggccgagcgcgtggtggtagtgcgcgtcattcgcgcgctgcgcggtggcgactggtcgtgtggaccttggtcgtcgcgactcgcgagcagtggtgcgtggtgcactactagctagagcgcacagctccgggccggcacttggaacgcagatcatttttctgaggttttgactctcacggtcacacgggcttagatttcactgtcagtggaggagcatctgtgcccccaatcagcaagcgtaccgagtaccagaatcggtaggttaggcgtacgtgcttgctttgttcacgccacgggcgcctcaaaaatgctcgtagctcgaagctaggctttcgccggaccgctgagcacacacggccgtgcgtccgtccacttgtgaaaaaaaatggatctttgaacgtacaaccgttcgctcggaaggtatatatccggctgcgtcgtgtaactcgtgttctgaggaagaagaagaagaatgcgtacgcgatgaccttcctgtttgtgtcactgccgatgccagagaggcccagagcgcagagcgcgcagctccgctctttcaccggctct

SEQ ID NO: 267 - DNA, 1050 bp, Zea mays
  misc_feature (1)..(100): optimal_loci_232894_G1, chr6:147967509..147968558, Cluster 2
aatcgtcaggaacccacaggaggatgcaaatatccttagacatgcgtccttgtataatgtcgtctctgcagagcagttttgtaatgcatatttggtaaatatagtagcatgttttacctttcaatgatgacagaacttgttgcagatgtgaaatacttgtgctggttatttgttatatatgaacgtcgtaaactaaactttgtgcaatggatatccatcgatatattctgacattattatcttggacgcgacaaagaagcttgcgagggatgccttctgttcctgggggttcgtgcctacacttctcaccgaggcgaactgaagaaaattttcatggtgaagaaagctccacctgggccatgtagcgaggagcttcgggctaaaagagtagccatcgcccatcgctggttggattcgaagctcacatcagaagagcagaagcgtgagcggcctgccaagaggagaaagaaagccgctaccgctacactctacaaagtgagcttgcacaaccacaaccgaaatgctgcatcgtctgactttggatcatgatgcgcgcccccttgcaaacagtttgtttagaaataatcagaaccatcaggccgattgtgttcgcccatggattcggggcagccaggagccagctgtgcacattgctgtaccatacctggtcaataggtagatctggagtgtcactgtcagagtaaacaattagacctcgatcacgggcaatctttgactttcattttcattaactaccaatgcacgttattgtatgcctttcatcactgtgtgtctgtccgtaagtaaaggggggaaagttagctgcaatgctatgatcaggtagattccagaagccaacaggcaaattccagaagccaacaggcccccgctccaacgtgctccccacttgtcctccaaagacaacctgccatgtgggccgttacgaccttaaatcatccatcccacatgtcagtgacggcaacccctccgccaaaagtgaactgtgaaccggacgatccaggcatccagctaaccgcttccccctcgtcg

SEQ ID NO: 268 - DNA, 1122 bp, Zea mays
  misc_feature (1)..(100): optimal_loci_234340_G1, chr6:154135204..154136325, Cluster 2
tgctcggctgggcgcatgcagacgcaatcatgattcatgtgtaatacagtaacaaatatagctactagttcgttatacggttgtgagatcgatcgaacattagcttagctttccagggtcgcgttcgtgcgtacgtggttccatgctgcatacctggcctggtggtggtggtggtgcatggtccatgattgctgggaatatgctatgctatgctatgctatgctatgctatgtttcgacacataagaaaacatcctgatctatctatctggaactcgaaacgcccgacgtcgtcccaggctcccagcagcatttgaggttttgctacgaatgtgcggtgtcgtagcattggattcgtccagaaatcatccgcggcggctacaatgatcatcagctcgcccgcggggagactgagagcgtcgtccgtcgtctcgtctccgcgggccacggcaaagctgccaagctgtctggcaagtggcatgtgcatggcgatgcataaagtagggggcagtgggctgacggcggctccgcgcgatcggccgtgcaccgttcgtcgctggcccggcccgcatgaatttctggcgtgcgaccgatggtgcaggttggggctggacggaggacagcgcgccgcgcgctggatgcatggaatggaacatcgctcgcgcgctggaagctgaatccagcgagaacatgaacagctcgctcgcggcggccgcagaataatcgcaggcttccttttcgcgttatccacctcggatcttttccgcgtgatgatgatgaaaggcacgttcgcgaggatcctctagctcatttcagcctgtgatacgggggggctttttttccaggttgctatcttttgctttcagcgtcgctggaccaccgttgcatgtggtaacatgcatgcgggttcgttcgttaaagtgacagcccaactaagagcttgtttgggcgtgtgtgtgtatatatatatccaaaagtatgttttaaatgtcttgtgccattttgatgtgatgctttgagaatttaatgataacttactctatatactagtagggtgcccgtgcgttgctacaacaacttacaatttggtacaaaacagtgatgcaatattattacaagctga

SEQ ID NO: 269 - DNA, 1147 bp, Zea mays
  misc_feature (1)..(100): optimal_loci_234379_G1, chr6:154325268..154326414, Cluster 2
gcaatgcaaactctctgtgcgactgcgttttaagagaagacaagtgtgttcgtgccagtgcgatgggctgcggtgcggtggttctggacctctggtccttgtctggcaagtgacgggtttgcccctgtgtgagtgtgagtgacagctgcggaaattcggaatcgggatttggccgattgggtaaaaagcggagccgcggagagtggtcacactcacggtgtagacgggcccagcggcgcagtggccgtgagggaacggaggctcactgtcccggacgtgtgggccgacgaaggcaatcgcgctaagttactgaaaagaaatgtgtccgttactgtgcagctgtacctgtacttagtagtgcactgccgtgccgcgacaactcgcaggctcggtaatactggctgtacgtcgagtaatcgggggtactgttgtctgattgcttcggattgaaacaaacggacagtagttgattgttgttgtaaaaaaaaaacaacggacaggtgtatgactgacgatcgtcgttcgcaacctgctactgttgaacatgcatgtgttcagtgcaaggcaagcggagctagcctcgcctctgctttgtttattagtatcagtgtgtgtgtgtccttctttggcagttatgccagttcggcgctaatctgttcgtccagaagaatccttacgggcacgagttctgtcgctgccgtgcgtgcactggcagatcattattatcgacgcaccaagcatcaatcaattactatacacgatcggtgtattagcggctaccctgcatagtgtcctttgggggggggattcggattttccaatgaatggcgacgggaaagagaaacatgcatgattcaaccatgcgcgccgcactgtttgggcatcacatggactgacgatcacatgcatgcatgattcaatcatgataggagcacgtagccttttatttgagcatagtatttccacaaatcggaatcctgcccggccctatgcttttgctttcgatcactcgcactctcttttgttttcggctctcgcaatgcgagtgggtgaaagtgaaacataacagggttgcttgattgcttctcgctcgcactagtagaaaaaggaaaattaaaagggagaggggattcagtgttccacgtga

SEQ ID NO: 270 - DNA, 1039 bp, Zea mays
  misc_feature (1)..(100): optimal_loci_234382_G1, chr6:154327143..154328181, Cluster 2
ctgctctggctcccgtcatcagtggactggttcttagcgacgacgtgcgcactgtgggccaagctcgcggtcgcgccgctgtctccgtcgtcgtagcagaagcttccgtgtgcggcgttgttgccccatgctgcggctgcgcctgcgcggccctccgcccccttctcgaggtcgaggcactcgaggagcagcgccaccacgtcggccatggtggggcgctgcgccgacgcctgctcggtgcactggagcgcgatctccgcggctttccacacgccgttgacgtcgtggctgcctcccataatggacgcgtccaccacggcctcgatgtcgtgtcgccgcgcgccaggtgctgccgtgtccactggatcacgctggtgggctgagggccgtgcaggataggaggcctccccgtgaccagttccagcagcaccacgccgaagctgtacacatcgctcgtggtgcttggctctggctgcattgttgcctggttcctacatgcacgtcgacgtcgtccacgtgatttttcgtgtgtcagtgtgtgcataagtgcggattaaaactcacgcgatgtgaggtcctgtgtgttgcttcccttaccagttaccactgtaccttaaaattactacttgtgacttaaaggttgatacatttcttttgtatttcctctattcaatatatattaatgattctaaacaaatttaaataaaaagtttaaatttaatttttttagatctttttgaacgctacaactttcgtttagatcatctatccatataaaattatttgaaaaataaaaaatcaatttcaaaaccattaatcttaacacaaaattttttagcactaaacaattataaataaaaaacattatcaactacaaaattgtatatctctttaagtattataagtttttaaatggtcaggcttttgaaggctaagacattgtgccacaatttatatggtaggaatgaaaagatagatgttacattacatataaatccaaggtattttaatgaagtggtggtggaagtagcgccgatag

SEQ ID NO: 271 - DNA, 1018 bp, Zea mays
  misc_feature (1)..(100): optimal_loci_235544_G1, chr6:159826778..159827795, Cluster 2
gtgatgaacaaaaatagagggagagaaaaaaaaaatgctagtagatatattttaaatcgattattgcacgtgttattatattccctgtctctgagctgttggacaggccatcgtctatctaattgattgcatgttttgaaggctttagggagaatcgtctgtagaccaacgtttcgttggcaagaggccgggagtaaagtgaccactcattttcaagccatggaaaaagcacgtggttttgatactactcctgaaaatcgtggcatgaaaatccagagaatgtgggacttgcaggcaagtcctgcaaaaggttacaaggaagaaaccaaatcactagtaagacagaatgcgatgggaaggaggatatgtacgtccctgcagcgactttgaagcaaggacttgggcactttggtggctatgcatctttcacgaggattggatatttggccatgatatttatttatttcagaaagctttagagtttgtttggatccatataacaaacggtttgtcgactaattttaggatattggacttcaagtattgttgactaataaattgcctaattgttagccgaaaagattggcaaattatttgactattagccatttgaccatgtgctaataggtgctaatagatcataaaaagaggaaaaaggacatctattaaactgacttaaactaggtcctatcttcaaatataagacctaagagagaaaaatggctttcaaaagaatagctattttataaatttgtatcaaattaatataggagtctagacttgaaatgtgttgtccgtggaaatggatcgacgggaatcttagccacatggatgtccgatgtgctgtgttgtatattgatttgcttcagtgatgtgcagtatagatactaggccttgcagctcaattttgtctatgtagaatctgatgagtgcctgtagaagtgccctgcgtcacgctaaactaatgtgcactgaatgtgtggacgttgtcctagcccactttcgtgtttttttctag

SEQ ID NO: 272 - DNA, 1055 bp, Zea mays
  misc_feature (1)..(100): optimal_loci_236016_G1, chr6:162476027..162477081, Cluster 2
atgtttttatgagattatgataggtatgttcccagttcccatgtgaagaaaaaattaaattatatcatgctatctatatttaaatatagttttataacatgttgatttcatctttcaggttgcttttatatcctaattttgatgtttgcttggaagccggagcttttgagtcatggtaatttcatctttcaggtatgtttccagttcccattgctattaatttgtcaaaaaagaattgcaattatagatggtgacaccattgtttaaaatcctagatccgcccctggatgaagtcaccagcatctaagtccagtgctcatgttgcattggactctgcacttcaacacttgaacctgaaataaattaaaatcagcgtgtaggtggacagacgctttttccagtagaccagtacagagaccaacctagattagtgcaaattgggccggttccagttccaaaccgctgttcctttcacccagcgccagcaaaaccagcggtttagccgccatgggcggagagctcgcaattcgcgacagacagtcgtatcctacagccacttgcgcatgcacttgcttcagaaaccatgtccaagttcaggccattgtcgtaaacaagagtttgtagtttgtaacagctcgtgtgcttactactactagtagtatttattctccagtgaagctctcaagttttggccgattctacctgcaaatcagatgccagaattcagaaagggagaaagccaatcagcacgcgtcagattctcccacggttcgcttacctccaatctgaatttacgttttccctatcttttggtctgcactgcatgtatgcaaactagcttagtgtgtgtccgcgcgcgcgtgttagtcttcaaaccgtagtcattagcagaacacaaacctgatggttcattaatcgacgtgactccttttgagataccgtgacgtggtgatggtgatcggaatcatcagaaagttgaagcatcgatgatctgcgttgttcacgtttcggggcattcgatttttttgccactttaatgtagcagccatttaact

SEQ ID NO: 273 - DNA, 1056 bp, Zea mays
  misc_feature (1)..(100): optimal_loci_238819_G1, chr7:9252485..9253540, Cluster 2
cgaggaggtggccttggccttgtctccagtgtctgtcgcggcgcggctgccgtgcacgtggacgtacgtgagcgcgtgcggcgcgctggcaagcaactgccacgtgcagtgggtgagtggcgcgctggcatgcacaggcgcaggcgcaggcgcagcacatcggcgagcgagacggggactgcgccgtacatgcaatgatgcaatgcaattcatgcatcgtaccgtacgtacgtaactactacaagtacaagccgctagcggtacgtaataagatggcagattggcagcatgcagcgcagcacgaaagatgcacgcactgacgcacaccatcaattctctactggagacgacgcgatgacctcgtacgtatatatgtcagtatgcgaagaccatcgtttacgtgtacgtgtactgtacgtgtgcgtgcgtgctgcaggagagtactacgtgatcgagtgtacagaaggaaagaaagtacgtacaactactagtgccggctagttgtatacggtcggcgcgcggcaatggccgggacgtgccgattgaccgacgacacacggcgtccgcgccccaaccccaacacggcaagcacacagcagagacaggtacgcataccagtacgtgtggcggaatgaatgcacagcactgcacacgcgcaggaaagcagcctgccattacatacagtactaagtacgtaaaggcggtttggatgtagatattggtacacataattgggaatcggaatcagctttttctgaattatggttgttttggttatacatagaattgagatttgaaatccgaagagtcaattccgtggtattggactataactagaaactcactctctctcccaatttagagtgtcacccctcaatattgtgtggaactagaccatctaattcaatctccaatacagtaacatccaaacaatatgattagaatttcatcttatttgaatatcatgaccgatttgatattgaaatcaattcaattatatgccctccaacattgacatccaaacgaatcactcatagttggttccatgcactatat

SEQ ID NO: 274 - DNA, 1039 bp, Zea mays
  misc_feature (1)..(100): optimal_loci_239044_G1, chr7:10690463..10691501, Cluster 2
gtaattggatcggatgcctggcacattgcttgtgtctttattagcagacaaagagccttacctgggaacgacgacgattatgccgctcagacattcaatcaaacccttgcagtgttgccttgaaatacctttctttacatatgctacaacacacaacttttgtaccagcaaccattgaagaattctttcgcttgctctataggcaaccaacccactgtccgcagtccgcctccgccatgcatgccaagtatgcgcatgtttgcggcaagtttcagtaccttaatgtgcttctacacatgtaccttaagataaggtttacggaaaccgcgcgcgtagtgtgtcgtcgtcatcgatgcaccgttctgactgaataaactatcgagctcctaatactataagacatggttttccaacatgctgtcgttgtggaacaaccgtgtagaatggtagttattggagcatctgtctaacaacaagggaagtttgagcggttgatccccaggcagatgtttctcttagacagtgtttggctctggagccagatagatagaacggctcccgtccagaaaattttgatgagtcaaataattcaacatttaagcataatttttttttctatttttagattcattccgtcctacatgaaatcaatccaacaaacaacaacgatgacactctggaaccaaaccctatcttaagagcttcacgccactcgagtagatgtgtttcgttgcaccattcaacatttgtgtgagttctaagtctcttcaacaaaaaaaaagggcaagaacagcccatccactttcaacaagtctacactcggagtcggacgtcgcctgtgatggacacgaatccatggcgtgcttttgcgcggtgaactattatgggaaacgaactgggtactgctgcaaagccacctttgtatcaaaaagcccgcagcaatctcagatcctgttggtgcattgtattgtattgaggcgcatgcagctctgaatcatgaatcgttatcggtacccatacagaatcatcgtctcgctcc

SEQ ID NO: 275 - DNA, 1245 bp, Zea mays
  misc_feature (1)..(100): optimal_loci_240402_G1, chr7:17716899..17718143, Cluster 2
tgggataaacctgttttgaactcatgatctcatgactcactgagaaagttctcatcactacaccgagcatgtccttctataaatcttcatacaaaaataaactaattaaaaatataacttatgttgatctgaagttgaaacaatgtaccaagatgttttgtgattcacattcagaaaaatacaatgaaacaatcacatatacactaccatatctaggccctaactatgtctcacacttatgcacatactataatgtttgtctaatttgtataatatctgatgagctagaatagttcctggatacattcttagctaatagaacaagcattacagttgctttcactttccacatttgaaagaaagatgttcaaactctggtcttgagcttgtgaccacctgtctatggaggaagaatagggcctctttaccacctgttttagaagctactccctttcttgccatccacttttgtccaacccgatgttagggttcatcaattactagaattatggccgcaagaagcactacaaaccaccagataggcgccaaattggctcttgctggtaatgcatgtctttccgatacctctaaatcctggtgcgtcaacatgaaacagaacaaaaagaaattgatgattcactgccatgatttttgtttcactgtactgcctctgtttcctatgaatgatactcatggtcatatgggagaacggtatctcaggatccatccaaattatggcatggaaggattggatgatttatattgttttgagaggagcgtactactgtagaggtcctctgtttgctccattctagtatgtgcacaaacgaccaacctttttgaaccaattttaatttgaaaatttcaattgctttgatgtggaagcgataaacaaaaaaactaggaaagtgctaatacaatgttacggttcctatttatgcttctgaccttctgtatagagtataatgtgtgttatgttgactacgtgtgtgtgactgtgactctatgagtttagagccaacaaccatggttcaaatcctcatttgtacataattttagtttctaccaattaaatgtggaggaacacgataactacggtggaaactggacccgactgagttggagagaaggcaagttggttacaaagaaatataatagttttttttataaaagtaaccacaatggaacgatggaaactggtgatttaatataataaagacttaagtccccaacccaagtacatcg

SEQ ID NO: 276 - DNA, 1385 bp, Zea mays
  misc_feature (1)..(100): optimal_loci_251643_G1, chr7:94028845..94030229, Cluster 2
ccatcacataatgaacatgacaatcagatgggggctcgatggtcgccgaacttcgactactggatagggatggcaatggatgggcacccgacggtggaacaaacacccacccgtattgacacttattacattaagacacacccgcacatgtgatacctaatgggtgtatttgcacacccgcattcgttgggtgttgggcacccattgggtgaccaacatttgtaagtattgcaatcttagaaagtagcaccacacattacactacaaataaaatataaaacatacataaatatatagatagtcaatctatcaacacaacatgtaataggatgacaattcacatgataacattgttttaaactcaatttagtcacataatagtgttgtatgaggcttaatgataggccaaatcaaacttctcgtatctcagattagcaatggtgaaattacacttaataaaataataattactatatatgttcaaatagttggtgatcatcataataaagataaacaatattcaaacatagtatggttctaaactctagtgagctaagacaaattcaattccttaaaaattaagacttaggataaaaattaagacttaggacaatataatattatttatggggctaattggacactcgtgggtgaaactctagacccgcacccgaaccatgggtctaatttaacacttgtacttgcacccataaatctaatttaacacccatacccacgtctaatggatgtgactgtcatcgactcatcctactacgggacatctttgactgattttgcgctgaacatgaccaaaaatcatattcttaattaaaaaaccaaaatacacattaggcacgatgaaaaatatatatctcaaaattctcagaatcgtatttttattaactatagttgactaaggccactgtactgattggaaagcatgggggtgatcaatgtgtgaaagagacacttttcaactacccaacactgacagtagcctaatctagcagaggtcgtctgtcgtctactctacgtgattttatataataagggatagcctacatgtatttttcaggaccggaaagcttaacctgtgccatgtgccagtacagtaccagtgcaagtgatgtgcaggaccgaaaatttcttccagtcgcagcccgtggagctctgaagtatctgacgtggtcgggtcggaaactcggaatccatgcggattttggcggcagcggcaccgaagctgccgatcaattccagcttggcaagacagcgatgcatcgtctatcgcagcattggagacggtgtgtagtcatcacaattgcaaagacgagactataaactttagattagtggcgtaaatacatgacgacgaagctagcaacata

SEQ ID NO: 277 - DNA, 1013 bp, Zea mays
  misc_feature (1)..(100): optimal_loci_254673_G1, chr7:111330504..111331516, Cluster 2
atccaatcaattaactatcagaatgtaatataacatcgtaggaagtataaagtctgtagaaaatgaaacacaaacctatagacgatgaaatttttttgtgagggtcactatgtaaagggaagatgaaaatgtacggcaatactctgcaaatgcctcagatttaagtttttttcacagcggaatcgctacaaagtatatttaacaccatcatcggcaatttgctcgagataatacaccagcctaaacttgtgttaaacagcctaatggtacacttgacaacgatgataaaatgacagaaaaacgaattaatcacattggaaaaagaacagattcaagaccacagtctgcctcagtggtagtgacaatttgtggatcgtcatggaacaattccgataatacgtgcattttttatgcatcatcggcagccaacgaacatgacaagaagcaagaccccgaaagaaagatacacagagaaaggagatttagttttggaaaagctaaagcattagagggacggccattgaaggcgagttttggatttggaaaagctaaagcatcagagagattcccattatagacttggtctatcatgcccggaaaagggttctgatgtccctgtcttgttctcatcacctgcttgcatccaatctcaatccaaatcgacaagaagaaaaacgataaactcaagcaaccaaagatctcagagcataaaagaaagaagagcaaagaccagcccgcagcacgaatagaaggatgcaaacaacatagtggagagtatcgcatggaaggcgcggctgccgtcggcgaggactgtgagacgaggcgattgttgggacatcgctccggcggccttatatatagctgtcgtcggacttcctagggttttccggtaggatgttgtagtttgtgggctgggcctattgtccacgagttcgaacgggcctaagcgttctattatcttctctgtttagtgggaaattttttttatttcggcccatgcataagttatacgc

SEQ ID NO: 278 - DNA, 1067 bp, Zea mays
  misc_feature (1)..(100): optimal_loci_255654_G1, chr7:116281714..116282780, Cluster 2
accggaaatgccataaaacgcatgatttgttttgaccacctacgtaccagtgttaggggtaacccatgggcacttcaccggcctcgccgacgtcgcgatggattctccgttccacatgcccaccaccggcggcaccaccaccacctgagcagtggctgcaccaccgcctggcacgatgacgctgccagcaggcttcctggacgccgccggccgcgcggagggaggaccggcagaggcagccgccctccgccgtggaggccccgcggggcggcgaccgatcctgcccgtggacgcccggctgcagaacgactcggtggacgcctccgacgcgcacgagacgctgagcgaagacgacactgctgctgcgccatggcgcagcagcgtggacgccgccgcggcgccccttgtcggggacggggccaacgacaacgtcggtagcagcctcctcctggccttgtcggccgccgccgcgggggcgttgtcctcgcgctggggtaggaggctccagcttgtccctgcccagcctccgggcggcgccgggcacgcggggagccgccgccgccggcatggagcgagcgaggtagcctacacctagccgcgctagcgaggcgaggcgtccggcctaaagtgagcttgtgacgatgtcgtgagcgaaagcgataggcgatcggattcggatgggcgggagcaggtgatgagcctgccggttaagtagcgcgcggtagcggccgcatgcagcgtgttgtactaggaggctagcagctagctagcaggtggcgcccgcggctgcctgtcttttgtattggtatacgtgccgtgcgtacgcgcgccgcggtgggcgggaaaggagaggtgatgcggacgcgcgcggtaggtgccacgtctatagtgctatacaaacctctggtgcagctaatcatgcggagcgccggaccgcgcgcgattagctcgtcaggtcatcagcaaacgctgcaagcatggatccctgatcgatgagatgcatggtgccccgtgcatatgcatatgttgttgtttcctgacccggtcggccggccggactatatata

SEQ ID NO: 279 - DNA, 1195 bp, Zea mays
  misc_feature (1)..(100): optimal_loci_256611_G1, chr7:121249059..121250253, Cluster 2
tgagtgagtgagaaaaaaagagggtaaagagatctagatggttcaatgtgatggaggaggattcttgtgtgtacaaaacggggtgtacgaagaaaacatatctcaacaggagtcatttgctggatggatctacattaatttgaactggtgctttatatagtgttatagattaagctagaaaatatgatggttttatgtgtttactattgtttagagtgccaagtaaacaaaatagtgatgtgacattggaattaatggagagagagaagagaatcacctttttagattaaaaactatctctacatatgaatcaagacataaaaagatacatagatagataataaagaaaaaaatatatgcatttggacaaagattattttaaaaaattacccagcgaaattatattttttaatgtgcagtacctgtacaatttaataaacatagaaactgcattagtttctagtatcaggatattgctgtctagcattcgtactgcatttatcagtcaaccagaaacggagaacatgacgagtaacaactaatcaactatgcgcatttgatcggcccgcctactcgggaggcacatatgattattcaggttgaagcccatacgcagattgaggggttgagcatgtaactgacagcccagttcaagatccggcccagttaaggggcacaacgtgcgtgtaacggtgtaagcgacctttacggttcgttttttatgggcctaatcccgcgcatgtacgggtaactctggactcaggctgtgctgcctcagtttttatttacatttaccatcgcctttattactactatccagcagccaccgcaacggtggagagcgaggcatcaataaaaacgtcggcggattcaccacggcgggcgatcttcacatgggaacgccgcgccggtgctggagacgaggtagcattgtgcagagagcctcctagccatctcgcaggtcaacacagagagcggtacagtgtccccgtggatttgagcgttggatccaatgtgtgtttcccagttccatcagtctcagaactgatattactctacaccactactgctccccccccccccccccccgctgttctccgttttcaggactcatgaaagcgtggattacacgcgttacatatacattgtcggcaatcaaagagaatattacactcaagagtcctaactgtaggag

SEQ ID NO: 280 - DNA, 1070 bp, Zea mays
  misc_feature (1)..(100): optimal_loci_256631_G1, chr7:121355434..121356503, Cluster 2
cacgaccgcgccgcaacggatcccatcgcgcctggtcgggccccgacgcgtgtgtgtaccaaaccacgtgtttattccctttaaccccgaaactaagcaaagggggagggccagcggcacgagggcgcttacgccgatgctaatcgcgtctcggccgcccgtcattattggctgcaagctggaagacgatggagcggccgtgaagccagagcccacgatacgacgtatctctctctcctcggtgcggcggccgtgaagctttcaagttgccctgaaggcgtcgtgtacttgcctataaattgaccacgatcaaatcttctattttttcccttttcacatacgattcggtaagtttgtgattcaaattctgcatacgggtgttgtgtggttgtaggggcaaaacgcagcgctgccggtaccccgtccgcggcatctccagccggcccactcacactcactcacccgtcgcgtccaggcggtgtagtctctcgtcgtctctccctaaccatctcccctccgaacagcgcggccgccgggcgtgcgtgcaggcaggcaggcagggggcgccgcgcggcggcactggccaggctcctcgccgggcccctaccggatgggccacggccttcgtggaaagcgtgtgcgtacggtggacgcgtgcgcgcgcctgcgctccgcacgtacgtccaccacgacggcgatggcagcgtgcgtcgcgatcgacgatccggccgtttgcgcatggccttacgtgtgccgactaccaccttggccacgcgaatgatcagatagagtagagagctgtcgggagaaatctcgtgggcgcgcgaagggaaactagctaccgatccgaaatgtcaccgttgttttttaagccttcctaaaataaatgcgaattacagttatatataatcagtatgtaacacgaaaaccattttcagaaacatgacactttacgactcattgcctgtttagcggagctccggctcctctagacatagctccggctctaacttctccaccatagctgctctaccatgagagtcgctgtttttttttcaaaccatttggta

SEQ ID NO: 281 - DNA, 1026 bp, Zea mays
  misc_feature (1)..(100): optimal_loci_256643_G1, chr7:121398470..121399495, Cluster 2
attatcgcacggggcagattgttttctcccacctgaggaagcatggacaacaaaccaaccttctagttcaacaagttcccatcaggagcaagtacaagaaaacagacaatgggttcagtggaggcagcaacagcaatcgaagcgtccatcttctccagcatacagttagttattagaccaacagcgcaatccagcttctttttttttagcctgacgtccattttggatcggcaaaacaccagcgtgtcgtgtgatctgaatcaggtcatcagtatgtatatgcattgcgtgcgtgagcggccggcgagggaacagccgcaaccacccctactataaactcacgggcttcaccctgccttctcggtccgtccaccaacagcaaccccatgtcccatctgccatgccatccatggaccagaccgtggaaaagggcagtcatacgagacactgctcggctcgtgaagggtttggtgccgctttccggtcaaccgcaggctttctcgttctcggcggccaaacgaggattcttcttggacgctcatatcatatcatatgatggctgggctgggcgcaacagagcacgtgatccgtgctgcgtcttcgctgtgcgccggtacaaaaaaaagcgcgcgaggaagtggccggttggagttggatcgggaggtttcgttctctgttgagggcttgaggccctgtgagctgtacagtgtagtactgtgtagtagtacgccgtacggccgtaggctgtgctgtgtccggatgcaaagggaaaggatgaatcaacggagtttggccgaaaatttattgctcattgattcattctatgtcatttattcggtaggtttgcctacggaatactatatttatttgtatgttctatctcacaaccccccccccccccccacccaccccaaaaaaaagtccaatagctgtggacaagccaatagagatgagaatcgcagaaactcgtagcctcctaggtaacattctgatcaacggtttgttttggtttttttttcctcaatt

SEQ ID NO: 282 - DNA, 1139 bp, Zea mays
  misc_feature (1)..(100): optimal_loci_257263_G1, chr7:124751903..124753041, Cluster 2
gtcaaatctggaaacgttcaactaactaagctcatccaccaaatgcttgtttggaagcacccagtttttaagaatttggttctaaacataccagtttatatcctagtttatagaaactagattctcagtcccttaaaaatcaagaaactagacttctctagctaaaaccagtttatgaaaactgaggtggtttcaaacattttaaactattttttcataaacagtttctaaaaactagagataaacattaggttattaaaaactatgttgtttccaggcctaaataaaaagctcgcgcacactggcacgtgggcccagcccatcgacgtccgcgcctggacgtcaaccgccagcaacgacgattcgcttctgcaaagatgtcaaacgctaagtaattgactccatataaaaacccaaggaactcggtgatgatgtacgcggtgtcgtaagcacttacgctctgaggatgcccaatcatgcgcaacgacagagagagagagagagagagagacagggcaggaaggaagaaagcaggaagcgtcgcgagctggtgacgaacggaaacgtgctgcaatcgctggactggactgctgtctaagctacgggtgacagcgtgaagcaacctagtaaactaagggaatgacgatcatgtttaggtgcagtaagaatggtgaccggacgaaattgtctagaactttacaagggacgaactgctagcgttcatgtgttcaaaagaagaagtgaaatttccagctgccatgttcgaccctaggagatctgcaggctgcagatgcgttcggtccgtgtgacctgattaatccagggagaaaaagagaagggacctttttcttagtagctgtctatttaggccccactcacatctagccgtccactaatattttacgttgcgatcatccctggttccatatacatctgctatacccttttttaaaaactagttattgctctatctaaagttaaaacatctaataattcaaaacgagacagttgtttacaagaaacatgagatatgcttgtgtctaaaaattaggcaatatatcaggtgcaacaggacctattggtgcaaccacgcgaccaaaacacaagcatgaatatgtgaggacctttttaaaaatatc

SEQ ID NO: 283 - DNA, 1111 bp, Zea mays
  misc_feature (1)..(100): optimal_loci_260134_G1, chr7:140577457..140578567, Cluster 2
tgctagctaattaaaaattagctaaaattagttattttgcatctaaacaatagagctaacatgtgagctgattatttagacaaagtgttcaacaagttgttagccaactgtctaaccaattttacctatttagtctaacttataactagttctagcttataaaaacacacgttaagcttgaatacatatgcatgtcatagtttattctagtaatttaagtgatttatacatatgaaataaattcaaacctcttggaactacatattatcttgcttgagaaaaaacatattagcaaacaagctccgaagtattcttagagccaaagatcgaaattatttacacgcaaaagtaagatgaaaccttttacacaaatgtcgagcgtgcagctcaatatatgcagttcttacctagttttgatttgaaaaaaaaagaagtaaaacaaaagcggccaagattgtgaaacgaaaatccctctctccccatttcttcattcttgtcccccacccacctccgtccatctcccacccctgtacacctgttcagccgatgttgtcgctgacgttgcccgggatgtgatcaatgtcgacgaggactccgcgccctaccctgactcgcgacattgtgtttcctcatcgtgatgtgcttggacttgggatccttgggtttggaggtgtcattggtctgacgggccgcttgggttttggctgtgggcgtagtttgggaatgcagtgagcgagctgagggcgcatgtggagatgattgtgctgagtgcggacggagtggatgggatgaggacgtgcgttctgcgcccgagcaatctcttcggtccgcgcgattccagcttggtgaggtttgttgctggatatgcaaggtctcccttgggcaaggtattccaatacgaaatcgactttgttactgttcaacttatcttcacgattcagatgtttagcagttgtcatcaatggagtatttctttagtgaaggacagatatatatatcaaaccatgtttccaacttgacatgcccacaacattatatcaaaaagaagaacttctcacgaaggttgagaaaacctccgaactcctgcccacccatacacagcagcaccgta

SEQ ID NO: 284 - DNA, 1398 bp, Zea mays
  misc_feature (1)..(100): optimal_loci_260602_G1, chr7:143406873..143408270, Cluster 2
tttgctattcgtttatttcagttacactgatcgagacagaatgataagaggtattttggtcttcttataatttatttaatatgctctaaatagttttagtctttacaaccaactatgatatagattaaactttagtttttttataatgtaaacaagagttccggcttttcgcatcagatacgtacaaccattacatgttaaatattgatttaatgaatagtttttttttaaaaaataaaactaactaaaatgtagtccttgaattaaaggaaccaaatatgcccttggttgcgaatgaagtttggaatcggaaacatggtggcgcacaggagtgcaggacgagacggatcaaggctgtggcgcgaccgggtgtgggggcatctacttgctttgtggactcggcatttagtttctttgttgctatgcggacgcgtgcctgttctgctccccgcccccccccccccccctcccccccaaaaaaaaaaccgtttcaatgatcagcgctgcagccacacggacacggtgacctggctccagcgctctacactttttttatacgccgctcgccgttgaagaagtcgttagcgtgctgtgcatgtgccatgacgtcgccgtgagctcattatcgcgcaacaatacgatcacgcgttccagaatttcacactagaggtgatcacgtacgctggcgactcgcgtcgcgtcgcgtccttcctcggttcggtttggttccctctcgagccgcgccggtctggttcctgctgcagccgtgccgtttgaggagatactatgccactctgcttgctacgtacagtacgtgacgcggtgcagcacgtgcgggatcctgtgggattttcgaggtctcggccagtacgaacacgatctgatgaaggcaccggctagtatatatatatacgatctacagacaggtggctgcggcggcggcgaagggccgggcgttgacttgctctactcgttgcgggcagatatgatgatctacgtagaattcatatcaatgggctcgtacgcgtggccctgtcaaaacggaggggttggtgtactttcttctcgctctttattataaaagttgagagacgtcagtcacgtcacactgcacacagacttgaccggacttattataatgttttttgtttcttccttgagaacggagagtccattctacagtatatatacccattgaatcgacgacacatgtcgatcgttttcactgactgggcgtgctatatatggtggtttagctacgtatgtgtgtacacatacgtggtggaatcgacgactgtagcaatatctataaactagtgaaattatgtggcagttcactgtggtgtccattcagtttcatggcactgtctgtcgttgacggcggggttggagacatcc

SEQ ID NO: 285 - DNA, 1008 bp, Zea mays
  misc_feature (1)..(100): optimal_loci_262896_G1, chr7:156199962..156200969, Cluster 2
gtagcttatcagttcagctgcttcttagaatgaactaaaagaagacaataagcagaagctgctcttcactatcttttttcagataagttgtgtcttcaacaagcagcagtcgtgccaaacaggaccaatggtaaatctgaaaactatctcatagtttatgggttagagtataactatccctatagagaattatggccaaagttgcacttaataaacaatctaaattaaaccgtgtcgaaaatattttggcaggaattagtatttagtatctttaatgcacgatgcctatgtatgatgtgaagccgaagattgatcgtagacaatagcgcctttaattctgatgacggttattggcgtacatatatacagttgtggcgggtctttcggcaacgcccaaggggttaacatctgaagtggttgccgagatataatgtgcaagaagttgcacacgtgaagccatcgagttctcataacgtgtatttcatggtgtttagagaactcgctgtctcacacgtggacaggagactcaggagacgtgttttaagggcccggccatgcatgcgcccatgccgtacattacatacatgaaccatgcatgacgttaggtgtggactcgatggccttctctctgctttgcctcgatgaagagtaaaacagagagtactgtccacgagatgatcaccgtgtgctctgctgacttggaaggttggatggctccatggatggttgtcgacctgcgaaagctacgcgtgaatcctcctgtggtgctgcgctggatgtgacattctgctccaccccccactcgaacgcgagaaatgaaagaaatgcgccccaacaacaggaacagcgaaaaagggagcctacattattcctcgtcgctccaacaactgaaaacgacaatgccgactctctcttttctttctaaggggtttggtctagagggagtcctttttagtctctctattttattttattttaatttctaaactgtcaaatgcagaaaagctc

SEQ ID NO: 286 - DNA, 1125 bp, Zea mays
  misc_feature (1)..(100): optimal_loci_264164_G1, chr7:162261795..162262919, Cluster 2
gtttatgccgcgttctgcacaccgtaggtttcggttgacgccatgagaaccctggcctggccatgagttgacgccagcgtgtttcgaactttacccctgcgaaatccctccctccctccccttttgcgacctagctagtgccactttgtcagccacccgctttgctctcttttcccaggctcagtcactggtagtcactttctcaggctcagtcacgcccccctggtagtgccctcggttgctctttgagtaccacacactactattaccccttctgctgttgtgcactcgtcgcaccagatagataaggcgcggcacgaccaggcaggcccttttgctcgtctaaccgaacgaggctggctttattaggtgacggttagatgagctgttttatttaagtaaataaagaaatttgcataccgctgcgcgcctccggtccggcgatcggggctcacctacccgaacctgccggcgcccaggatttggcgatccgtcgatggatgggaatgggatcgagcagcttgaagcgtagtagaccctgagcgcgctgggccgggcgctcctaggtctccggcctgacacgcgggcgctatcagcgccagcgagctccggacgcgacagaggagggagacggacagacgtcgccgtcaggcgtcgcggagggggaacggattatgaggcctgcgccgggccggccgccgtcgcgatcgccaattcaccacagcgggcacgcgacgcgagttcagttcaggcaacggagatcacgccacgcgcccgccagtactactactgctacgtagtacagtaactggcaaccggccaaccacagcacagccacagacgagacgaccctgtcgctgtcgcggtatccatcggagatagtacaaccgcgtcagcggcagcgtccacgccgaaccggcaggcggcaggggctcctttccaggtatctcacggcgacgaggacgcccgtaatacacgtgatacgacggcggcgaggaggttcaggcaacgccactagtggcctggcgcatgctcacgcctgccgcgttggaaaggattcatcaaaggactcgccaccagcaccacaccaagcttcccccaaactctgctgtgtcaggacaggag

SEQ ID NO: 287 - DNA, 1238 bp, Zea mays
  misc_feature (1)..(100): optimal_loci_265207_G1, chr7:168258410..168259647, Cluster 2
aagcataagtttaatttctgttcgagttcatatgaaaagttacaagttatgatttttcacgatgcagtgcaaaagaacctatccttagagaaagaaactaatatagatctattattatgctattatagcttgcctaataatgggagataaatatctaactatagattgctcactgaaagtgacctaaaggtttcattagagcaacttcaacggttctacttgcaaccttagaacttatttggtagatcaaactaaagcagaatatggatctatgattcccatggatcaacactagtgtttggtatagctctacctccctctatcttactctcacttagaacttctccaatagctcccaattgataatcccaaaacggtagtttaggggcaaatgtgaaaaacctagtccaacaactcatgatctatgttcccaattttttcgatgctccaaaaccagagcccctcgcggtatagatttggggccaagccaacgccgctctatttggccttttgtgtttcctgcgttaggtggggccaccacaaagggtacatccacgtcggctatcagggttgcacttggacctcccaccaatgatgctctttctcgtgagactgaggaggaagacaaccacttgatcgaaaacaaacaaatcgataactttcatagccactagtaggcggttgatttcgtggactcggagagagattggaagactttgggtcacatattggcttgtcaataaaattctaagtcgatcttgtgggctgtattggagtattttaaggagttattggagctgggtatgttttttgggcttttagaattttaggtggagcccaatatagagatattgagagtaaaaatattaggagttgttggagatgctcttagaccacacatgttaagaggcatattaaaaattcaaaaaggatgatattttcttcctcctacaaccttgcttgtcctcatacatgagcggagctcagctaggcatagccatgtccgagcatggggtggaggggcgagaccactgccgctgtcgctcgtgactaggtgcatccatgggcaggcacaaccaaggctgatgataaggtcacatcgcgatgtggtggagtgataggaagaagacgagaggaacagaagatgaatcattttgtggtgtaataaataataatggcaggtaaatttttagctccaccaaacttggatttcgtggagcatcccttgagctgctcta

SEQ ID NO: 288 - DNA, 1375 bp, Zea mays
  misc_feature (1)..(100): optimal_loci_265630_G1, chr7:170666036..170667410, Cluster 2
tgtcatggcatccacgtcctcttgggaactggaagagcccacgatagtagacagcagtcagtcaccactccagccaccacgctcggcccgccgccgtcggcatcctcgggttcaatcgtttggcccgcccgcccgcacgcttgtcgccagcctagcctgctggcagcagctgtcctctcgttctggtcggcgcgcggataaacaacaccctacccctgcgggctgtagtgtgaagaactaccgcgtgccgtcgcgttcgctggccggtcccagatgtggtggttgaggtagacgagtagcgacgccgagacgggcgccaagatgctcatggcagtttctggcgcagctagccaaacgcaattatccgcactcgctttctgtgcactagtggtggtggcggccgtgtccttgtcggctcgctcggcagtccgtcgtccccgctcaaattggaagctttccggtggttacgcggtacgggcggggcggcggcgtcatatctcttttcgaggcacgacgaggcggttggaggcttggagcgtgtgatttgcaagaggacaggacaggacaggagaacgcccaagttgaggtttgagcggcacacgtcgatgagattttctagaaattctgttgaggcagttagctgctggtgtccaatgcaggtaccttctcaaacagtgccgtcccatctagccactctatgtcttgaatttttgtatgattagagtatctagctgcagtatgataaacttagttacttaaaatctacatcactaaacagtaagcggttttgattctagaaactaatttttggtccctctattttattctatcaatggaggatggctggcggtcgagactgaaaccacgacggcggagtgaaccagcgaggtatagtgtcaccgcacctcgtcctcgtctttggtaccatactgcagctggagcttattttcgtttccttgcaacttccgcaagctctccgtccggtgggtgggtgccgatgcctgtactccccgggcttcatgtcgattcaggcgcttgagcttgctttcccgaacacaaatgttcagtttgctaattacctggttcgttgtttctgtacaaatagagtttgggtgaagtctgttcaccatgacactcagttatggtatttgtgccttttgactattggtttgtttggtgtgagagttgtattatgatgaatacacaatgtgaagttacatatttgattctgagaagctttaatgttgtaaatagcaagtatgtcctttttaccatttttgccagtattcaaggaaccatcagatcagtgtgaatgagttgtatacgtagggagtaatctgtagattgtatctgaataacaaggtatagatgagta

SEQ ID NO: 289 - DNA, 1185 bp, Zea mays
  misc_feature (1)..(100): optimal_loci_266128_G1, chr7:172945236..172946420, Cluster 2
ataattcatgtacaaagacttattaaccgcctccgatctgaattgtttgtctactaaagaataatttggtcagtatccgtctttactagccactgagccgtcgttgatgatcaatctccgcggtcatgttcatactcttctagagccatgattctttggcatcagggacggacgcggagtgtggtgcgcggtagctagctctatccgtgtgtttgcgtgtccatctaacacacacagtcacaggctcacagctgatctgagcactggtgatcccgtgactcgtatgactggtcgttgacgcttatcttgccatcatccgtcaatagctagcacatgatggtcacgtgccggccgtaacaagaattgcatgcacgcgtcgctttcgggtcttcggggcctttcggcgctctagatgcatgcatgcatgcatgcatttcatatgcatgttcccttcgttaaccgttgcaaaccaaaggccggccgccgccgccgccgccgacacacgatttcaggccgattgagggccgccgacccgaccgacgatcgtgcgtgcatacctactttgtccggtccatgcttgctgcctgctgcatggacggacagggttacccatcctgttttctacatgaatttcgcccggaaaacgggattttgcctaatttcgtatttcttcgactagtttacgttttcaagtttgactactcgaatttctctgctttctgaccgagtttcagtgacttttgaccggaagacacagtttggtagaaaaaaaaaccttagaaattttggtaggatttatctatattttattaaaagtcatgttgtacaataaataacaatatattcacaagtaattttattcacaaaaacacataatccatacatataaaaaaaccacaattttagtgcaccacacacatcagtagaaagttacagttgtgtcgtacaagtgcacataaagttttccataacacatattgtccaataacacaaattacaacgcaaagcaatgctcgaacgataatgcatccacgtattcaactggagtcataatattcaggcatgttcgaagcatctgtgtataggcttattccatatacatattctcctatatagttataaaataaccttagtatctatgagagattagctacttcttgcgcatttggtattgcctaaggcccc

SEQ ID NO: 290 - DNA, 1013 bp, Zea mays
  misc_feature (1)..(100): optimal_loci_268316_G1, chr8:7983910..7984922, Cluster 2
atggttctgtttttgcaagctatgtggccatcttctcttcccaaaaagacccaaaattcgtatagtatagatatagactcatattatatatcgttttgttccttgaacctagttccattatacacaacgaaagtatagatgtttagcagacaagaatgcttttatcttgattcaaagtcaaataaaaaaaataatcgcatcgacttttctttgatagagaagtttcacccaccacctttgtgcgttagggaggccgatgttcttgtgcaaggatcaatggctgctacttagtgcgttgcgaaggtcgatgactggctacaaacaaaaatcacgcggatgcaaatattctatagaggagtttgaacaaatagaccattcaaacactatcatatgaatctgtttttacaagctatgtggccatcttctcttccaaaaaatagacccaaaattcgtatagtatagatatagactcgtattatatatcgttttgtttcttggacctagttccattatacacaacagaagtatagatgttctgcactcaagaatatttagaaagtagcatttcctattttttttgttgttgcctcaaaatctgaaacacccagagtgcgaggtggatatcatgagtacgaaacttgtaaagttacaatattttttatagttttcccttggttatgttactttggttgtctctctaattccgaggggtattatgttgtcatttggtagttggtatccattttctatccaaacccatctaaccatctcgtaccaaacaaaggaatctatatcccacactcatctcttcctatactatttaaatttccatttcccaagccaagattacatctaagtgccacccttgtgttccctagtcttccatccaacatcgccattgccaagaaactatcatagcaatccatgacctcctagacttatcaacgatatgaggttgccagagtaggtgtcaaggtgcccatgcacgagcttgataaggtgggacgatgaac

SEQ ID NO: 291 - DNA, 1195 bp, Zea mays
  misc_feature (1)..(100): optimal_loci_269931_G1, chr8:16737935..16739129, Cluster 2
agggcatattctctctctcccctatcgggagggggacatgaagggagaaaaatgagaaacgttggaggctttcagtgcactcacacgaaacttggtggcgcggggaggggggtggagggagcctgaggaaccttcagagcctgtcttaacattgctcggacacaatgtctccttagttaatgatttttagcgacgagattagcacgaatgaacatagaggaggtttaaggcccatttgtaagagtggtttatataaatgaggtacttccaaacataccaatttatacttcagtttctagaaactggattttcagtttataagaaacctataagttgacctccggctttcataaaatcaatttatgtccgataaattacataatgtcgttagttggttgggtgaaaattatgatgattgtcatcactcttaggtctatgtatgcaccccctcgatgcctgctctatttgatttgaatgtttaattatcatttcaaaattttgaattaaaaaatatgagttcaatgtatattcaaaatttacagcaaagaaaatagcaattgaatcaattgtttttaaaatagagtaatagactaaaaatctaattttcaaaaaattaatgtgttggggaataaacctcgcttatcgtgcggcagctttgggatactttctggactcttcccttactagtgaattggtcgcgccttgcgcgactcattcaccgatatgtttttacattttaaaagtattgcaacataatcatacataaatcaatgattttgtgaaactaaaacaaagaaagatagatttataacttgtctgccagttgatgagtttgctatggctctcctcattcctcgggttctaagtcaatcactgattttgatgctgctagacaatagttatttcttgtacccactaattttccatgcacataccttatcatcaattactctcatattagatggtatgtgcacctgctcatgcactcacactcacacaaataactcattaagggcttaccctgtttggtgatataattgatcagtgtattatctcccaaattagttcacacgggtcgtgactgtctgtgtctagacctccacacgcatcaatacctcgaacaccacatcctcccccagattcggcaagctgaccagctcgtaccctccggcctcagaacctggtggtggctgct

SEQ ID NO: 292 - DNA, 1185 bp, Zea mays
  misc_feature (1)..(100): optimal_loci_270813_G1, chr8:21862947..21864131, Cluster 2
agactttagtataccaaagtggataagaacaagctatcggtttcttcgccaagctgaatgaaaaaagtagaaaacgtccgcttttagcccctgttgggcgttgtagccggcgacccggcgttgtttcgaggggcgcctcctctgtcctctgtctgggtctctgtattgcatttgcgaagcacacagccacacacaacaccataagcgcggctggacttggcagagcagagggctgaaagcgacggagcgagccgcgcccgcgccaaaatgagttgcccgcggcgggttctcactccactgtacaagcgtccagccacagccaggcagcgagccaagccaccacctgcgtccagccacacggtctcacaccccacggctctactgcctacgggctacggcggggggacgggtcgggggccgcgacgtgcctgcgcgccccgtgccgtcggatccgcgcgtacgcgacgtgggatggggaacggacgctccccatcatgcccgtctcgtccgctagctagcgctttggctttgggaacccgcgccgcacctttctctctttctttctgcttcttgttccttcttcgggttcaggggcccgctcgccagtgagagatagatacatacgagtagagcggacggagccacggaggaactcgccggtgccatgccagatgccacacggcgcttcttttcttctttgtttttttgtcgtcgttcgctttgctttatttacttcccgcggccgaattcttctcttctttttccgcgctgtgcgaggacactcgaactcgcttttacgcttcacatctaccgtctcgcgcacaagccgagagccgcgcgctgtgcttggcatggcaagcccagcgccagcggatcgaaacgaaataagtcttaaatctatctctagtcaaaattgaataaaactagatttaattctcctcaggacctgtttgattgttctggattgggtctaagatttattccacctgatgagatcttatataaatttagataatcaattcgaacgaacatgctctcgatcttcttggatctagacacaactaaataagtcttagaccttgttcagtttcagccggattaaagggtatcgagggacattaaattccttttattcaattctaattacaaatagatttaatctcctccaacccacctctaatcgaa

SEQ ID NO: 293 - DNA, 1065 bp, Zea mays
  misc_feature (1)..(100): optimal_loci_274354_G1, chr8:45256708..45257772, Cluster 2
agggaggggagggagcggggggtaataggaccagtatgtctccttcacatcgctacactcaagattattttctctggaaggaatggttctgtttcactctgcaagttgcaactactgcatcaagattacgtattggcaacttttgcaatacaatagtgcttcagtaccccaccacttttcaagaatcgtgctcctttgttttcctcgaagactatgctgccacttcttgtgaagcagtttttaatggtacgtagagttttcaactgtttttgtaagggcttttggaaagacgtcctttggtaggggagtgatgtgagctatcatccacttcgagtaaaggctaagcagaagattctaacaaatgtttcccttgtcgtaaagttaaataggcattttaataacagaaattgttgttgcatgttaatgtgacatgtaaatgcaatatttacaggtcacattcacggaacaacatgtgtcatttttacactttttaactaatgtttgtgctattgttggagataatgtttctgtctatccatttttatttatgctaattaatttctctgtaatgcacttttttgttgaacatgcttgtaattcaattgaacatttgacctgttcaacatgggtgtttgccccctttgccagcttgaccatgaacatcgtaaaagctatgtttctatgtaaaatatagccaatggtatatgtaaagctggtagaccatcattgagagctaaagttatctataactttggttgttgattgttctttctctagttgctgactgatttagttatgtcttcaagactctaaagtaggaatttaaagcatcaaaccaagtcttctacaaccttggagcagttgcacctattacctaggacatttttttgatgtgcaggtgtgttcaccatttctggagtcatagattcgtttgtatatcatagtcaaattcgactgatgttgtcttactatttgctgcaattaagtagcttctgttgcagctccaagttccaaaaattcactgtggcttttcctctcgaactcaacttgattaaacatcagcct

SEQ ID NO: 294 - DNA, 1218 bp, Zea mays
  misc_feature (1)..(100): optimal_loci_285863_G1, chr8:119748369..119749586, Cluster 2
caattatttttaaatatctcttgcattcacatagcctcagcctcacatgtatgtggtcttgaacagggttgatgggtaatctctatccaagctctttgctccacagtatcttgtcttgtcaccttaacatctgacgtctctaatgtgagtcacatgcttgttcagaatttacaagcccatagttctgcacaaatattcactttcatttggcaaaatataaaagggtataaatgatgtactgtcttttactttcgttcagttcatcgatttggagtcttaaatataaattaatgatgtaccggcttggcggtggagttttttcaggagttttggcacttgattaagaacaatatttttgatatgtgcaaaaaaatttataatgggtcattagatatcaagaggcttaactatgatgtggttattttgccgcctaaagttgaaaatgctaataaaatgaagaattttagatcaatcggtttactaaatttttgttacaaaattatcacaaaaatgctcaatagtaggttggttgcctacattatcaaagtcatcaatgaataccaatatagtttcattaagatagatatattttggacggtgtggtttcccttcatgaaatcattcatgaaggctagcaaatgtgctgcaaatattgagttgcacagagatgctctcatctataccattcagaggacatggacatggtagtggaactcaaacatggaactagggaacatagcccctccgtctttgccgatgtcgtctcctactctggccgtcacggcccccggtaccatccccctcgcagcaggtggtccgcggggcgccgctcgggcacattttggttgtgtggccgcctgaactctagagaggcgtggaccctgtctggtaagagccttcatggatctctcctttcgctacgatgtcatcttcattttcgtcggtgaggttcggagttccttcagcttggcggcctgggtgattgtgatttcgccctaggttattgctacacatttggatcattttttccttagttttggtggcgttggttgctacgtttcttcgctcttgagattcatggagcggtgatttaggcgttctctcccaaattatttttgaggttgattgctttaatcctggttcctcaccttactatgatttctggaaggcatgaccgaggacacaacaactggtatgaatctaaggaacatggaggga

SEQ ID NO: 295 - DNA, 1202 bp, Zea mays
  misc_feature (1)..(100): optimal_loci_28905_G1, chr1:177037718..177038919, Cluster 2
cctcccctgaccacaactagaggaggggcttgatgacgggtaacctaacaacgaggtacattagagggataactatatgctgagacttctaagccccaaggcctattggacactgaggtgcttcgagggctcaaggtaaatagtaccccaagacaacttgaagaagaataatctaagtcccaaatcagccttatgccttggaacattaattaacaatttaaagcccccatggcccgtcatgcctcggggcgctataacattaatcccatagggcccctcattctcaagacgctcatgagaataatcctaagtctatgtggccacttgttccccggggcactatgtaatataagtgttcgggtagttgaggtcctaaaacacacaacgactcttagacgctagggacctttagctagccccaaagcccttaagcttgatgcaccgtgagaacaagggacctagtgagcttaagtataatcatgtcacaatatagaaggatgtgtctgggcccacctaggacaatacaaccttgagaaatggaccccatatctaagatggtgataataagtttataaagttaacttagtggataagacttaggtacaacatattaaatgtgatgtgtgacattataggcctaacaagaatgttttgccacgacttaggtagcaggacactcaagatcacaacaatgtacgtgcatcgatcatgtatccatgcatgcacatgcgaagtgtaccataaaacattatgaagtacaaaaggctacatcggctaccaactaaattatactgatagcacgggccccaacactcgatgaaagtgacatattgtatttgcccctttaggaggtatggcaaccgataggaagagaaaatctctgacactatgccacgaccaatggcatggacttcgatacgactccatgaatatgataagaacgggctagttttgccttagtgagtggactttgatggttatgtaacctctctcctctcttgcactataaaggggatggggtgagcaatgatttgggattcgatttaggaacatcacacgagattcagaccaattctatcagattcggacatccttgctcaagaattcatccaggaggcaagcataaaggtggattaggacagttataactagaatccccaccatagatataaggtgagagggagccaaaagatcttgatgtt

SEQ ID NO: 296 - DNA, 1018 bp, Zea mays
  misc_feature (1)..(100): optimal_loci_292069_G1, chr8:153011615..153012632, Cluster 2
  modified_base (310)..(310): a, c, g, or t
  misc_feature (310)..(409): n is a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
cttttgggctcgattctggcaggaagtgattcccctcccactcatctcatctcttacgtcacctaaaatccatttactacttttcctctccacaccaaactctttcttggtgtccgcacaccatgtcatgtaggagtatgtttttttttctcacgagaggaagatggaagccgcagtgaaaattttactgcgcacctgagagtcatgagaaaccatggaaattgcgtgcgcggacctgccggagggacaaagcagaccttgcgctagtgctatttgccgttcggtcgggtaggttagggggcgtgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaaaaaggaagtatctagagattcgtcgaatcatggaatgcgtgcgcggactgcggagggcacaaggcaggaaaaagcactagtgctatttgcgttcggtcgggtaggttaggtggcgtgcgtacgtccaatccaagtggcaggtcaacatgtagtagtaaatttcagctgctagactaattgctagtccaggcgagccacaccacaccacacggaagcaccaagtgccgaaagtggcgggggcttcatcatttggattcgtcgcgcaaccgtggagcaaggaggagggggcaggccgccgaaccattggagcaaagcaagggcgatcgacgacgcgggctcaggattttgcatcgcgcgcgtggcattccggagcaaggaggagggggcagctgaaaaggccgaaccgttggaggaacgggacgacgctgacgggtaccagccagcgagacgtgcctttccggagcatccgtgatgccgccgccgcgccttcctctgattgatcagatatacaaatacaacctgcacggactctccttggaccttggccactcctccaggtaacttcactctgcaggagaggaggtgggtgcgtgcgcgcgtgcag

SEQ ID NO: 297 - DNA, 1360 bp, Zea mays
  misc_feature (1)..(100): optimal_loci_292070_G1, chr8:153012679..153014038, Cluster 2
  modified_base (773)..(773): a, c, g, or t
  misc_feature (773)..(872): n is a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
  modified_base (787)..(787): a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
aaagtcagtagggcccccagtccggcacaaatagatatatactcttatatatatatgtatggtatatatttattctattcccaaaatccctagccgttgctcgctggtaaccattgctaaagatattgtaaatgatattggtgtaaatacatcatttccagtaaagcgtaaagcggcgagaaagaaaacaatttgatgaaaagtagttgccacgaagaaattcatgaaattgagagagcttttgaaagtcaactattttttggtattagttgatatggcgagcactttctttgaggaccagatttaaaaaaactctccatgtttaaaggtatattcgagttttttattgagctcaagcaaactaaggtcactaaaatgatagagaacttaaagagtgttgcactaaatttgcaaacactttctctcatgatggttcatgtgatgttgagttaaatgatttgatttctaaatacaacctgcacggactctccttggaccttggccactcctccaggtaacttcactctgcaggagaggaggtgggtgcgtgcgcgcgtcggcgcgtgtcagcatgtgcgtccgggagagggtaaactacttttgcctactggcactggccaccaccgagagagcgtgaacgagtgaatagagtaataaaatatttcggggcgccggacacagacgccgacgtgtgcgggtgggttctccaaaactgcccgcttcgttgtagacccgcgcgcaccggacgaatctcttgatcgccaaaggtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggtggactgatgattcaagcttgattcgtcgggagatggggaagaaaaagaagcacgtgctgttttctaagagtagatgtacgaagaaagagaaaggtggtgatctgatggacgtgtacatacatacatacatacatacagacgcagacacttcgggctgcaccaacctcagttagttcttcaggtcaattcaactctgaaacgcaggcagcggtcgtccccggccgggactggagcgagcaaaatcgcagagcggactcggttcattcagccacgagctcggccgcgcttgcacgttttcaattggtaacgataacgcttgctttttttgtttttacttggtggactactggacttcagcaacacgtgctcgcttgagagtgagagtttttttctttccttcccagccccctttgtttatatagctgcgtacactgtaggtagagcgtacgaaatgagtgcacatgcccattttttttgccaga

SEQ ID NO: 298 - DNA, 1044 bp, Zea mays
  misc_feature (1)..(100): optimal_loci_294091_G1, chr8:163311970..163313013, Cluster 2
ttatacataattactagcttgtcattgctctattttaaggagtgacaatagatatataaataaattgccgggccgggttcgtttggcccatcgtgccaccaacccccggttccccagtggtccgccggcgatcgagccgccccacgcgtgacgcgccgtcgcaatccaccacggtccaatgccgcccgctgcggtgcggtgcggtgcggatccccccgcgcgtgcgtgccacctgccgcgccgcagaccccgcagcaggtccacccatgtacagtactgtacggcggtaacgcctcccgagtcccgacgggcccggttttgtcgccggtggcacgaaaggcgaggagggtggcgcgcgtcgtcgcggcttcgagagtccgcattgcggatggagcgcgacgcgaggcgatacgggatagcggcgcaccaaaaccgtctgtcgcaagtggtttccggaggcgtccgtccccgtccacggttccaccacacgtccacagacctaaacctggcgctggcgagcccggctcgttgccgggcgacggcacggctccttcctcccgtcccgtgcagtgtgcacgtacgtacaggtttagaggtgcggaccagggtccaaagcatgacgtcggctcgctcaaaccagggcaccagccaccaggcagtgcaggtctctggtcgcgtggcggcatcgctgcgtctgtgcacgacggagcccggaccgctagctggaccatgaccgtctctcgcaagtgcgacacggcatctggtgctggggccgtggaattcacgtggccgtgacacataccggagtgcggttcaccggtcgccgtcgtggttttcctttctgaacggagacgaaagccatgggcagcttccacttccagagctgtgactcgtactcaaatccaagtgtgcgatgcgtgcgccggaaaggcgaggagcagcctttattttacgtggcagccgccgtgggtgactactgcctctgggctctggctggctattgtggaatatacttttggtcttccacggctcgcatcggtgcgc

SEQ ID NO: 299 - DNA, 1045 bp, Zea mays
  misc_feature (1)..(100): optimal_loci_294297_G1, chr8:164622545..164623589, Cluster 2
cggagttatctctgcagcaggtacccatagtaatttatagcgtcatcattagtactcatcactctcctcacatctggtgccttttaactaccggccggcgaccatcgatggcgatagatccgtcgtcgctcaagtcaagtcgtcacaccgaaatgtgaacagtggtcgccagccgacggacgcaaggaatgaacaggcggggaagcgacgggcgagcgtgcgtggcaagtggcagcacgtacgcagcagcggccaagccattggccgaggacgaggcaggcgcaggaagcgagcgagacaagactggaggagagtgacggcggcggcggcgccggcagccggcgtggatggtgggccgtcgtaccgatcaaacggcccagaaaccccgctgggtggaccaggggcggcaaaagggatgctggcgccgcgcggtggggggcgtgggtcaggtggtctgcctggcctcagctagctgaaggcagcctgacctgatcgagcagctggggggggcccggcccgtggccggctgcgcgagcgaggagacgtgtgagggcgccccgcgcgcaggcacaaacaacaggcacaggcctcgtgggcgacgccgcgcgcggcaggaggcccgcaggccgcccaagcattttcgcatttaacgcggcgcgaccaccaccgccacaggatggaccgcagcggcccgggcggagccgatgatgcgatgcgatatctcctcgactccccctgacactcttctctctctctctcttctctctctctgtctctgcgcctgcaccctgcccctgcggcgtactacggccgcactgtgctgcgccgctcggctgccaccgtcggtcgtcatcattgccgccgggccctccggccgatcgcctccctcccctatcgcaacaaacaatctgcttgttgttccgtccattccgtctctgcatgcatccatcccgattgcattgaattgaagtggatgaatgcgagtaggaaggaggggggtgacgagagtacttgtaccacgaccccagtccccagctagccaaca

SEQ ID NO: 300 - DNA, 1056 bp, Zea mays
  misc_feature (1)..(100): optimal_loci_296573_G1, chr8:175213331..175214386, Cluster 2
agagagacgaagacaagagaaaaaaaatgggaggttaggagttaatatacgatgccaataacgaggagggggaagtacctgtggtggttgcatggttgattgcataaggcttatgttatcatgttgttagacgagacttaaagaagaaatcagatttacgcgctttgcttgtgacatcaatttaataaacttatttagtcgtttagttcttatacatgtaattatttttataaatagattatatttaatattttttattagtatctaaacattcggcgtgataattagaggtagacccaggacaaaatgagagtgggagcacacttaaaatgatgagcatcaaaacaccagaatgagagcatgatcgagggcttatggcatagtgccctcactcaggcaacgtaagtccacccctgacaatgtccaatgcctaaagtttagtcggcgtattaggtaagccaattatgttcctaactgcactaaattctgtctcttcgtcgcgacggtctccggagactggtcagccccataattgtgctccgtcaaacacgtaattagtcaagaactgtttgccccatagcgattatacttggcatttaaggtttcctataaatgaatgacagaaatccaagtttggcaccgtagattttctcagccatctgtcagatagaagcagaaagcaaggaatacacaaataaacacaatttcttttagtttgggtgaataaattcctgaaacaagtgatgacatctactcaaaatcaaaataccagaaacaagagaacatgtctcaaacctgtttactaaggatgtggatcctcccaagcaaagccaaatggaatggttgggggcagtagcgcgagcaaatccgtcgtgccagtgtgcgaacccaaagctaaaccatcagctcctgtcaccatagtggatgatgctacaccggtggaaagcataggcatcgatgatgcagctccggcgaccgccggtggagaccacaatgcgccgacgacagaggtgtggggagagttggcaggtgggcagcagggcacgccggcagttt

SEQ ID NO: 301 - DNA, 1025 bp, Zea mays
  misc_feature (1)..(100): optimal_loci_29982_G1, chr1:183814890..183815914, Cluster 2
tgtccttcttgtcctttggatggttgagtgccatggtcttcttttttgtcgttctccttgttttactcatccatttatacactgtatgtgtcttctgtgatcacgtcacccaatacttaggtaggatctatacaccttttgatttgcctctcataatgacaatggctgtagtattaaatcttggaaacaaacgtctaaaaaaccaacgagagaaatcctcgtcatccacctcgtgacccaaattactttgttcaatcacaatgacatgaagcctatgaaacatttctctatgtagaagaaatagacatttctaaatagtatctagacatgcatctaggaccatggattagaaaacccgtgaaaaccagtccagtttcccattactggatcagtaactgttttccaaccatttttacatgaaacctgttaaaaaacagcagaaatcgacaaaaaaaaaagagagagagtagtttctcgccgagagatccgagcaaccgatttatttgactttgtaatgcaaactggtcaaaaaaattaaaaaaatgaaaataggtttctctgtcgggaaatagggattcaggccgagaaacacgcttctcgccgggactaaaataagttttttgtgcgtgcccgtcatcggtcagcctgcaccgctgcaaacgtgacggctgggcgtatgtcgcgagcttgactgagctccagattttggatacgccaacctatacgcgtgcaacgagccaacgagggtccaaacaaatgcagctttaaggatctaccggtgcaaggaaataggtaaccaaaacacaaggcatgagaacgtgaatgattctttttttttaaaaaaaaggtgtttggattttggtccactccctgccacgcggccacgccaccgttacgcccatcacggtttcccgtgacgcgaaagctttggctaccagaaaaaaaaaagcaaaatttgtatctgctgtatctgcaagaagcgaaagaaaaactcagaccggtctaagagcgacacggtcgtcgat

SEQ ID NO: 302 - DNA, 1372 bp, Zea mays
  misc_feature (1)..(100): optimal_loci_301852_G1, chr9:24140199..24141570, Cluster 2
cagcctcaggctttgcagcaacagcctttcatcaccacggctatgggaagaagctctgcaggccgtgccatgcatgcatcgatcacaactcacaaggccggcatgcacaggcacagccctctctctcagctagaccctctgtctctcatctcatctctgtgtgtgtgcgcgtgtatgtgtgacaacacgagccagcaggccaagcagagtagcatgagccatcaatataaatggagggaaacaatgcaaagaaaaaacaaagcagccaggcacaggaactgagtggcacgcacgacacacccatgccacgcacaccgcatgcgaacaaatatgaacattccaaccgtctctctctctctctactctcgctctgaatgaaagcagaaagatgaaaggagaaaggagggcgcaatgcatttatgcatccatccaagcttgcattgcattggcttcaatggatctgacttctgagccagccagccaatggcctgtctctctttcccttgcgacctggcctggccggccgaaagcctagccgcccgcaagcccacagcggacggcgacggctgtgtgcctgtgtgtgtgtgtggtgtgcagtgcagtgcagcgcgcactgtgctgcacgcgcaaaggcgttgctgcatgccccctttgtacctgccgagcaataagtggcagcttgagctgggcaaggccaagcagagcagcccacaacgcactcgatgcgtgcctgcctgcctgcttgctcgcaagccgcaacgcaccacgaggaaaggccatgcccgttcactcacgatccagtcgctgctggattgcatgtgtgcagcagcagctctttgtcgatccgcaaccacgcgtcgtcttcctgttcttgctccgcttggtgtgtgtttcggttctgttccggtgatctcaaacaactgtacagagagtcagggtaaatgcacagatctagagagagtgtgagacaaagagttttttttttgagtggcaggggaggggagtaggggaccgacgagacgacgcgcggcaagtcggcaacagtgtaaaaacaaggagcaggagctgttcccacctcaccttcctttctccgggtctcatcacatgccaagtctctggaagttctcaaggtttcgttcgttccgctgcaacaacaggttcaggctcttgttttgttgtaagcagcgtgcagagactagaagcacagtggactctagtaagactttgcagaaaggggttacattagaatgtctgaacaacgccggttaaagagtagtgacctgaaagcccaacaagccaacaacagcaccagcagcaacaagtacagtgcgcacaaccaaggaaagaatgctgccgtcctgcctgcggctgt

SEQ ID NO: 303 - DNA, 1293 bp, Zea mays
  misc_feature (1)..(100): optimal_loci_302109_G1, chr9:26608836..26610128, Cluster 2
caaagagcctacaatgacctattcgattgaatgttagcttgttagcctgctcggcttcctaatgagtagacctgttcaaacatcggtggtatcgtgggccattggcacgattcatgtttaacccatgcattgtgttggggtcgagttgttgggatagtttttttagcgttaggtcgagtttttttaggttggatcaagtttttagtcaaaaatcataggccttagcagacttgtggattgttacgggtcaaaaactatgattcatgctcgcccgttgtattggtcgagtcggaccaggtttttttttgcgggttgaggtcgattcgagtggtccatgatcaaacttactcatgagtgctaattataatttccaagatcctgacaactatcggtgcattcagtgtgctacaacatcgtccttttagcctcgccaccacacaaaagtcatgtggcattattggactatctccagccactcacatatttcatccatatcttatcttctatttaaaactttattatgatgcaaaacaatatttttacacaatccctcatggcccttgcctttgtaacaactaagttagaaaacaattttgtgggtttatcctcaacatcaacaaaacaagaacaacatttttttatcatcctttatttaccgcaaggagttccgtttagtcgcgacactttgggtcgtgcatccacaaccacaagacacagctcattgagtccttgccattggagacaacaacaagaacattcaaaaaaattccccgtcacccgagtaaaagagggcaatgtgttggaaatatataggaaatgagagaacaaccgagaaatccctcatatcgaaatgtatataattcacatgtctagactcaaattaatttatgaaagcctgtgaatcaagtgtcaaatgtagagagggcgcgcgcatgaattaagggttaattaaatatcgaaatttgtgcgctcattgcgtctgtccgatcaaattccaccgtgaatgagctagaatcggtcatcagctgcccagcgcgtcgatcaccatcattatccacgcctcagcaggcgtactttcatcatcaggtatatagttaattgctgtaaatccaaccggagccagatgaaaaactcctggcaggtagcgctgcactgtacagcacagcatatgtaacacgactgccgtacgtgcatgagcatgagctggacgcctggatgagctggcttgtgccttctacgtacgtacctgatgtatctatctatctactagtatatatgattggagttgtgctt

SEQ ID NO: 304 - DNA, 1317 bp, Zea mays
  misc_feature (1)..(100): optimal_loci_311097_G1, chr9:83967505..83968821, Cluster 2
ttcgaggtcctcaagagtggggccctcgaggtagttgcaacattatgaatctactcgtgttcatataataaacatggtcacaaaataagaaacaatatatcaaacatgaaaacatggttcagaatggtcctataattattctatgtatttgtagaatttatttgagaccaaaatcatttaatttagatttaaaatgaattagatatgaatttttaatcattttacaacaatcaaggcatatattcatttatctataacttccaaggtatctaaaagtatatttttggtccctagttataactggtgtgtactgcgagtttatttctgtaaaattgaggagctcttaagcaaaatggtcacggtcagctcatactgaccaagtgctaaccaatatccacgaatatcagccattggatcacacgggtgcgactcggaataaatggatcactatgtgggcggcgcacacggtggtaggagacctccgcgggggtaggtcactggtgagagccatgtcggccaacagagagctcggctagggctacaacctgttgccaagccactagggctacgtcaagcatgctaggcaccacctcgggggcaagggacagctggaggggcatggttggcggtgaaggggcgttcacggcgaaagagcatgcttcgattagcaattcccgcatggtccatgcactatccagctagggaagggacgttcgaggttgggtacctgctggcgtagctctaggtgctgagtggaagtcgagggagctcctgtgggctcaaatcaacaacagtgaggcgcgatggggttggattgttgtggtctaggtcgtcagggtcgatagagctctagggaagttgcattgtagtttgttcgagcttcgatggtcctggtgacgccggtgggaagtcagggtgactctggtgtggctcaacgagcaccagggcttatgggctgcgacgacactggtggcatgaagaaggtgttcgggaagctaggagtgtgagctgagagggtgtgaaggtctgcattttatatgtgtgcaccattattagccagagacagctccaacgtgagcagcgtggctggcacatcggttgaatatcggtgagttcgtgtctttgaatggcatgatgtcggggaagtaaatggggggacgactgccatgaatgcttatcgcattcgctctcaggtgatggggcctaggctgatgatcgagctgcggatggcgagattgatggtgacatgcatgtcaaggagcagtgagaggggcaggagattagggatgaaaggtggggttcatctattagcgactt

SEQ ID NO: 305 - DNA, 1206 bp, Zea mays
  misc_feature (1)..(100): optimal_loci_319912_G1, chr9:133148427..133149632, Cluster 2
ccatagttttctgttactgcacctttcttcatatgaataactaattaaaataaccacaaccagtacgactctttttccaaatactatttggttataagcaactatagaggagagggcacaagaatcagatgctgcgaacaatgcttttggccatttgacagaagcggtaaaaggatatggtgccaggcgagcagacgccccaaagataaaaaaaaggagcaaagaacagaaattttattatggttcaattttgtaaacaaaatttggagattaatattttacaaaagtgatgaggtatatatgtaatctctttcgagttaaatttcagaaatgatcctgtgcattatatacgttctatccttctcagtcatgccttcatctaaagttcaagagttaaatacaaattaagcatccagtcggaggatcaattctcatatactaaaacaagcccccatcctacctccatcttattctattctctaagagatcaaatgaacaactattcttctaaacaaattggtactcggtagaggtaaaatctgctctcatcctacctccatcttctattctctaggggatcgaaaccaaaccaagattaagaagaagaaaaactgacctggaaatcaggaggtccaagaacgaaaccattattataagaaaaactgaaaccaaaatcaagaggtccaaaaaacgaagcacaactgacctggaaacttgagtgttgaagaatgagaaaattatatatttaggactttaaacaatgtgcttcgtatttttggcatccgaaatattgacttcgtaaaagtaggatttaaaacatattctaatttgtttgaatgtcattttctgccttttctatttttttctcctatttggcgtctatgccatgcatgttttctcgtatgcagcttgcctttgtgaggtcgcccccgcgctggcctagtggcctttcaagccctcgccagggatctccacgacatcgacggcggagtagtcattccttctgcgcgcaatcctcatacgaacgctctgcgacaggttcctgattccgctgcttcattgcttgctgagcttcacatcaatcctgacatcggtggtcccatagccctctgcgcaaacttcttgatctccttgacgacattggctcaaacctaagaaaatgttgacgacattaggcgcatggttatgcccccctcaatttcaaag

SEQ ID NO: 306 - DNA, 1282 bp, Zea mays
  misc_feature (1)..(100): optimal_loci_321058_G1, chr9:138420971..138422252, Cluster 2
gaagttttaatcttcaatatcaatactccaaaaattactgcaattttggctataataaagtattcgaagtagtgttttaaaaagttcaaccgaagacctactagtccagaatgctaccattttttaaataccataatattgtactttctttgttccgttatattagtcgttctagcattcaatcacctacataaattattctctgaattaggacacaagtgggcttcaaattcaaatagataaacaattctatgaatttagacaatcctaaacacttctaagacgaccaataaaatagggcagatggagtattagaacttaatccgtctgcagaattttttgcacagtagtcggcatgtcgatgacctgttctaccacgtaacggggggcgaacgggcttggtgcgcgggagtcttgacattgaaccgaggtgctgtctggtttacaaaatgtaacggaaagggtaatgataatggtttacactcaattactgacggtaacaagtttaaatagttcggtatcaatttttagtatgatatctgattacggttaaattaaaacaaacatgatttaacgttatcacttaaccattatgttacaaatatatgaaccaaacggcacccaagaccctagcaattcccggcgcgaatccttgtgttcgagcatctagctcagctcggtcgatcggctccaactccaagtagaagtaccgcagcagtagaaagtagaatattcgatcatgagcacgcgcgcactcctggattgggcgttaaggtaatctgctggatacacacgcacacgcacgcttgctcgttccggttgcggactttggactgtcactcgttgtcctcgttgctcttgctcgtcagccatcaccgcccttcgtcaccggctcaccgcattcgcatacgtgagatcgtctggtactctggttacgcttggctgcctgcgtgttcaggatgccttgggcttggttctctcagagtagcccgcaatacaggcccagatctgtttcggccgctgtttgggagctctagctgggcctccagcggatgcattgtttcttactactgtagcctgtaacgttccttttaaaaggccgacaatcagcgagcccaggtagcggatcgtggtgactggtgaggtggaaccggcaaacagagagccgtcgtcgcgaatcccgcaaagcagcccacgtaaaaacgcgcgcagtgggatggatgggatccacatccacgaccaagtggaatcgccggaaaggaaaagacaacagtttccgccg

SEQ ID NO: 307 - DNA, 1219 bp, Zea mays
  misc_feature (1)..(100): optimal_loci_321299_G1, chr9:139740448..139741666, Cluster 2
taaaactataatctagtcaggttctcttaattcttttctggatggttctggtgagggagcgatggtttgtggaatggagtgagttaatccatcaccatctcattccttgtagttagttgtttagtaccaatatgtggaataaagtcatcccatcaaatttgaggaataaactcatgatgcaccactttattttggatagagtgattcatcaaaccaaacacttcaatagtctatgtgaagttttgttgtttggctgaagaagaattgttatcatggaggatgctctaaagagtgctgcaaacagcagtcggcaacaggagcataaacatacagttcttttttgctgggacaactacctttgcaaaaaaaaaaacgaaaagaataaaaaataaatcgcagacttatacgctcatcccacttgtgagctcgccatcacagcggccttttttggcaatccgcccgtgcgtcgctccggtccaacggaagcccaaaagccgaaacggacgttgaaggccctagtattagattgttattttgggccaatgcttccgacgggctttctcaattttcgagactctattttccgtttcgtccaggaatatgtatgggccaggaatacagtatggcgtgaaggagcagtgcacgacagcacgagtacgaagcgcggttgtttccgtagtcactcaaaactggtttctcacagccacacacacaccatcgccaagctagacggcgcttggacgatcaccaacgactgtcaggactctggagatgatggaagcataggcaccagcacgaagaccacacggccagaaggcagagcgtgtggctgaacagagtctcgacgacatggggccgggccgccggggttgtgacggcgaggttggatgggcaatgtcgacggctgctgatcctcgtcgattagtcccatagagatggggacagtgatgggtacggatgcttgtgcctgctaccatgccgctccacaggatgaaggttgggtgaacggatgtcggatgcggcggcgccggtagcccagcagggtcgttcgttcttgttaaatccctcttccctgctcgggcctagtcgctgtgtaggcccattgcaagcaggcgtgtactttttgagacccccctcttccctgcctcgggtctgggcctgggcctgcgaggatttaagggcggcaccttgttatgggccaaagtcaccattgttgggc

SEQ ID NO: 308 - DNA, 1070 bp, Zea mays
  misc_feature (1)..(100): optimal_loci_321726_G1, chr9:142053759..142054828, Cluster 2
ggagacacaaaggtgtttgacttcgcttgggcatgaccatgaatccatgatattggccaagcttcttcgttgactagatttctctcgttcctcgtgcgagtttgcaatgttcgaacgaaaaggtcagctgcaaaaaaaaaaaaaaaacttttcccctccttcagaaatgagagtcgcccagagcctcgaatgacgaggtactctgctgacgaggccggcagcaaactggagcgggtcatcgtcagagtcgttgcgcaaatcatcgagtgcacccgaagcaagcttaggatagcacgcagcagcatctcgtcgctttcagaacagtgtcaagcgtgtaggacggctcatgtgtgctacatccttgtctgccaacacagtcgctcgctggatctcatcagctagcggtagcgccatgtgcatctaaagtgatgatgtgggtttttagtgtaactcaaggcgcctaatcctcactgtccaagtggggaaaagcttccatggttttgcatgtgtccagtggggattttcggtgattggttttaatcaccggaaaaaaagggctccactgatggtggtgtcgtactggttgattttggtgagtgagatgtgatgacaatctgattgtatttcggttgtgggtgcagtgtcctttcaatgaactttgatggtttatgagctagagctctacgctatcaagatctcgcggtgtactggtgtgcgtgtgggtgtacagtacagaaacttaaatttgattggataagatagggagtgtttatttcaacttaaaatcagattctgacagttattctcagggcgaccttattctggaggcacatgtagttggcctcttggcacggtcgtgtggtctgctggtgtctgttgttttgtttcccatctctatgaagttgttctctctgtttttttatttcctctagatagctgatggtctacttttctaggtttttctttttcctatcctgcttgctttctggtccttgtcggatcttgtacatattttaactcttctaatatattgtggtggcaaagcttttgccacttaattaaaaaaaaga

SEQ ID NO: 309 - DNA, 1260 bp, Zea mays
  misc_feature (1)..(100): optimal_loci_322347_G1, chr9:145367236..145368495, Cluster 2
gataccacccactatggtggcagcgatagtcggcttacgccatcaaatcgatatagtgagtgcccgcctattttagttggtaccgactgtctaattttaagaaacttaaaactaaaagtaataaaaatgcaagaattttaaaaaaaacattataaattatttaactttatttgtatatatcgtgtaacttttattttgataaaacgacatgttttattttaaataaaagttagtaagaaatgttgatgtgagactgcgattggctataggataatgataaaagttgtacactaaagtattatggtagatacaaactaataatgatagatacatacgcgacgatagcaatgtggcgatagatgtcgtttcaagaaaaatatgtgtgctgtgctttaaataatcgagaattatgattgagctttagtgttttactgactcggaaaatgacattttatatcaaagctattctaacatgcttgcataattgctttgtataccactagtatcaattaatcgcccaagctgtacctcgaaattacagcaccgaagtaaacattagctacggatacatcagttcagaaaaagagtcaccacttcttcaatatttctgtaatcaattgagcccacatcttgtagtcggaaatttacatcacaacgtttcgtgcatgaaacacctcagatttccagtatagttcttatctgctcaggagagtgcttaaccaacgaccttgggtcaggataattgttataagattctgctagagctcttgccaaaccatagcaggcatttgaacgtaaccttggaaccctgcagttgctcaaattcaggcaaaggaaccttctgttccagtcacaatgccaaagagtgacttcaagcatttataaaagcatttgtggcgacgtttcgattatatctgccagagaccttgcatcaaccttgctaccgtactcctttatgtatggcatcttatttgacagtccacatttcctaagaatgttgtcaacttctttatcgacaagggcacgaatatgtacttcgatcatagagcgcaggttgtttacatagcttgtagcaacctcctggcccatcaatggctcctgaatagctgacaagcagttgatgaggtagactttggatgaagattcagcacaaccgattcccgttttctacagagctcaaccactcaacacctacgtcgttcactaccgtcagaaactgtctttattcttttagatttaagcccggtttttaatacacta

SEQ ID NO: 310 - DNA, 1259 bp, Zea mays
  misc_feature (1)..(100): optimal_loci_323135_G1, chr9:149270404..149271662, Cluster 2
gtacaaggctgccatcaacttgacgggcgtgattaggctggccggcgctacggataacgcggtgcaggaatggcggcggatgatgaggggacactgtccccgacctgtttccgctgttcacgacgttgcgacttggaaagagagagcgaagtgggcgagatggccagtaggggattgcttgctcgtagcacctttgcaggaatttcctctgatagtctgatgggagatcagatcgagagatccccatgtgcgggtgcgggtgcggtggcatcgtcatccagcgaggagttcattgctccttgctctcgatcactcatcattgactcggatccggagcagtggaggcgtctatctacgcgccaccactgctttctttttgttctcttcttctttctactactacaagtggccgagtgccttctcctgcggaaattctcggcgcatgaacgtgcgtgcgcgacaaccgccgctgctttagctttatccttggtcgcagctgccgcctgccacgagcatcatcgtctcacaacgggggacgattattccttttattttcccccttatcatgtttatctgataataaagtatccacacacggcctgttccgtttgataccaagactagacagtttcgctaaagagaggccaatcatgcatcatcgcagactatagtatacttcttcaaccacccaatttctagccatcgtgagaaagaaactgatttttaaacgacagctaccggaccggacgattaactagtcctgatccgtcgtccagtctctcggcttcttctgctctgcagtgtgcagtctgcagtctgcaatgcactgcaccccccccgactgaagtgacatcgcaccctcacaggattgattgtctaaacatcgggacaccgtcttgtgttttatcttttgtccgatcctttactcttatgcttgcttgagtgtcagctttgtcccctttttccagttctttttcttctaattattcccctaaccaccgagctagcacagtcatcaaactcggaatgcggtgcaaagtatctgctttagaatgcagtgcaggtatgcaaccgatggctcgcgcgccaaaagcagggggcggggcaggacaggggtgccgcactgctgctcgaagccctcgtgaggccaggccatgcatgccgcgagatcaggtcgtgcgtgggcgtggcacatgctgtcggtgccactctcggttcaagatccgagctcctcgcgcagggattataagaataatcgg

SEQ ID NO: 311 - DNA, 1383 bp, Zea mays
  misc_feature (1)..(100): optimal_loci_323506_G1, chr9:150836328..150837710, Cluster 2
cccgatcacgactccccggctacccaatcaaccagtgagagccatcaacaagtgtgtgctagctgggatgagcgaaggaagccaggctacgcgcatccaaagcctgaccgtactctagaggtgcagtggattcttttacatatggtttcggtgattggcggaactcatttgatttgagtgatggcagactgcatcaatcatccggtggcaggccggccacgcacagcgcaccggcaacggcaacggcacgccgcagtccaagcctcgcaaggaggcccagcgccatccatttcggtgggcacggcggccgcccactggtttcggtgtcgctgtcggtctgcgccgtctcccctccctgtcgtcgacgtcagttcgctgcctgtctcgagaacgcggggggggaaggggaatggaatccaccactccagcaggcattggaagcttcctctctcctccggcgacgcgtccggactcttgagtctgagggggcccaagcaacggatatatctcaaatctgtgccgatggatgaagggaaaactccaaattattgctcgggtttgggagatgtcctgctatgctgtgctggcgcacctctggaaccacaggccgcctgcaatgcaaccgtgccttgcaaggcttctggccgggctggctacaacgagacatgctgtctctagagctgcagggttaaaggcgcacgataaatggatcgtcgtttattatataatataatggtgtgatgtgtttgtaatggcataacatcttcatgccccttcctccagtgatgtccttgaataaacatggaaacaaaagagaagaaaataatgcatggttcaaggttatgtttggtggcacgcggatgcggtcgagccttcatcttcaaaaggtacacgtacaccagaagtgcagctagaagaaagatccgatcagactacttactggtagctaactagctacgtttgacttaaggcaacgacgacactagaaattggtcagagtcgaaatccgatttgctcggtgcttcgacttcgagtctctacacgaactggttttccatagggttattattcaacgatgcatatgtactccgttagctttgctgatggtaagtgagctgatgcatacgcaaggagcagcggcgaacgtctcctgatgctgtgctgatgctagcacaacaactactatattttccgctgtgaagtgaactccaatagtacacctccgtgtaaagaagtcgttgcaagtttgcagaggcttccgctctccagtctccccgggctcgggctggcaggcagagcagagctaagcaaaagaaagttccacgcgggaggtgggaaaccggctgatgccgggggatccgaacaacgtcagtcaaccagtat

SEQ ID NO: 312 - DNA, 1142 bp, Zea mays
  misc_feature (1)..(100): optimal_loci_324073_G1, chr9:153445980..153447121, Cluster 2
gagcatatttcattctttatttcatgttccacttattgacgtggtaatatatattggaaatattgtgatgaaactaccacactcagaatgaccttaatgccttacctattacacatctacctagaaggccggtgcatgcttcaaacgggcctataatagaaacctgaatgcatgagaggagtgaggagagaggtgcatgcttcagcgtccagtgtgtccagtgcaggcagcccagtccgcccctgaaacctgaatgcatgagaggagtgaggagagaggtggaaggccggcaggcaccggcaccaccggcgccggtacacacgcacacacagcatgcaggaacagcacggccggagtgtgccggactggggagggagggccgccagaggggagcagcactgcactgcacaagaaggcatggcatgcatgcagctagctgctagcagtagtagctcaagtgcccgggagaccggcagagacatcatttgcatgcaaggcgaaaacaagcggatcatacggctcatcatgccctccccagtctcccagcccagctacagggagctcccctgcatggctgcatgatcctttacgcatgccttgcatctgcatgtccgtgcgtgcatccacgtcttgtcaacgctttcggcgctgcaaattgatagtacgtacgtgtctttttttgagtaaatggctcaaaaaaaaaacatagagatctaggtcttcatgattttaaacattacgaacatcacccttaattttgtttgagtaaatggctcttgagcctgtcatgacggatcgtacttggcaacacgtacttattactgcaaattaagtatagtatccagagagcagatccgcagcacaagtaacgtttgtcacctgacgacaatgatgacttgtgcaaactcgatgaagaaaacagtactatggacacaagatcgataatggcacaacatgcgtgtctatcatagctacgctagtgacatggacgattcctaattccataaggtcgaatagaaaccaggtgtgtgtggcttagagtacaatgcaaaccagtatagtttgactatacaaaaacccttaagaactgcatgcctaactttctggaaaatatcatagtcaaagtcaataggaaatcagag

SEQ ID NO: 313 - DNA, 1210 bp, Zea mays
  misc_feature (1)..(100): optimal_loci_32718_G1, chr1:200639117..200640326, Cluster 2
cggtggcatgtgcggtggcacgagaaatcacgagatcataaatatggacactttgctagtatactttttatggtgctgagtactaattaagcccgtggaaaggaggcgttccactcagctgagatatgcatacagcaaatattccaagcccgaaagttctgaagaaatttaaaaggtggtttgaagtggtttaagccaggaaagtcacaggtgaccactctgtagccgatttgttgacggtttcagaaacgagataatatatgtacatttacctaacacgtggtaacaagtgacgtgagaaggacgtgcgactcgcgagcaagacacattcaacagtggctcgtcaagacgtgagtagagcagccctggttggctcggctggttgctggccgtgcagttcatctactgcttgttttctgaagagccgtttgcagcaaagtcagctcttgagctaatttattaactcctgctccgttgaataactggaagtcagcttgggtgtcctgcgcgagcactacggagtacggaggcgccatgccggcgcggcgagcgatttcttcgcttcgttcgttgcactggcaatttggcaaggcgcgcaaggactagagaggtggctctaacctgtccatgcgagcagtgcggacctttcccgatgtcccgtactcccgtcgtaaagcaagcacggccacagtactgtactggatacgttttccagtgaatacgtacgcgtacttttaaaaatttagacaatttcagtagtagtttaatctagaaattgttagtcaacaaatatatgacgtcggatatatgtacatgtgctctaaacgtgatgaacatatatagaataataactaacataatttttattataaacagtgtagtagataggtagccatgttaaccattaccatgaaagagaggacgaagtgagcaatagtgtcacttacatatactctaaaaaaaacatgattgccagccctcaccctaaactctcggacgacactcattttggaggcttgctattctaatacttgtgcgcataaaaattggaatggagagaacttgaccaacaacaaaagcaatggaaaaccaatgaaatgaataaaacgaacatatgacaggatggagcttttgtcttgaagcgaggagaaccgagcgggagcagaagatcaagaccacgcgctatgccgcaccatgaccgtaacggtgc

SEQ ID NO: 314 - DNA, 1249 bp, Zea mays
  misc_feature (1)..(100): optimal_loci_336618_G1, chr10:75155474..75156722, Cluster 2
aaggctattatcaaatcaacaagtgatcgtaatgtatttggctctagttggttgtataataaaggtgaagcaccaaatttgtcgtgcacacaacaactatctggtgacaactttgagctgaattcatcaattttattacttagcggcgaatttgatgattcagaaatacgacaaatttttacttgatagagaaatttatccatgtttcataaacaatatgggatggttaggggggcaaggcccctgccccacccccttggcttcgcccctgactgtatggatgtacatgtacctgcagtgtatgtattgtagcactacaatcggattcccgacgcaggaatttccgaacaagctcgtgcttgagtaattgagtgtttcacaggcatgtgggccctgtttctctattattacttttgttgttgttgttgttactaccggtacaattgctaccgctatccttcacgagcacgatcggcgaactattcctatgatttgattctacatcatttttatttctatggcccgaacgattgtgttcgagatgacattttagctatgaacctgactcaaacacaatcttcttagggggatactatatcctagtcctagatgctacttattttatagctcaccttctacaacacacacaaacctgtctcaggcatccgattccgatgcaatgatcagtgaaaaatgttgaaaactattcaagttgacacatcgaacaacaatgttcgagccctagcttctttaggtattgaacatgatagggcatcaatagagctgcttaagacaatgtgcaatagttgatcttaaattttgccccccacatcccaatatcataccacaccagtattatctctcctcctatatcacttccatcttcaacggtttccccttaatcacaacccttcatccactatgcataaataaaataatttacatttggtcgtcgtacaccatccacctcctccttcccggctttccccatcatcttctatgaacaaagcaagatagtgtgccctctgaaataaggggagagagaacatccctctagcttagggggacaggtatagaggcaagtgatacaacatatagaggtgtcctattcaaggggagagagtggtcacaccggaagtgttgtggatagcctaaagataagacgaactctacaccacctaagcctagcccactagctagcgcatgcagagtccttggtcgagatgcctttttcgaccgaggctcccaa

SEQ ID NO: 315 - DNA, 1241 bp, Zea mays
  misc_feature (1)..(100): optimal_loci_345972_G1, chr10:126976834..126978074, Cluster 2
cattcctacctcagggcactcctccaccgatactgtgtacggaccacggaagatggaaaatattcgctgcaaaccctctgcggtcatttctcctccgccttcgctgtgcggatgagcgacgggacccaactcgaggcaatgcagaacaggccgatattattatttacgaattacgaggccaggtaaaaagaaggcgagctcaactgaggcggtgtatcactcgcttccaagtgggcctgctgtatctggggccaaccgtaagcggcactgtggactgagatagacacactcgtcgacggcttccagaggcagcgcatcgttttaccgccctgaccgagggtgcgtgcaagtgcgaggcccgctgggtggccaacacgtggaccggcggatgacaggtgcgggaagcggactcgttcaccttcctcggcggcggcaagtcctgccgttgtcggacgccgggcagcgtgcgccgacgtgggtcgcaggctgccgtggcgttcgactgttcgagtttgctgccgcccgggccggggtgggtaatccagtagccacacaatgacaaaacatgctattgagtccaatgccttttcgaaccaacgtcaaaacactaatttcgttggcatttgtcatttgcatattataagacctcttcttcaagtgttatggaagacaaggaagagaaaagcccattcttattcctgtacaagcaaacttggagtaagataaaaaaaaagagtggacaattttaccacaagtattgaagcttcatcgtctcctcttatgaccaagcaagtttctaccattgcagaggccataaggatggtgaaagaatggagtgcaagaaaaaactacccttatgtacacaaccatattgctcattatcaaaacaaaagttagagaaatcctcagtttgttagagacaaatgaaggagggcttattgggtaaagagggaacatgagataaagttggcatgaatctttatttgtgtgttggagcactttttcttgtctttagaactattatcttggtatttttttggaacaatattttcttgttcgtgtgttatggattgtaatatgaatgttgaccgttatgtgggtgtgttataaacaaaataacgtaagtgaacctttatgtatatgattggtctcatttttgtcttgtcttttataatattacatgttcatatgttgcaaacaatactttcgtattgatgtggtatgaactgtaacatatatat

SEQ ID NO: 316 - DNA, 1159 bp, Zea mays
  misc_feature (1)..(100): optimal_loci_346640_G1, chr10:131041497..131042655, Cluster 2
gggactctagctgggttggttagctggtctaagtagcactcttcaggtcctctcttttgtctcacgccaaagcacaggtctaaggctcggccccggtcggcgatcacggtcacatgggccacgatgtcggtatgtatgggtgttgtagggattcaggagttttgtcgacctatgtgagaaggtcttcttctaaatacaatattcggggggctgtcttagctcccacgggttgagttttaaaagagaggtagtggtgcctgatgctggtgatggaggatgataagtgtaaagtaaaaaatgcttccacttcaaggctaacctacccttctggcatacaaggaagtactaaatttatgattaggccttaaaataattttatgttcttcatttgtaacacaagtagataactactgctaatcgatggtgtcactcagcttgcagtttacttttttcgcgcgagtaataagaacttagacacttcctgttttctgtatcaacatgtgctctctctgtaagaatactcgtaggtgtcaaatgccttttgttccccgtgccaatggtacatgtgactggttctaaccttgcctttttattgactaacgtatcagcttgcagcgatgaggattgaggaggatcacccaactgcccgctaagaagcgccttcacggagccttagaattcataagaacaggataaccagataatctgtgggataatgaattgcagtcaaatagttcagatagtttcggtcagctttgtgcatatggttttctattaatcttcatgcggcccattgatgtcgttgatgaacggaaaaagatccttaattttttggaaatccgttgtgtaggcattttcgggcgtgtattcagaataacctgtgtgattgctgtttctcaccgacacaaaggcgtttggtccaggtgatgcttaaaccgtactgtaaaccctaaactctaagcatgtaacataatccaaatagagataataaattattgtgcttacagagaagtcttcggcgatcatagcaaaacattggcggcataaaaagcacagcatgggcatatgctctggctaatgttcgtggattcgtgctgccatcaacatttctttgtccaaaatttccccatgcttgtgtgtcagcgacctatcgatcgag

SEQ ID NO: 317 - DNA, 1062 bp, Zea mays
  misc_feature (1)..(100): optimal_loci_348005_G1, chr10:137748436..137749497, Cluster 2
aagcagatgctaacgtggttaagattaatagttttattcttaatataaacatatcggcaggattagtgtgtacaccgcgggccttccactgtggcgtccccgccgacgccgccctccttgcctacgaccccgtccacgtccttgccgcgccaccaggtaacaacatctgttacagcactgagacagtggaggaggatgcaggacagcaggagtaggaaggagaaacaggaattgtattcattctgatgatgcccccccccccccccccctctggagcaggttcccacatagttattttccgcacggcacacatagttatttacagaccggcgtgcacacgactacccagcactcacccacatggcagttggcacgaagaacccttccactaggcacccggcgctgtggtgcgagtggcaactgaccacggggctgttggtcatcttgtgaagcacctgtcgaagctgatgaagtaacacaacactgccgccgcctcgctgccttccccttcggtgctcactccccctttctctgcgtcgctgatgtggatgcccaatgactctccaggtggccagccgcaagaggatgacgacctgttgtgtgtggaggttggccacctgcttggtgacctcggagagggccttcgtcatggcgttgatgacggatggtggcactccctatggcactggcagtgtccaattgtccatggtgatgaagtcttgccattaattgcagcagtagcgtcacctgatactagatttgtagggtccttgatcctatcgcggttgcgaagtgcgtaataatgtaagattagagatcaaaatttatggttttggaaaggtcatggtggcgtgggtgcaaagcgggagcggcgacacaggggtggatctagaaagtggagaatgagtgttaaattttttgaaagagtaaaaaactgaaggcctaaagtttacccctcttaacttgtgcaataccacataggatcacatagaactaattataaattaattataaatgagatataaaactagtcataactcaaaattattcaacatataaaaa

SEQ ID NO: 318 - DNA, 1066 bp, Zea mays
  misc_feature (1)..(100): optimal_loci_348184_G1, chr10:138809468..138810533, Cluster 2
gcccaccgggccctgggcgagctgtacggtaccgttgcttgagctggcagtagtgtcgtgggaaggaaaagctgagaggatggcttggaagctagcccgcgccatggggtcgacgcgccactgtctcgacgtcgacgtcgacgtcgacccccctctggcaggggcacacatcagcgtcgcctcctagctgtgcctgtgccgtcccgtcgccagctgctcgctacactacaccacacagcatgagaggtgcatggcgatggggtacgcgtgcgtgagagaatcggccggcgaggtcacgggccgcacaggcacagcagtgcgagcgaacaaactggtgtggtctcgatcgggaagatccggctggcttggctcctgacctcctgttgccgtggggttcggcctcgacggctccaccgcagaattctattcacgatttcttctcatggggtcgagagtttctttccctcatgatagaactcattatcaactaagatttgcgaaaaccattatgaaaagtcgttattgtattaaattcaaagacgagatattttattatcgtgaacaatagatattattgacgtgcctcaatatctttcggcactagtttgttaccaataaaggtgtgaatatatttacaaaacatagtatccacaaagtttattctcctgcccctgtataaaacactaaaatctaaaaagttatggattattattactggcaaataacttgcgagatgtgcaaacttcgtacatacaagaaagttgtccctaagcataataatttcctttaggctaggctgctttttatgtaaccgtgtccatgctcgacataataaaaattgtcacttcttagtgcatgattgaatcatatagaggtttagagagttaagtttgaacggtagaaaatactcgttaagaagatccacaacttcttgtaactatcttgttccatcaatataatcataagtatccagtggaagttgtagaaatgttataaacatggagatattagactatgcatttagttacgaaaaggtgcgaggtacaagatagtggacactaactta

SEQ ID NO: 319 - DNA, 1310 bp, Zea mays
  misc_feature (1)..(100): optimal_loci_37448_G1, chr1:225488892..225490201, Cluster 2
agaagaccgagcctaagtagtggagacctggtgggccttccaccaagcatgcaatgtctatttgttgacctagactacactgtcatcctactcgtgggtatattttgagtgtaattaggatctagacaacaatgtcctataattaccctattatacagtatattccgaggatgtagcaggtaaccacgggcacacatgacaagatattgagagcctttgttcctttctatcacactactaaacacttctaagtggttggttccacctgtcaaaacccaacaacgaagaccacacaaagatcaaagttatcctatcgcctttcattctatgcttgaaggtttcaatgatgaagacaagatacaaagccccaacatatgtgaaagctcaaaagtcaaaacatgtgaagcatcgtctacgaagacttcacacaaagccacaagaccaaccaaggttctaaaaactagaattaatcgatgattaatggctattgataggcatccaatatgattaataggtaattaggtaagtaatcggtataccagattaatcggtcgttgacctgattaattagccattgactagcctaatcaaacaaatcccactatctaatgttgcttctaatgctcaagactggctggttgaaggatgtgatgatattgacgaagaaaatgaagttatgcaacttcataaaagttcaagagttaaaagaacttcatgaagataatttcaagtttgatagcgaatgtggagacatcgaaattgaggatgaggatgttgtgtttgagtcagactatgatgaagtgctcccaacaaaatattatgagcaaggcagtgaacattgataatgactagatgtctctattttatattttaatttcttacattgcacatttggactactatttagccgaatagtgtctatcaattatttttcgattaatcctcgataaccgattaatagctcatgtctagcctatcgattaaactatgctattcaatatcttgaaccttgggaccaacgaagcttcaaagaaaagagatgtctttgaacaatcaagcaaagatgacaaagaatcttcgatggaattaaagatgtgcctatgaagattgtttatcaacaaggacttgacaactaataaagatagatattgaccaatttacccttgagtagacaagtggttgtaattttatagtccgagggtagttaggaatttgaacatgtattacaaagatagggacctctccaaataccctctgacattgactattcatagacaggaaattgttatccaatttagtttgcttttttt

SEQ ID NO: 320 - DNA, 1055 bp, Zea mays
  misc_feature (1)..(100): optimal_loci_38684_G1, chr1:231280905..231281959, Cluster 2
caaatgtcaattgcaatacatccactgattaacggactagaccgggttcttgtttgaccgtgtcagtaacaagatgactagctagccgaagattgcaacgccgagggttcacacagtaagttgaaaaatgcgctaaagtttaacgtacgtgtaaactgctttctggcgctgcaaattaaaggtggtggagaattgagtcttgggctcttacactttctaaattaggtgcctacttaggcattgttcggttagaagagataaaatttcattatggatttaatctggatctagattggatgaattcataactcacacctaatcctattgtaggattaaacccatcatttaattcatgtatttcttaaagctagttattcttttgatccatggattataatataaaacttgtacaatattttcatggatttgttccatacctaatgagctataatgagctatggataatccatgtctttcatagtttaaaaaattcccaaacccttgaattataatctatgatggctttaaccgaataaaaaaatatgagtagacttagattattttaagacagattgtaacatggatttaattccaatccatactaatctagaactggactgatgtaaacgaacaaggccttatcatagcctcttgctttggatggagacatgtttggtgtagtgacaactaatcgttatctgctagctagctggggaaatacagctaataactcaaactagagaataactcagaaattctacttaagaatcaactctcggagctagacaatcatggagcgaaactatgtcaaacggactctaagtgcatgtacaaccatgagacactagaacgattttctaaatacaagagacaacaaagaaaatgtatggtacaaactaagcccctaaatcataaatgaagttgagagacaatacgcatagagaatcgtgtagaaacagaaacttcgtgaagagtacgtctcttgtactttttcagttaacctcttatagagaccccttaagagaccatctaataaatgggatgtacacgtccta

SEQ ID NO: 321 - DNA, 1390 bp, Zea mays
  misc_feature (1)..(100): optimal_loci_38685_G1, chr1:231282575..231283964, Cluster 2
aatagcactgaagtcctccctccgtctaaagaagacacaagtcatcaatctcgagtacgattgtattaatcacggaatatatttttttcttaatatatttttgtagaatacaaacgttgatgctattatctataaatcgttagttagatttgagattctttttgtttggatcgactgcgcgtatgtaaacgttaggctcaagctcaaacagattccgtcaaagggctccaatccatacatgcatacggagtggtgccggccggaaatgtcaaacgcgcgcaataaatccactgattagcggacgcggactggaccaggttcttggttgaccgtgtcagtagtaggatgacggcgctgaagattgcaacgtcgggggttcacatagtacgtgatcagttggaaacgggctcaagtttttaacgtgtagtactaaacatcttttctggcgctgcaaatttaaaggtggtggaggagaattgagtgttgggctctcactttccaaattaggcgactgcttatctgctagctagctggagatatacagctaataatagcctttccttagctgactagcaattaattattgactaaacatttactaatctacaagaacctgagcaggtcacctggtggacgaagccagcaatgtgaagccgtcataccgtttatcaccgtccaaacggggctgacccagctaatataaaccgcagtgacaaacagcatgacgtgaacacgggcagactcggctagtgaagatcgagactacgaccatatccgtgcacgtaaaaacttgtgctggctgcaccatgactcggttgcggtgcctacatacaggagtgctggtccggtcaaggatgcagatactgcgaacttgtgcacgccgctgtacggttgatttgacgacgtacgatgacacagaccacacgacgaaagcgtacatacatacaggagtactccgtatacatctacgtacgtacgtaggactaatttaagaggggttgggttctacccaactaaatttagtgtctgtcatatcaaatatttagatgataattatgagtatataaaatctagtctaattataaaactaattatatagatgagaacgacattcttagaccggttaaccatgtatttaatacatatacttgatattcaaatatttaatgtcacacaaactaaactttagtccggggaacaaacatccctagttgctagcactggctagtagtaatcctgtctgcccactcgctctcgagataaataagggcttgtttagatgcatggggattgaggagaactgagggcatataattctttgctagtcaaaaatgactaacaagagattacatatccctcaatccactccggtctccatgcacaagccctg

SEQ ID NO: 322 - DNA, 1125 bp, Zea mays
  misc_feature (1)..(100): optimal_loci_39518_G1, chr1:235912481..235913605, Cluster 2
gtcgacttggcccggacgctcgagaaagcatagaattggattgggctgtcccctccaaaacatgagatgagattcgacatgggctttgattcagcacctgttcgattggtcgggtgttagcctcattgtagaaaggtagcaacagcaaaggtgaaccttttatcttcttctcttacttcgtttcaattccaagttgtagctgcgccgaaaggaggacaaaaaaacagtagaatttagcttatgttcatatcgttagaaccagagagagaaaagagtatggttcctgaacttgtcagttagaactgcttccatgtttcagagagtcaccagaccatcatccagtgtgagatgttgttcacaatgattcatttgatgatgtagtgaaagtgaccaaatgatctggagtggctcatgatcaaaactaggatcgccagtcttttttctctctctcccggtctcccccttgcttcactgtgcctatcacctccttatgactcgtgataagaaataaaaactcaccggaaatacagaagctatgacttcctgcctgctcagaaagtcttttgtgcttgatagttgatacctcctttctatttacacaaaaggcttttgtttgtgctagagagtgatagacaaggtcgataattgtatggtttaatttccagaattactaaaccacgttaaaatgaactttctggaaacatacgattgtggtaactcccgcaacacgtaatatagtgatgtttctggatgtgcgcatcgatattctggaattaacaattggacatctcaatatcctaatgcttaatgaattactctttctttctttttgtgcaggctcacttcataaaagatagacgatgtaatactgcacgggctgtttttgcattggagttagaatgcaagtgggctctgagtggaacacctttgcagaaccgtgttggagaactttactctcttgtctgtaactgatacctaaatgaacaaatataattccttctagattatggattcttacttacatgttgttttttcagattcggtttttgcaaatcttcccctactcatactatttctgcaaggactgtagttgtgagatactagataccaggtaagatgtgcaat

SEQ ID NO: 323 - DNA, 1287 bp, Zea mays
  misc_feature (1)..(100): optimal_loci_40494_G1, chr1:240993949..240995235, Cluster 2
ctaggcaaagcgaacttttagtagatctctttgctgactgcatgtttttcatctgtttggaacatggttcctatcgaggtcaagggatttcgcgctagttccaaggataggctgcgatttgacaatttactcatgacaatctttattatgggttttttctaggatatctggtgtttttgccatctcatcctgccaccttctgatgtaattgcgcaggtactctccttccccttggtcaatttgttgcggctgatgaccaattgtcctaggccctgaagagatggataaagttataaatgaactcatcccaagaatctattgagttgggggctatcctagcaaccattctctcggtacaagcatgagaaattcgatgaaataattttccacgacaggagggcctcctttgactgatgtgatggataggcgacagatctctaagcattcaacatcgttagtatttccgatataagctctaattttactggataaacttctcaggccaatgcaccgcctttagatgatccatgaaagctttgactagaatgattggtggacctctagtaagtttcacattgtaattttttagtgggttgcctctatcttctaccatcatagtgcttgtcctgcatatagggccgagtaggtcatcatgttatctagacaggctatgtcttctcttatttgaggtatattttgacaaagtaagggtgtgagttgattggtcacaagtttggactcgataatgttctgagttggtgtcacgtggatgattcttccttgaaaattgatcgtcctcgtgagttagtgatatatggctcatgggtccgagatgcccccatatctacccgctcagggaccccaggaccgggtcatccatattttttttgattgcgcaacaccttcagtctattctaaagttggatggtttcttgcttttgttgttgctttgagtgggtctcggtttgacgcactaggattccctatttctcctagctgtgaagctgccactcgatgcagatagcttctcggtagggcgagtttcctatggctggctgctagcagcctgttcagggttgtgatatccttctagatgttaatttgtcgtgatggctagacactcaccttctttgaacccttcacttgggtttggtatcttcgttgtggtagtagaaggatcagaaaaagagtcgggatctaaacttatgttaaagttgatgtcatattcttggttcaactcattgacattatcaagcacgggttggtgtgtgggtggattttcactct

SEQ ID NO: 324 - DNA, 1310 bp, Zea mays
  misc_feature (1)..(100): optimal_loci_41602_G1, chr1:246412785..246414094, Cluster 2
tgtcgtacctccaaccattacatagaggacagacttgatagtttggtccaatgtctcgtctcatagagagggaacagcgcagcagcagcggtccaagcaaggcccagcagcaaggcaaccaaaagctagcgatagcggccgcggctgctggatcgccagctcgatatatcagccagtggccggcgaattgactctccgtttaatgagccgagcaggagcagtcgagcacagtgtagtggctgcatcgagaggggagagagaagggaggaatcgaggtggttgaccccgagattataggccttcaatttgcgtttgcgatccaatccaatcctctccaactccaccccacgacgaagatgcatagtatgcagcctgcattcaactgatcgctgagcgccacctcattgacccggacctcccatccgcccagacggccagaccagcaccattgctttcctagctgcggcattccactctccgtttgctttgcaccgcttccattcgaactgcggcgccggggtggggggacgtggggtgggtggcgcgtcatgggcagctgcgttcgtggcatgcgctgttcgtggacgtggcatgcgctgttcgtcatgcgctgttcgtggcatgcgctgttcgtggacgtggcatgcgctgttcgtggcatgcgctgttcgtcatgggcagctgcgttcgtggacgtggggtgggtggcgcgtcatggacgtggggtgggtggcgcgtcatgcgctggctatggagtgcttcatcttcctctagagtctagaggtcgatcgtcagctaggatggatagcttctcagcagtcttatttcctccactccatgtcctgttcccgctcagtaacgtgttcgacattatctcgtgacacatccatcaattcatcatcgaccgatgacgctagccattgccgcatgcacctctaaactgttattggtttccccgttcttctcggaggtccgactagaggagtacggccagtgcgttcgtggcacgttcgttgcgacggccgttaacgcagtaataacagtagtgaagctagcgtccagcccgggtaggtgcagggtaggtcgacgttactgcacggctgggctggctggtgcaaattgcaatgcgacgtcggagtagatagatctagggcagtctgctgcgctgagtcgctgacaacgggacgagtcatgaatgactacacaatacggtctacacattcccattaaatgagggggtgagggaggattgcacgacattgacgttgtatgtttcatttttaaaagttcctattctatgagaacagtaa

SEQ ID NO: 325 - DNA, 1305 bp, Zea mays
  misc_feature (1)..(100): optimal_loci_4385_G1, chr1:22652413..22653717, Cluster 2
ctcagaactcgtgaccacagcacagacggcatcagagatcagactgcctggtggcgtaaaaggacaaagaatgtagcagtaacactgatgagcgcagaagaaatgagagggtcctacctacttgatgtgactatgtaatactgtatctatattttttttattctagaaagagcaagaagctcagagctgggcaggaagctcagagatgctgccaaaactaaatcatcctcaagtccaaaataagtataatttccggttcatcataaaactgtatacaagaaatacgggtccaacccgctcgcaaaaaaaaagtatacaagtacgcaacataaacatggatgaccttttatcaaacgaatatacagaggtgataccgcctacctcaagtcctcaagatgctcgtggatggctcctggcaaccccacctgaccatacattcattggttgacagaattggaatactcacaagtcacaaaaatgttagtaaacctagcccggaaccggacagcaaccaacggcatgtgcagggggtgtaggtaggggacgaccaggagcttacagcaggaaccttccccttgcagggcaaccggcgccggcgccagcccagagatggcagtgtcctatccttggtcccctgctccacgacgaatgaaaatgttaaacgcatctttctaccaaacacactatccatccttgtttaggcgtcaacaagacaggctacaatgtgtgtcggtcatgtccgcgaagcatgacaggtttagaatgtatgttggttttgttcgatacctactgtaccggtacttgcacagttgagttggaccagatagcaatttccagtcgttgttcttgcaggcaattctacttgtcatgctgtagttacagtttctacatgctgataccccccccccccccccccccagttcgctgaagtgtgtcagggaatagttttatagcttagcgtaagtgccaggtaagtatctcacaagcagcagtaccatccagttactgaccaaactgtctatgccgaactaagcacaatgaaaccaaagaattaatgaccattagtcatattgagtattcgcttcactattatgtttttgatttagtaaaatgcctcatcaccactaaacaaagttaaaaattcaactcactccctaaccacaatgagtcagcaacttatgtgcacctaaagcagtatgacagcctgacgggaagcaatgttacatacaggaccaaatgggaggtgaatgacacgctagtcatgcacagtttgcacacatcctgcaacatcagaagcagggctaa

SEQ ID NO: 326 - DNA, 1251 bp, Zea mays
  misc_feature (1)..(100): optimal_loci_47856_G1, chr1:279903298..279904548, Cluster 2
gcagttcctgttggatccatcttgaagtcctctgccttgtctcatccaacatcccgagcattgttctccatagctccaaggttctcctcctgacctagctcatcgtcgtcgatgccattgttcctgaatgttcgggtcttaggtggactcctcttcaaatttcatgattttatctctcttgtttttttaaaaccttcattgtaacagttctgaccaatcttgaatggatgaatgattaagttttgagaatgcctcatagtaatgacagatacttataataccgtatatttgtaatatgacatttgggataatttgctctagcagtaactctacataaaaattgtaagttgaaaaacaacaccagcatattataaacaagccgtcctggaaattatcaagttcacattggcagctgatgtccaatttacacattgtagggtgttgcagcgctatttttttcccttgtattttaggtgtgttagtgttaacgatttgtagccaaacttgtgtttctaaagactgcagagttaaaacatctctaagaagaatgatctaattggagatgggtgtggacatggtttatacatgagatctccgtcattaaggagtgttcttacaatctggtttcaacaaattaattgtaactgttgtgatacccgctcgacgtgctcaaggtcaacctgcagtgcaggtgagcggatttttattgtttggtgagtgctcaagttgcagtcttgcggcgctatcgtgcgggtgcagcaccttggcctcgggaggctgatcgcctgatccgagacagttagctcatgggattaaactgcggcgtatttggggtttcctagcatttttgttttagcagtgagcgtaatgtaaataatgcgctgaaacttataccgctgaaatgcttccctgtatcagaaaataattcaaaagaaagacggctcaacaatccatcagcttggtgctacttgtgtagttggttatatctctggtgtcgttggtactgttgtaagtcctgcaaataatattgtctcatccatgtacaacaaaaatgctaaaaaatagcatacatgtaaatataaatataattttccagcataaggtatcattgttgtcaaaatctactctacaatttttctaatgttctcatcttatgcttctaggctatcaaaactgaaaagtacttgtccattccgatcacccttgttgcattggacccatcataaccatgcagtggttcttgtacgatag

SEQ ID NO: 327 - DNA, 1346 bp, Zea mays
  misc_feature (1)..(100): optimal_loci_49382_G1, chr1:286502405..286503750, Cluster 2
ttggcggtcgtggctggcttgcgtccaactagatcgaactgtgcgtgagtaagctaggggcagcatagtcatttcgtgcaaccagagaccctataagtgtttaggatggttctaggttctagctccggtgtggagatgtagtttagaatatcaatttaaatagttttaaaaatatatttaatcttaataataaacaaaaatgacttatctaaatgtcttataaagacttacaactctagctctatgattttatggaacatctaatgacgtgctctaccaactttaccaaattttagagctggaaatgtcccaaacatggccaaaatatcaaaagtgtgatatattcttaacggttctaaaagagcagatacacggcaactccattcctattctagagattgaaggcttcgaagttccatgttagcaaatggtagtcttggcagttccattacggtaaaaaactcggcaggccgcacgcgctaatcgccgcgcgctgaggtcccggcgtcccgcgccgcgtccaccgtgctgggaacccgcttgcccctccacgtgcggtcgtgccgatcgtctccatattcgctgcttcctcggcggccatgctccactcctccaccccgtccccaagccaaaggcaccggcgtccctcggctcctgcctccggcctgtctaccgctacctgtcgcccgcggagaaccccaggtccgcgtcaccgccgcgtaagatgcacacgatgaaaaaaaggccagggaggacaccagtgacacacacgctgcatcctcgcgcgcccctgtgcggcttcccgtgccacagagcgtgccggtaagcgcgcccttgcagatggactggacgacgcccaacagcggctcgaggaaatgccagcaaggtaaggtgctctctgaatagttatcgtctctactttctaggagttggagctgaacagcacttacggagctaataattttgtgtgaaacacagaatgttatttttgattcaagggagcatgatgcaagcttgctgagggtcattgcttctgaatacgaagttttacattcataatattgattgactgttgctcaagcaaatgattgtgttcctgttacctggatgtcctttcgtggctatattctatacaatttattaatcaacttaactcattgaatgcatagttgtatatacaatacaaccaaccgtacttttctttgaaggtcgtaaacttattttggtgttgcagattatctgaaacatatgggattgtccatgtgaattaagtgttataatgttttcacaaaggcattccacgagttgcaatattactggctccaaaattcgacttcagaattctt

SEQ ID NO: 328 - DNA, 1063 bp, Zea mays
  misc_feature (1)..(100): optimal_loci_49562_G1, chr1:287586576..287587638, Cluster 2
accttttttagatgaatagacaattagttggtgtacttgaaaccgagaaacagtggactaaaaatgacacgagaaacaggaggagctctgtagtcgttttccaacaggataaaccgaacccgggcaggcagcttagcaatttgccagtacatgtctcactctgacgcctgaccagaaatctaaacagagtatattatatcataatatgtgatgtctccaagaaaagagaatatgggcagagaaatacagtgagatataaaatactgtatgtcctgtctgctggtgcaggagttaggagtatactgatgataggcctgcctgcaccttctgctttccgtatctctggaaataatcgtattcagatggtggtcaattcgtctcatcattattgtgtacgggtggtgggtcaaccatcctccacaccacaacccctgccttaatccgtatttttaatttctcgcttgaccagatcagtcaccaagtaggattcccttccttgatctcctccgatcaccatctgtgtcgtccatcgcaccgtgatctgcagcagctccagaaaccggtccgccgggccatggacatcacatcacacctcggtctgcgtcggatcctgacgtgacctgcgacttgctgctgttcattgcagcgcggcagaatccggtggcacgtcgggttcgtgtcgcgtcgtctcgtcggtcgtcgcccattggccgttggtgagatattgctctcgttttcgctcaccattcattcatgcatgcatgcatgcatgtgtgtgtgacccgtcctctcgtgtcgatcgctctgaacatgtaacttgcagttagtttatttatgagataataaaacgtggttctagcgcgtcgtctttgccatgccatgacacggcagggggtttgagcatcattttgttagaacatcggtttctctggttgttcaggcactatttggaaaagcagcacaaatgccgctgctagtttcaacgagctggtggtaccatgcccccaacaaaattcctcgaaaaaaccttcgttctctatttgaactaaaaaaacgtgttttt

SEQ ID NO: 329 - DNA, 1369 bp, Zea mays
  misc_feature (1)..(100): optimal_loci_49574_G1, chr1:287723438..287724806, Cluster 2
tatggttttgagaaacattgtttggatataacattgtaaaccacgatattagacaaaagctaacaatgccactttggatgggaatttctaatactccaaaaacgccatggtatctagaatatcatggttttaaagacatagttttcaagattgcaatcaaacacctcgtgacattaaatactacggtattgccccagaccatggcattgcatagaaactgcaaacggtattgcccaagaccatggcattgcatagaaactgcaaacgtactgcatttccaaacaggccattaggatatagacgatagccatatatttaagctaagttcattgcctctagacaattttcatacacattatttgttgttgttgttgttgttgttgttgttgttgttgtgtctaataagatttattttgagacataagatttaatttaaaacaagcctcgatcaatttcaattagattcaatgagacatgtagctaactactacgagtcttatgatcatacgacgatacaacatgatgcacgtctgttacagaactcgtactatatgttttgctagaactaccagtaccacagaaagtcacgaggactacgcatattcaagaatctgatgctataaggcaatcttcatcactttttatttcttctttttatttcaaactctactacgttaaacaggatactttacaatataaaacaacactatatatataatctggtggtgtgtatgtgtatgtgtatgtgtgtggggacgccggtttaggcagatgccaaggtgcaatatgcatttgcgacgtcaacagtactcgtataaacaaagtgacaagcgcaacactacaagatagtacggcccctgaactacagtgtgtaaaaaatctgaatggtcagatgcagaggaagagcagcaggcacagccagcgccaggaccagggctgcggcggcctgctgatccatgcatcgctgacacgccacaggccatggctagcgagatcgaggcaggcgttaatgcgggccgtagcatacagctgtatgcttagtggtttacctttaattcttgtcttgctcgcgacacctccaccgatccgtcgtacgcaacgctgacaccgcatgccatgcatgcatcgccagcgcgggcgcggccggccggccggccggagcgaccccccctccggtccggtcactcacagcctgccaaactaagtactagtactatcttgcttgggtctcttgacggcagacgaaagtagcattattggtgtatctcgtctcgatcatcacagtccaaaacaaaccctttctctttgtctggttataatatatagtttttaactaaaggtttgaaaaaaatacccgtttatgttttgt

SEQ ID NO: 330 - DNA, 1020 bp, Zea mays
  misc_feature (1)..(100): optimal_loci_5038_G1, chr1:25806377..25807396, Cluster 2
aacaatattttgttatcttttaacgtttgattgtatatgttaacaaacataattttcaccttgaatttggttgtggataacactaacggtttcatacattatctcagaattggtgaaaaatttgagcttgttgaggaagagatgaatattaaattgtcttgaagattctgattcatcttgttgggctattattcatcatgtaagaaatggaaaagaatgaccgatcggttcgttgttcactatatttctctatctagtgtctttctttgcgttactagaagtcttcagagcttacctatgctcttagaatatagtactgcttgcacatacagatcaaagccagtagaaaacatgttgtttactcaaccttgggtcaccctacacgtgttcttcaaatgtcattagatgagttccaagttataaaaatcattcgcctagcttcaaaatttgtgttgggctctattgtagcattgcagatgtgcaatatttactgcatttgcatgcgtagcagatctcagtgacatgctcgtggaaaacacacttttggtgttggtggtcatctgatgatttatggatcgtaaattttctggttattattattatgaacttagagaaagtaatcagtgcatgtacgtatgttgttgattaatcgatgcatgtatgatgtttgttgtccacttgggagttgggaccggtagcatgtgtgggaaaggcgagcatgttgtgtactgttttatcttggctcgctatgccctgtgacccaggctaggcctgtcagcccatcaatgtccctagaccccaagacttgtactttattttgcttagatgaaaaaaactcattttttgctaccttcttggatggcataacaagggataatgcacaccgctgatctttacatgcaatatacacttacttacactacaacgtacaacatgctctatgtatctagagggggtagatcatgtcattttttcgtaagccaactaccaagtcttgggcctaatatctgtgtggttttc

SEQ ID NO: 331 - DNA, 1224 bp, Zea mays
  misc_feature (1)..(100): optimal_loci_52101_G1, chr2:2066314..2067537, Cluster 2
cgatgcgaacagacaatgtgtcgtgcagttttttgaaggttactaagggttactgttaatttcatcgagcacattggtagtggaaactttatattaattttttttatttggtcacaaagaaataaaatctcagcccaaattcaagctatttgctaagtgttccatgccttctgaatctccataactggaaccaataggcccccctctcctccactctaaaagttagcctattatttactggtgctgcgtttacaactccttttgtctttctgggacttccttggaccatacttgatgctttgcagttaggaactttctgtcctgcagttgtgcgagctacgtttaattggtccattttataactgattgtgtgtgaacaattcgcttttatatgaatcgcactgtgttttgttgatctccatgtcctcttctcgtttcaggagtatttgcacttcttttgtaaccctccactttgccatagggacatcaaatcgagcaacattcttttatatgagcatttcgttgcgaaggtatggtcttgtgattgtactgtttcaacatttgcaagtcatggccagtgctttgctaatttttggtgtaacctgggaaaaacatctatgctaatatgctaatatgattattttgaagacacctcttagcatcaaccttggttcttaatacagaaaatgcatcttatatttttttcttgctcccttcccttgtcttcagagtgcacatgataatttggttagacagtgctacatgtctgtactccatgttgcctgctaatactccatatactccatgtgcttgtggtcgatctgtgtgatcatgtgcttgagctgtagagggttaatcaatttagtggaagtggatattgaatatgtttaagcaggcaacatggagtacagacatgtattagcaggcaacatggagtacaaacgtaacaggccttcatccattttatatatactctttgatcttgtggtgtttgtgcaggtccagaacatctgcactaggctgcctaaaaagaagtcttacaaagatttggttagttgcttcatgctttctctattcctctcttaatacttagctctatttgattgatctgtgctatactgtatgtgctattttttatttttgtatctcaacttaatctttgagaactgcatgtaccactatttctgtatttttattaattttgttcatactccgcgatgccat

SEQ ID NO: 332 - DNA, 1150 bp, Zea mays
  misc_feature (1)..(100): optimal_loci_52122_G1, chr2:2123754..2124903, Cluster 2
gaaattccgggctcatcacatggcggaacttgcgcgtcggcgtcgaggcgctgcacttgggagcaaaccacgccgcccatgcagatgcagcctgctggccgctgcagagccagaggaggccaaaaatggcgccagcccgtgaccacactgcttgactgacaggtgacagccgacaggtccgctccttcgcgtaacataacactttgattcgaactgggacacgaccatttggatccaaaccgtccatattcaagtaatggcaccagagcgacatggtatggccacggagcctttgcatacggttgacgatcatgttccggcagcggagcgcagacgccattacgacacgtgcgtgcgttgggtgcagtgaactggccggcagtcacggtcacgggccacggtcacgggaaagcgttctaacctaagggccgattacaccaagaattattcctgttaatcaaaacttatacaaattaaagaagcaattcggatcggaacagttccggtcttctattccctatcaaccgaacgggccctaaaccactcatcactgtgcggcggccggtgcacacgcacggacaaaagacatgtcaatgtgagcctctcaacgaaaacatgaacctgaacagcatgactgcagcgtcgtgctccgtgatcctgcctggactgcagttctttcatggcggccggccggaacaatgcgttcgtcggcgaccaccgctgcgccctgccaaagctcctccttgctataggctaggtgttttttttgtgagtattgcatgcacaccgccgatcggcgagcttgacacatagtattatttacaacactctaaattatctcgaatcctagtatttagcgtacatgtgttaaaaactagtcatagacagacaaaaattttaggttaaagtagtggagttttcaaatactccaaaattaccataataaaatcatgtcaactcgtttctaaggtcttggaaaccgcataaaacgtcaatttagagtgatttgttttatcttcacataatttactaactttttgctgatcatttagttacaccatttaattagtatgttctacgaataactgaatgcttgtggttttgttgtgacatgattgtgacacctgtttggttttctgccttagccctt

SEQ ID NO: 333 - DNA, 1213 bp, Zea mays
  misc_feature (1)..(100): optimal_loci_52227_G1, chr2:2484957..2486169, Cluster 2
gttatatttaaagcaaatccctccaatgtcatcaaaatatatacccccaaaatctatactgatctcttcaatgtcactagaaattggttcgatctatttgagttttaaaaatttcagaataaaaattcttaaaaacatgaatgtacatctcagcttaactcatctatatacaaaatttcatagtcaaatttatcttactctagtagttaaaaaagacaaaaaaaatggtcaggcgtagattattgcgagttaaaaactatggattgtaactgtttgttgtattggtctggtcgagttagattttttttgtgtggactagattgagtggcacatgatcaggtctatgtacaagtgcaacgccttggtctctagtctgtactctctacagctacacctccactagccgtggtgtggtagtacgggtactggtggtgcttgagctggagtgctggtgggagcagcggctagccctgagcattggatgctagctccactacgcacccactaccactagtcaccgaggggcaggggcagccaccggccagccggccggccggctctgtaaaaagctagtactaggcgcggcatgcaagcagcgcagcgcagcgcagtgcagatcccgcccgccccggcccggcgcatgcatgcacgccaatacaatgcaagctgtaaaaaaggcacgatcctccacgcacgcacgcgcgcacgcggatggatcctcgtcctcgtcgtccccatgcaatgcaacgcaagcatccccgtcccgttcccgtacttgtgttgtgttccgttggacggcccagagatgcggccaaaaaacgcagcacttggtgggtcgctgtgctccgtgcacgagcccggccaaaatgcccaatactactttgctggaggtagagaggagagtgcgtggtccagtgcttccagtccagtccagcccccctacccctactagctaggctgctacagtgtccactctccgctgctatcgcagaagcagaggttgcgtcgtctcgtcgttgtgttacatgcgatgcagacgcaggagggcgctcagcgtgcacatgtggagtggcactggaggatgccaataataacctcaggctgcctgtcagagagttcagttcagagcacgatgggacgccggcccacgtacggaggtgtgctgcgccgtggaacagtgctcgtcggccgctagctccagctccggtgccgg

SEQ ID NO: 334 - DNA, 1118 bp, Zea mays
  misc_feature (1)..(100): optimal_loci_52420_G1, chr2:3552847..3553964, Cluster 2
tattatttttatagattaattataaaaaaaagttggactagtagcagcagctcctctgcagtccactaccgtctacggtcgtcacctgcatatggtcatagcaccccaccaggctcacgcggcagcggaaacagccgactgcagaggactgcagcggaaacacccgtagcggacacagtcgtggccaattatgctagggctcgcgaccggctggtggggatcaccacgtgacttggggctgtgcctgttcggtccggctgcccccgatcaccaccacaccaacccttcaaagcacgcgcgccgcacgacagtaaccgccggtcctcgagttctacacggcagtcagactcatgtaggaggagtactagtccagtcaatgatttcatttctacgggttttttttttttttttttggtttggaatccaagcctatcatgcgtcatgcgtgagggcacggttgtagattcggcggtgactgatctatatccgagttcggatatttagtgtttgatctatatccgagtacttaaaatttaataaataagatgtcgataactatttaaatcctttctgatacgtttgaataatatctatattcgatccgaatttaaataaaaataataaaaataaatatggtatcaacgatatatatccatattcgaccaattgcatcgtagttcgacgcagcagaaagatggcaaatgaactagctaggcgcctttcttttcaaatccatcgttcacacagtccaaacgtgaacagtcaattcccaatcatgtgcaaaaaaaaaaaaaaaacagtaaccaggcttgacgggatggagatgagaaaaaaaatgccacgggactttccaatcttcgattgactttttacaccaaatttgatcaacttgtcttagtcaaaaaaaatataaaatttattaatttttgttgtgatatcgtttggcatataattaagtatggctttgaatttttcgtttttcgcaaaaaaaaaagaataggatgagccaatcaaagttggtaaaaagtcaaatgaattattaatttaggttgagagagtaattcatagctccaaattttgaggaaaaaaacaatcaggagagattgaggactgagaag

SEQ ID NO: 335 - DNA, 1219 bp, Zea mays
  misc_feature (1)..(100): optimal_loci_52962_G1, chr2:6187305..6188523, Cluster 2
tcccatatgcatggcaagccaaacatgcatctttcactgcgaatctctgaagagagcgggcgcgcgcgcgtgcacgcaagcatcatcagtcgtggaagcatgggccgagcagcagctaccacactgctgcatgctgtaggttcgtcgcacacatcgctctctcttcccactgacggcatcccaggctgtgatgatttccctgcacagttcgttcacaccggagcaaagctagctaggccgcgcattgggtgaaaggagtgagacaaacaaggcgaagccgaccggatcgagcaccgcaccctttttctagcttttgcacacaccacctgctggctgctgccgcatcaccccccgcgcgcggtctcagtcgccactcgctcgccagcgtgatttgcgacccccgccgaccacatcctggtgagcttgtctcgtcgccgtcgtcgccgccgtccctgtcgtcggtagccgtatgcgtgcatgcatggtttcaggtcgccgttctgaaaagtttctcgatcgactccgcccccatactaaggcgatgccgatgctggctgctgggtgcactgcacacgcacttatatagcattattagcacgcaataatcagaactagagcgagcgagctcgatttctcgcccgtccttggagaccgcgaagaattaaattaacgagcatcttgttgacccttcaataatgtggtttcgataattccattccacacatgcatgatcaggagcgaggaccatctcattctcatctgctggtgtggtatccagtctgccggtagacggacggacggacggacgtacgtacgtcagtacgtgtccctcagatcggaatcattatacataatagagctggtcaaacatatacataattggatatgtcatatgtgtatgcatgcatgtatgtatatatatcatgatgatgcagggtagttggtggatttctattcgcttgactgttgcccggcactgtttccggccggccgggacaagctgatgagtgatccgacgtgtttatatatagcgagtagagatcgatcatgcatgtgtgcatattgtgctagctgagagaggtttgcattggttgtgacgactacctagctacatgtgtacgtggttcgacgcggttcatgtgccactatatatataggaccatatattatgatccaccatcgatcatcggtcgccccctgtgtggcttctgttcgtgac

SEQ ID NO: 336 - DNA, 1168 bp, Zea mays
  misc_feature (1)..(100): optimal_loci_53423_G1, chr2:8902420..8903587, Cluster 2
agggctagggcgtgatggcaagtacgttttaccacacataactgcatcgcattcaccgcggcctccccggccccagcatacagcagttagtgcttcctgcggtgacgcgctgccgcttattggaattcttcttgaatgctctcgtccggtccggcatatccatctctagctctggcgctcgaggcatctcgttgcgctcgagggagtgtgacctgtgacgagacgagactcgcccgcctccgagctccgatccggccccccggccctccggcctccgcccccgcgcgcgcgccgtctgttcaattcaatgtggcacttcaattctccaacctcctctttgttgggttgttgcagcattcaacactcgagctcgctcgtcgcctcgcctcgccgctaccacgcacacctaggtttaggctagctcaggcactgtgggtgcttcaattcagcgttgctgtccgtcccctgtccttccatccatgcatatagtatcaaagccagccacactacgtactaccgtgctttgcatgcatgcatgcatgccccccggcctcgcacgcttatgttttactaattgtttcagtcaaaacatgggacaaggaggtatacggtgagctttacctagttcgtataattatctaattgagttggatgggaggtgcatgtgatttatgcatttaaccatctactagatcatattgcatatatagatgaacgaatactagtgtctaaatcatatgcggatttcaatagactagagggaggaaaaatctagcaaggatgaaaataaataaagtgtttgagagatatggtcggtgggatcaatatccccttatttatagagctattatatattttcaatttagttctagataattagagccgaaccacttaacctcaaggacgttatagtccaacacaagatctatatagatatgacagtcacgagtacttcacagctttgctttgtatcgccttaagctttgagctgacaccgtctcaagttcctactagaaatccacctagattttgaggcccaaacctagaaatcgttcgctcctctagcttctccacttgacttagatcaatcgttgttgtcttgattcgatgaacacaatctactcatccatgtcctcttgtacttgtcaatgatctcagctgggctgcc

SEQ ID NO: 337 - DNA, 1162 bp, Zea mays
  misc_feature (1)..(100): optimal_loci_53478_G1, chr2:9261975..9263136, Cluster 2
gagatcgatatctgataaggtatgcacgacttcgatttggtgggtgatgtttttattccatcgatagattaagcatgaggtgattatttggattagattggaatattcacttttgattgttaattggggattaaataagtagttgattattgtcactcctcttcgtttagaaaaatgaggagattttttcaacactttcaaatgggtttcacgactccatgaattattatgctgcaaaatatatagtacggtccacgtattgttccgcgatcacaaaatgtatcctccgcgaacaaaacttgctgacaggctactactcccatcaaaattactggactggacacaacacaaccatgtattccaagaatgcaaccgcgcgttaatcccgaggaggtaggcatatactagactcgattggattcgaggagtagcctgtcctgtcccgaaccaattaattgtgttcgtatgccagggcccccggccgcaccactcccaatataaacatgccgtgcaagaagcaaggaacgaccgattcggagtgagccgcacgcggccaggaacgaccgtgacgccgcggtgacgaacggctttctgcacggccgaaacggaccgatcgagaaacccggccgagtgctccgcccgccggcgccggcgccggctccacactaacgacaggcaatgaggagggcggcgggcagcgccaggcacctgcacgcaaccatcatcaagcacacggggcaaaagctgcctggcgcataaatggcaggggggcgggcagtccatttccaggcaagaatctccaaatgccgcgctcatcatgagcgagcggctctccaaacaggcttcgttcgtgctaccagacgtcgctgacagcatcattagctacatcagccagcccagctgggaaagatagatatcgattgtggctgctagtatagcttaactgacactattacctcgcggttgcaaacgaaatcataaacgaaatcataagacgtgtcgatttttttatatttaagaatggaggtagtattatcgtcatgctcatattgtatggaggcatggagcgcacacacacgaaagatgtactataggaacagccacagacgtacaaatggcgtccaaaaccaaaaggtagtccaagcttgcattatggcgggtc

SEQ ID NO: 338 - DNA, 1107 bp, Zea mays
  misc_feature (1)..(100): optimal_loci_54404_G1, chr2:14104544..14105650, Cluster 2
catcactaacattttgctccaaaagatcaccgccccttaaggtgcagggcacaacaatgtctctatctacaagggtatcaatgaggacccgagcctaggggatgttatcggcaagccaagcccgagggacacctatactacccccacatgatagaagtgagccctctaagggtcaccattgcctctaggtgtggccctcacctaagctcaagaagccatagaggaggtcaatgtcgttatagtcacatagtggaagcgactgaggcgggactcttggactaaatgtgggaccatctagagaggctgatgttctagaggtcaacgcattcgtatctattgatacccgtcgaaggagggaaatggaggaagccctggcctctagtattgctgccgctcaaccccaagaggaggctaaggggatctaggataacatgttttcttcttgattgtcaccctttcttatcccatatgcatgttttgacttgtttgggcttggattttgatcaaacttggatcttgtatatctaggatcgagtataacgtgtgcaacacctcttaacacatatggtagtccttgtgattgtgttttcatggtcatcaccaaaaccttaaaatcatggtcatgtgcacatgattcttagatagccatatgtagataaatatgcagctcaatcattagtcgagcctacttgaagccggcatgaatagcatacatatataccactttgcatcgtgttgatgattagggtaaagactagtttcgcaagccgtcctggtggcactgtcaatcaattgagaaagagggtttttgacaagctgatgaccaactcctgccgcagctcttatcacatactttgactatacacagagaatgagagattctccagatatcattttcagcctgaggaagcagtagtcaatatgaaaggagcaagcttgacaagtataaatcctctgaaattttgcatcctctcacaggcacgtcgccgtttgtagaatccaggcaagatccaagagcaagctgcgtccttgcatgtcaatgtcttcttccccatacagagcagtgtttggctgtttgttgaactggccccgttgtacatcgcattg

SEQ ID NO: 339 - DNA, 1081 bp, Zea mays
  misc_feature (1)..(100): optimal_loci_54422_G1, chr2:14203564..14204644, Cluster 2
ttcatcattgttaggtttttttccctcatctagactaatgagtgagatccacaaatccatatctaaattttgcaatcttgtcatttgtatacattctggcacagtagggctatctactaactcatttggtcaaattcttcacggtaagatcccgattcaatttggagcattttagttcgttggagttttgtttggagtttagacttgatcttctaggagaacattttaactccattcctaacctttgtgcaaaatttcatctcgattcgagtccatttgagctattttttgcacttttggaagaaaaaacgagggttgaacaagccaaactcgattggactacccctcaatctcgaccgggccaaaatctcgactaagacgaccctacacctaactaggtcggcttttggttagtcatgaaaggacaaacctgaccaggtcgacccttcgctctggtcaagccactttttgctatgtgcagtttgtgtattgagtgccttttttagttttcgtgtgtataatagtataagcctatctccatcagcttactcatctttatacacatattcaaactccactctaccaacagtgcaatctatagtgcaaaatagtgttttggatgactatggttgaactgttggacacggtctaagatctgatctattgttctagcgggtttcaaaatttgcatagaaactttttattcatcaaacaagcaacatgtagttggtttaggttatttgtgtgcactctttcttcgcctttgctgagcttaggagcgacgttttcaggcttcaaagtgttccgtgtgtgcattgagttttccgttgattttagtgctctgctatgttctcaggtcatatccgaggatattctatcactagtttggctcgagatcgagctactcgtttggagatttggaggggggaggggggggcggggttgaaggattgatttgaacaacaaccacttcaaaagcgcctttcatttatcttgtttggtggactgaattggtcctttgtcggcaccttccagtgtggagctcccgtacgggcgtaccacccgtaacaatgtcgcgtgg

SEQ ID NO: 340 - DNA, 1038 bp, Zea mays
  misc_feature (1)..(100): optimal_loci_54763_G1, chr2:15981738..15982775, Cluster 2
tgtatcgcctatcgtcgtcggcgtgcctagctagtcgatcgaggtttggcgtgccaatcgcattctgttatgctagctgtgccacccttgcccctaaaatacaccttctctcttggtagttggtaatttgcgttgtttattgttataagtagggctgctgctccctcgcgttttacttgggttttaagcatggcatgccggccgatcgatgggtcgatcgatcgagttcaaggattcgatatgcttttccgcgagccatcaccttcccccccacctgcacgtctgttagggcatcacttttcggcaaaggagagggggacggtctcgatgatactgcaggctacgtctacgtgtgtgttttgccatgttctgcgattcgcatcctcgctcgctcgctatcaggtattctccttgtccacagtggtgcaatggcagtagcgtgctcgagcagtatgcgaactagcttggaaaatccgagagctgctgctctgctatcctgctacggatataacagtgcgatacgtattgcaaatttgcatatacaggcgaagagcaggtcgagatgattgaaccttgctggagacgaaatgaactaggtcaaataatgccatgcatgcaaactgacatgcgtggtgacgaaacgactcgaggtacctgctgcgagtcgtattaccgtattcatgggccgtacgtgttgtccttagtatatatccagttggttacacttacacccaggggcggatccataggggggggggggcaaagtgggccatggccccccctcaattttatacaaacctattatacataatgacatttattgttaagtggagaaaaaaatcaaagttttgataagatatagtcatattctaaacaaaaaaaaaaaaacaaatagctagcgactaaaactagctgagaaatttagaatgaatcaactgattgaccaacttatttttagctataccctttaaataatcattagttcttagctacctcaacctagctaaaaccagttaacaattagctgtctaaaacaat

SEQ ID NO: 341 - DNA, 1043 bp, Zea mays
  misc_feature (1)..(100): optimal_loci_54867_G1, chr2:16680952..16681994, Cluster 2
cctccgcccattattttcagccggcgaataaaggaggaagacaagccaaggaaaatgtcacaaaattctgactgtaccgtcggatatgctggaaaaaaatgtcgaaacagtgcgatccactcgacttccatcagcatcagaaagcgattttgcggcaaatacagcacaaaatggtcactgtcgcgcagtgcatgttttgtctactggccaatagcccaatagccatcaccaaacgataaatgttagtagctggcatcatttgccgattgcctggaatcaaatactagtactccagtaattgagtggggatgggggataggacataggacacgtactcttcctacctttcaacaatagcgatgggctgtcgtcttctatccgtccccgcattccactggcatgcacacaagggaagcagtgcaagctgcccaatagcggattggtcccgaccaggaggagcaaaaggacaaacactggcggtgcaatgggctacgtaccgaatctaaactgacagagacacgacaaggaagaacatgaacatggcatgagaccccgctggtgtggtcttgtaaaagactgttttcccccctcttggagtcctggactgcactgaaaatgtgtcccgagctgtagctagctgaggtgctaagttcacctaaaatccgcattagggtgtgttcgtttgtttcggaatcgtgacctagaaccaattcaaccaggaatgtttatctaatttgtataggctttgatcacctgtaaccattcctgccccaatcctgaacaaaccaacgcagcctcatgaagttttggatcggaatgatgacctctctgaaatccgcatgtagtagagctgccggatagtggctgaagaatcgccagaatctagtaccttgtagtagttagttgttgagactctcttccaaacagctgtccggaaggaccaggatgccattagggatgcacatgatagagaacgaagcaggactgcaggcgaaagttcaacttttcttttttgacaataaatgttcagttgattgtcctat

SEQ ID NO: 342 - DNA, 1265 bp, Zea mays
  misc_feature (1)..(100): optimal_loci_58379_G1, chr2:36844538..36845802, Cluster 2
ggggccggggagcgtgtgagcaagccactgagcagcaccagccagcggcagcgtgggtgtggtcagtggcagaacggcacggaaaagggcaggtttgggggtgaacaagtgcagtggccatggcgacgggacgggtgtaccccccccccccccccccccccggtcctgggcggtggggccgcggcagcctcgtcgaccgtgcctgagcgatggcgtttctgtagttttgtcggaggctggagggtggtggcgtggtgcgcagcgtagaggttggggtgtttgagtgagtgaaaggctgctaggcttttctgttcgttgcggtggctggctgctgggcaacaaagcagagcacgagagtggtcacgctctgtcgacgtgttcttttctcggactgaagagcaaaagcgttgttttcacgtgcacctccgtgttgcttgaaattacacaagggtccgttttgaaaatccatggatgccatgcctcttggtccggtttttgtgaagcacacgctataggacaaacgaactattagtctacagtaccttcagaccggttttcatggctaaacgtaggtgaccttgatcggagaggagcacttgctcccgatttttctagacgtttaactaaaaaacaaaatagaggataatattaaaatttatttatatatccaaaacaaatttattgcatacattcaatgctcaaaataatgatatttattatatattctaaatatttgtatgcttttgtatatatgtttgttaatttttttacgagcacctctttagatgctctaacaaatctatttttttcttgaaccggggtttacagagctctaattatttgactaaaacataaactaaagctaaaaacaaaccaaccattatctctctctctttgtatatatagaagcttcatcggaccagaaacattctatctttcttgtcgaacaaggcttttggttctttctcgtttctgcttcgtaaatctggacctttggcgacaaagttgtaggcttctattcacaccttcgcaacatcaatgtgcatacgaagcttggtagctcctatttttctaatttgtggattgctattggagaaggtttgctttgctttctccttgtgttgtacctgaaacacattctctcaacccgaaggtaaaggggtttggggatcttcggcaatataggcactcaacacctccaacggtgacttcttaatgccctcatgttttagttctagtttgacaacatggatgtgatcatctca

SEQ ID NO: 343 - DNA, 1208 bp, Zea mays
  misc_feature (1)..(100): optimal_loci_61639_G1, chr2:55442141..55443348, Cluster 2
cccttagaagccgacgaccagatagtggtccctttagtggaggaggcgctaaccttagagcagtaggggtgccatccctagatgcggcgaggcactaaccctaggagtgacaaagatgatgacacttagagaacttagagatacgacatcccttcaaccactgctctgttaacataacttagacccaacaggcccaatctgattatggtcatggagtagtatgtagtgccatgccttcgatcatgttatagtgtcgaggatgtcctgttgtagtggcagacttacatgtcatagacatatgtatgacatgttgtggcgacgagtgctaaagttcatgccattggtacgacatagttggtaactggtgtagtagtttgtacttataatactccctggcacacttcgcatccaagcgtggctacatggatgatggcacttattgaatagtggccttgagtatgtctgcctatataattgcagtaatgcatccattagattacaacatcactcatcacacttaatgtgatgtgcaagagccttatccactatgctaccgtcgggagtagactttgaacatagtctcatacctttaggggttgtcttgccattaggccacaagctagttatattctttggtcttgcaagttctaccatacttagcattttatgagctcctttgttctcttggaagatcttagggccatgaggaccttggggactggccattaggattgattgaggatgaggacctcaaaaatctaggatccctaggagaccgagagctttaatgctctgtttgtttgagtttagagctattctaaaaacatggtgatgtgcttttgatcctgagaagccagtgatagctttttgatgatgttattagctttttaaactcaagaagctacaagaagcccatacaaccagacttcccatatgaactcagtttttctgagcttccagctatccaaatgctaaaccaaaaggctagatgtttgtttcagcttctggctttttcacgatggaaaatgcctagaagcttaaacaaatagttcctaaatctaggagtcctgaagtttggatcgtctcaaggtctggagctccatggaaccctagagaatggggtataagtttcacatagtttaaatgatcacttgagtatccatagatttaagttttagatgactttaccgggtattttgttactcaag

SEQ ID NO: 344 - DNA, 1114 bp, Zea mays
  misc_feature (1)..(100): optimal_loci_62665_G1, chr2:60669273..60670386, Cluster 2
cgcctccaacgttgcctctgctccccaaccatgcgacgctcgagtataagaaggaagtagtctctcgggtacaacaacgctccccagaactcagccatatctgcgtcgaagaggaggaagaagaaaaatatctcgcaacactcgaagaggaggaagaagaaaaatttataaaggtgttccaatccccaagccctatccttctacgcttccattgatttttttcctttgtatatggttccaatcgatgagtgcatgtgtagtaaagaaaagcatcattttgcctagaacaggtaactgtacttgcacattccacattgttcagcttagacatgaataaagaacatcatcgccatgttgtcttatgttggcaaagccactacactgaggtattgctgcaaagtcgttgtgcaattatgtagagtgtcgaataatatcttgggagaaaaataaccaccacaatcatacaaacaaagatttacagtgcaactaatttagcttaactttttgctcccttcggatcacaaaacagtcatgcagattagcaaaagtttgtgcataatggaaaaacttgacctcatgactactaaaacttgacctcatttatcaaaacagtgtgacacattagaacatatttcactggtacatctgatccttttgttgaaattctactgtggtcaaacatattgcacacacaatggcaattccaaactccagggaggcggatagacgtaggatccctttttggtggttcacgtttgagcaagttttagtagtttgaacaaaacctggcgttgtgcatgcatactaccgtgcacaaacatttctttgtagcatgtaacatgtgaaaatagcctcaaactctttgacgctgcccaatttcagtccaaggtcctgatccgatgaggcagccttcagcaaaggagatcctgagacaccctacctttgagaagctccataagtccccaacaacgaagtagaaacacacccccatttagatcagagcagccgacaagggaattgcacaattgctcccaattttttacatgtatctgtatgtgtgtgttgtgtgccctgatatgatattgtacgagattatcaaaaatgaagctgggat

SEQ ID NO: 345 - DNA, 1324 bp, Zea mays
  misc_feature (1)..(100): optimal_loci_63393_G1, chr2:64693626..64694949, Cluster 2
caacctcctccccctaccttgcgtatcgaatgtcattatctaacaacgcgaaggtacatagactaccagatagagagagagagagagagagaaagttaggaaggaacatgacacaagtcagtagccatattgaacctaggcacaattgggagccaacatgtaagaagttagagagatttgggcaccatatgtcctattgctacatgttgattaacataaagaaaaggaggatacaatttcaacctcaaaagaccagtgagcatcaagaccttctagctcacccacaactcttggttgtggtaggagttctatcttaatggtcataatccaccttttatgcatgacatctaggcgacctcttatgcaagagtgtcttgatcttaatcaagtatctggtcacccttaaagtgtttactcgtctcttccatttatagtgcaagggacaagataggttacatcaaccttgaattccactagttaagcccaactaccttatcattatcttgttcttgaagtcatatgggcccatgcccaccgatcgtagaacagggtctgagatgcccttttatatgtggttgtgatacatgtcatagagttaggtatgatatgtcacatccatagacatcaaggcctactctatttagtacgatgtagttggtagctagccttttgtacttaatagtacttctcgtgtgctcacgtgtggctataggatcaaaacacatgtaccgcatagtgaacttgagtaccatgcaatctatgtcatggcagcaataaacttattaggcctataatatcacatataatgtatctaatattttgtacctaagacttatccattaatataacactatggacttgtctttaaatctttagatgtggggtccaactcctagggttgtattgtccttgatgggcccaataacatccttctatattgtgatagggttacacttagtcgagttgagtccattattcacatgtggcttgggccataagagtatgggtccgaccattttcacgatacgaggcctaaggacattaaggacgatggggctagcagagtgcccctagtgtctaagtgtcattgagtgctctaggtccgagctattcctagcacttatactccataatacatagggacacgagggtccctagagacttagacatgtgagtgccccatggcatgatagggatggggactaactcccatgaatgtgatggggcatgagaagcctcggggctctagacttctgatcattggcctagggaacgagggtccctagggacttaaattattccaccttaggcaattctggggcac

SEQ ID NO: 346 - DNA, 1224 bp, Zea mays
  misc_feature (1)..(100): optimal_loci_7187_G1, chr1:37199922..37201145, Cluster 2
gaaacattgttaaatatatttttataataaggttatttataaagatataaatattagtaatattttttataaatatagtgaaacctaattaagttttactaggacgaagtgacggacggagggggtatatatataatatacgtataggtgcatggttcatgcatgcaagtaataatgtatatgactcggaatccaaagtgggcagctacttttgttcggtcaagatcaagagaatgaaagcatgtactaaaaataacagagaaaaagaaaggtagcgtaacgagggactgagggagcgcaggcgtacttggagaatcggatgtacgtgtacgtgtgcgctgtccatagacacgtacgcgaactaggcagcagtctagcagcggtacaaataagcgcggcagtgtcactcacctcactgctagtgtgctagctagctgctacatacattgtcaccttaatttctatcaagaaaatagctcgtccccgtcgtgctagctaggttcgttccacgaccggacgtacccacaaaggcgcgcctggtgatcctagctaaaaaaaagaggcacgccgccgtacgtgtgcactggccactgttcgggggtgcgacaagcagtccctggtccaggcgccgccgaatggtctcggccagccgccagccggccaatgggacgagatcgagagaaatgcacgcgcggagccagcagacagcagctagctagctcggggcctagcgcgttttgttcgtctaccgatccccaaagctactagcgggcggtgtaggtagctaggcgtctttgccggccggaggcgggcgcacatggccgcggccggcgccgggccgggatgccaaaaatggcggtgccgtaggctttttttagggggtagtgggcgggcaggggggctccgagggcgcggatccggccgagatcgtgccggcccgcgtcgtcctgctgtccgcctgtgcgtgtcagcgcggggttggccgcgcgccgacgccgtccgaccagggccaagattagtgccggttttcgccggtgcgttgtttcttcactgcctcaccggcatatatacatggaaacaaaagttgattaaggaaagagagagagggaacaagagtacaagaccagtcgaccaagcttaaaatctactactactaggttaaaaggcaggcgagcgagcaggcaggaaaggacccgatccgatcctatgattgatggtattatc

SEQ ID NO: 347 - DNA, 1394 bp, Zea mays
  misc_feature (1)..(100): optimal_loci_7355_G1, chr1:38133117..38134510, Cluster 2
ttcatatgaacgacttatataaggaattaatgatcatgtcatccatttcaacgtctccaagttgaacgtcgtgccatggctatacgctcataccagcgtagagaagtagggtttcgggacatgtgcttaaattgggttcaatcctaaatcagctaagatattgaaatggtatgtaattccaattttatcattttgatgtccctatattttagtttggaattgagtggtcgaattccacacaatatagaggggtgatgctctgtattaggagaggggtcttccagttatagtctaatttcagataaatgggtctctgattccaaatctcaattgcatgtgcaaccaaacaacaaaattaaggaatattgattccagttcctaactatgtgcgttggttcaatactaaatcggctaagatattgaaatggtatgtaattccaattttatcatttggatgtcattgtattttagtttggaattgggtggtcgaattccacgcaatacatagaagtgatgctctatattaggagaggggttttccgattatagtccaatttcagagaattgtgttccaaatcccaattgcatgtgcaaccaaacaacaaaattaaggaatattgattccaattcctaattatgtgcgtcgatatatacatccaaatggggtggagagctttacgaaagtaaattatgatagtttaaataatatctttttcactttaatatcaaatataaattaggcatactaacacagaaaatggccgataaggcgataaccatcagggttcaacaaattggtcacccctcaaaaaccggtggccaccaattaccgattaataacgatttatcgtagtaaaccggtagaaatcacaaaattcgaatacaaaccaaattattaattggctctatttgaagtcgattaatcgactgatacaaccgattaatctgtccttaacacgataaatcgaaatcaagctccttgtttttgtcaaataaagcacattaagatcacaaatgaacaaaaatggtccaaatgttatcacgagttcaataacaacatttagcagtttcaatacattacatgtcacagtttcatggttcacaaataacatcaagatacaatacaccctccggtgaagatcattctcacgagtgtgcattacactgattgtgtggtgtattatactcctccgtataatacattgcccacgcatcaactgcaccttgtactccacccaagtctgtttgatccattcagaagtcgtactccacgagtctaccaacatttagtagtatttaggctcctcctgttggtacaccaacctcattggttgttgagtcaccaccgaccggataattcacgtagggaagaaggggtgaagacgaaccttgtc

SEQ ID NO: 348 - DNA, 1097 bp, Zea mays
  misc_feature (1)..(100): optimal_loci_84411_G1, chr2:195536193..195537289, Cluster 2
  modified_base (821)..(821): a, c, g, or t
  misc_feature (821)..(920): n is a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
tcgatctagagattcgtcatcaacagatctcggttttaagcaatactgtagttttactgtggtaaagcaataccgtagtatttatgtcgtatacaattgtaaattatggtatctcaaactacattatttcaaaactacattctcaaataggccctaaagtattataaatactgcagtttttttaaagtattctaaacttaggtttatatctcagttttctgtgtaaaacgcagcgcgcgcatctctaacgcgtgcaaaaaaaatactttgcttccaaacacatttatatatccaatactgtggtattttaaaactgtagtattttaaactgtggtattgtcatgactaaattataccgtagtatttcaaaaaccatggtttccaaaaactttgttgtgaaacagggtctaaactgtacagattaaatccaagggaatggcacacaatgctgcgcacgtgttgcggtgttgtcctagcccagcaacagttcctacgtacaccccagcactgtgtgccactagctgcctagcagctggtggaggccgaaccctgcaagacaagtcctgcgtcaggtcgctgccgcggcagcaacgccatgcgcacgcggcatggtgcagtactgcagtgggagctgtacaccagggtgcagtcgagtggttgcaggcatgcagtctgccatccggcacagtaacttgttgtccactgggactgaccgaccgcgggcatgcttacaggccataattggtgggacgtggctcgtaacaggtggaggtcccactcccccttcaagccgcaccttcaaacaaaaaactacttgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggatgtggtgcgagaacctcctcctctctcttttctcggccagctaaataacggaatcgaaattcgccaaaaacaaaaaagctcactatcccatccctagtgcttgtttgcctgagactgtcttcaacggtgaacgcctccctcccccctcccattctgtagcggcaacaggat

SEQ ID NO: 349 - DNA, 1015 bp, Zea mays
  misc_feature (1)..(100): optimal_loci_84519_G1, chr2:196223398..196224412, Cluster 2
  modified_base (791)..(791): a, c, g, or t
  misc_feature (791)..(890): n is a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
ccattacgttatgtcatactcctagtactatagtatttctttcttctcatgcgatcgaataggcggcaaccttttgtcagtataattaatgaccccttcgttcatgttgatccgccgtgccgattaatcaggaaaaagggaggagctcaatagctcatgcatggtctagggataaggacgatgatgggcgttcgttgggttcggcgagcggcggcggggcatggccagccagtgaccgcctcgcgctctccatgtcacgcggggcccgccgcgtcggcgaacaggacagggacagggacagaaagggaaagtcgcgggcggcgccaagtaccaacaaccattcttaaaaaaatcatacactatttatttcattaatctttaaagttttaaaaaaatcatacactatttatactaccataatacatattgttttcatgttaccatacttaaaaagtgttaatatcacaaagaaattaagtgattaaagcataaggagattagaactcatctcatatgtgggtttcttctctccccatatatatttagaatggacagtgggggtgggatgggaggaggtttgggggtgtggatggaggtacggtggcctaataataatctaatctaaagggctcctccaatggcgcttcgctatcgcctacctggagacgacagcgacatggtacgggagtatgggtggtcacacgcacggcactcgccagcaagtccctcaaaagggccggaccgtccacacactcgaacctgtagctcttctgaccttgagctacctacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttttagcgggcatctaggaagtgagaactccaatagactttgaagaattggaaggattggaaaagatgggatgtatggccacgccacctcatatcccttccatatcacaactagatgcctaa

SEQ ID NO: 350 - DNA, 1074 bp, Zea mays
  misc_feature (1)..(100): optimal_loci_84562_G1, chr2:196404228..196405301, Cluster 2
tcgtccctttaccttttctgattctctgtgttgtgtccctttaggattggcgatgagcagtcaggggaagacgcagacgacagcccacgggagctgctgttcattcatggaagccacacagccaatatatcagaactgtcatggaatcctagcgagaaatgggtcattgccggcgtggctgaaaataatatcgacctgggagatggcagaaagcatctactgtgataacctctctatgcaggttaactgacctgactcttcggaaggattgacgagatcatcactggcttcctttaggtgtcgtctttgcaacttgcaaattattgtctcgcaggcatgtgtccctgtcgcaagacttttcagccgttaggtcatgatgctgctccatttgatcgttctctctcttgctgattctaggtcattaggtcatgatgttgctctatttgatctttccctatctggttctctacctccgttccgtaggattcactttaagcatgacttatggtggtctctaagaccacttatggtgtgtttggttgtggtacaaccttgtcgtccagcacacctttcgtaatccgattctatatacaataacactagaatggccaatgttctaactcataactctgaatcaaacaaccttatctaagtgatcgtttaatctcatcccatcattgctatcacaaccaaacacaccagaagaatggatagcaatagattttctacctctcaatctccttcaatccctttatcatcaaattagccctcctcagtcccttttatcactaaaccagccctaaggctctcttcaaccattcctctcccaaatctctccattcgtattttctattatatttaaataccttccccttcactattctttccactatttcatcatctctctaactatttcccctatttagttctctctttactctttaattgaattgttttattttttcatccatttttgtagttttaaaaactggtacaatatttgtaatactgtaatacacattgttatttatttattaaactcagaaacgttattttttatagtaaatataatta

SEQ ID NO: 351 - DNA, 1098 bp, Zea mays
  misc_feature (1)..(100): optimal_loci_85047_G1, chr2:199347993..199349090, Cluster 2
aacgcatcttaggcacggtcaaggaaaagaaaaaaacataataataatacatcttgccccttcttgctgggccctccttgtcaagtgcggcccctcccggttgacggtccgagagtgccaatcacgtattcgtgcaggatgtggcccaaagtatatatagagcattattcgctggtttggtcggcgcggcggtccagccaaagttttcatcagtcactagtattttcccactatcgttcgtctatcacatttacgagtctcaaacacgcgtattctcgtacgtgttatcaaacggtaaatttaagaattctgtatgaaataaaagtctaactaaactaaactaaacggacatagcgtattaatctctatagtgcatggatggagtatatggaagtggatgctgtgtctctgctcatgacgttgaaccggcaccagaatccaagaacgcgatggatacggtacggtcgagttgggcacacaacattgatgaccagcaacggctgccattcaagtgtcttttcttagtagtactagtacaattgtacaaaccgtttgcattgttgtagtatcgtactaaatatatcctattcacctactatgttaatggactaagcaggtagcagctgaagagaggaggttcccaagtgatgacaagagaccaaactagaccagctgaagcccaaccacatcagcattaattaaggccgatctcccaattcagttccagaggaacacgcatgcaccatgcatcagttaattactcttagctagacctagacggatgcgaaacgtgtaactgtttatgacgacaaataaagtctcatctatcagcgtgctcatatatgtgcaagttgagatacgtctgtctagctatcggacaagtgccgcttgcttaaatgttccccaacggaccacgccactcaatgagcgtcgaaacatgattgagatgggtaaagtgtgtccaaacaccaaaaggccttcagtgggttttcttacgtgaaagtttagtgcttgtttagttaggtgcagctctcatatctcattcatattcatacctcttatttcaaactaagaaatagtcgcacacacacctccacc

SEQ ID NO: 352 - DNA, 1202 bp, Zea mays
  misc_feature (1)..(100): optimal_loci_86713_G1, chr2:209275941..209277142, Cluster 2
ttagcacactttgtaggagctaaacggtgctaaagtgtagcatttacttttagtatatttttaacactcctgtttgggtacgtgccactcgttcgtccagctgccgtacgatctgacggtaaacgaagctgctcgtggtgctctcagtcgtatcgtatgacctggcgtcaaaggacgtcaagtcgtagagttccgtcggatcgtacctagattgatgcttacagttgtacctataacacgattcttagctaaaagtatatatagcgctaaattgtaacactgtatatccaaacccgcctaaaggtcccttggtgcacaatcaaccgcgacaggggagtccgagccccacgcacgtgccttttttctcgagtgtcggagacagcgactgctgccgggctgggctgggccggacccacgtgatagtcactaactccgccacgtacatgcatggacaagacacactctttccctgtgctgattaacatcatccactaagactgtgtgcaatagaccttgcaaacggccacccaaatccaaaatgggcatcgccctgcactgtagcacgaggcaaacaccatccaacagaatagccaactacgccacgcaaaatgcatcggagtagagaggctaccgatatttgagtactctcttttttcatatcatcttcctcgcttgagtaaccatcagccgccccatacatggagagcttcatgtaccatccagccatagctacaagcacgaggagaactggagaagatcgtgtgttcgttggcctttgtttcccgcgcctaggcggcaaagttcgtctattcccgccttctagttcccgcccccggaaaattactgaaccagtataaatgggccgcacaaactactgtctgttggagaacaaaaagtatacatacggtttgtattttaatgtggccagacatctgattgtttgcctacctaattatgcgtggcgttgttgcacacagcctaatcagctcaattccgttcccttgataggcatcatcatgggaccggccagcagcagaactgggcagctggcggccagtgcagaaaacacacgtgagctgaagcgaactgcagcgcgggagcggggcgcgaggcacatgccagtgtcgcccactttttagactaaccgcaacagagcccctacccagcttccttcccttcataccggctgtagaaggcactct

SEQ ID NO: 353 - DNA, 1377 bp, Zea mays
  misc_feature (1)..(100): optimal_loci_89916_G1, chr2:226181978..226183354, Cluster 2
tatataggccatgataattattgcttggaatggtggaacaccaagtgatatctttgatgttggtgtatttaagaaggtttttagtcgtgtgtctactccctctccaccatgtaatggcctaacataattgcccaaagcagtcgcgcagtcgtcgcccctctcctctaaccacatgagtggaaacaacgctcatctccctccatgttgttaagtagtttcattaccttaacaaaaaaattgtgtacattactgctacaagtagcatgaagagtctaacctgattgaaattaaatagtgagatgagtctgaatagctgatgaaaaattggttagtaacattatattggttgttggcaaaaagttatgagatatcgagatcgatgataatataggtgttgttcgtttttatataatcggttgtgtactaacattttatccaatgttttgtgcttcgtcgtaacgcacgggcattaaactagtaatacaaaaatcaacaaaagtatctcttgcccccctaactctgaggacactcgactctctcctccttcgacatcaagtaccaaaaggtacgccttaacctaaggatactaaggagtgggggcgtatcagtgggagcaatctagaacacagagagatcaacatctgagtctatgttagggctgctactgaagttgtctctaaagcgaaagttagagctaagactagcactgatggagctatcggctgagccagtgtgactgataccgaggaggtactgatagcagagcatatgatcatcacatcagtcgacgtactcccaattctgacagcatgtgtagagaagtccaaacctgctggccagagaggggagatggagagtccaaaagtctgactaggtggagtgctagactgtgtatggttggcagttggcacgacgactgactgtctgaagaggtggaggcggtgtcgtctgaataagagctacagagaacctggtgtgctcaaagagatgctagaaatacatctgattctctatcatttgacggtggtggaacagtgaaatgtcattcatagaatcatttgagttgtctgcagctcgaaaacgaacgagctcacgctctcggatggcctcatcctcctctgtctctctctctccagcaagtgcatcctcttggatctaatggcctctgtgacccagaattcgacctgctggacgtgggtcgacctcctactggggccgataaactccaaaggctaagcgtgaactcctcaaagttgccactatggtgattggatcagctgagcaaaaatcctccggcatagctgagcaaaggttttagctcccccttagtcatccaccaaatactagttggtattattctgcacttttcgtggggaa

SEQ ID NO: 354 - DNA, 1065 bp, Zea mays
  misc_feature (1)..(100): optimal_loci_89923_G1, chr2:226197484..226198548, Cluster 2
catgtccatagaggccagccgtttagaatattgattctcaataattatgaatgtcttcatcaaaatccgtttgaaaagtgaagtgatgcagagcttcgcttgtggacgtcaatcatttttcaagcttttaagtctgagaactagcggtgtagaattgtccgacggatcgatactgtaatatatcagtaccataaataatgaagtatacatgtcatgtggagaaccttactatactagcacgtagaaggccgtagcatgatcaacagagagggaaggacaggcttgcacgagcacgggggcggctggggccggggatcggaatctgatacctccgcggcatcctccggctgatcgatcacttcgaacaagcagccgcaacgcaggctggctgcggctctgcctggccggacctccctccaccggatctggacacccgatcgattcatggccatggctcgcccgccgcgccgcgccgcgccgctgtggtgtgccatcgccggacgccagacctccaacacggcaacagctacccaatcataccatacgcacagtcgatcgatcggggggggcacggatccaaccaaccggcggcgagcgtcgggacaaaatgccagccggtcgcaagcatgatcgagaatcgctgcacgtccagtccagtccagatccaacccaccattatcatctcgcacgcagacgcagccgtcgaacccttgcaggtgggtgtgcccgtgtgggggtttgagagaaccgacgcgtaggtacgccctggcgactgggatgggacggggcggcgaggacgaccggacgtcggacgatactgcccctgcccctgctatggcggctggccgggtcgccgtccggcctcagggtatttatcgctccgccaggacgtcgatgaccagctggtgcggatgaaaaaaaaaaaatgggctgacctcgcttcgtttcggtcggccctatcacctacctgtggctcaattctaggcgctaccaatacctggaacgtgtcgatcgagatagtttatcttaggctataaatacaagttcgctgaacggacagtttcg

SEQ ID NO: 355 - DNA, 1070 bp, Zea mays
  misc_feature (1)..(100): optimal_loci_89937_G1, chr2:226327239..226328308, Cluster 2
tcgtccatggttcctgtcagttcacggtaagtaagaggaaggaatgaatgctggcttgcgctggaattcagttaacagtgagtcgatctgtctacacagctactgctgtctgctgctgctgctccacaggatgggaatgggatactggttattattactgcgatacgtaaatatttatttaccttggttggcctcacgccggtggggcccggtgggtcggaggcggcggagtgcgccgacgccctgcacgccggggcggccggccgtgggaggagatttgggaggggcgcgcggggccggggcgtcagattggggacgccacgagcagcgaggttggcgttgggtagggctcggtgaagatgaggacgaagctggggaacttggatttctacgcggatcgatccctatacatcggatgggatttctacgcggatcgaagagggactggtttgccgcacgatctagggtaaatcccttacagatgctcttttcttttgtttcccccttacaaatgggaagtaaatagctcgtctttttttccccactcttcctactgagtgtccggctccagcaccggctcctacctcgcaaaacagctcctgagcaggagccataatacggctaagagcgggagcccagatttttggctctccacggctccacatatgggcgctgcgctgcgtctctccccgagcagacacctctctccaagccacctcatgcctgatgcaagaagatgcagctagcagcgagaccgttttactccaaatcaaataatacacgagaggagccggacccatttttacaggtgccgtagccctccaaacgggccctgaatctagccataatcgatatggaacgttttggatgtgtcttgctaaacttaaatcacaaaacaagtttaacagatattgacttggaatgggttcatgtatacacacaggcatgaggcttcggaagatgcatatcttgtgtacagcaaaattcgtcagttcacccacacaacaggaaaccgtcccacggtacacttgcatagcatcagcagcagcaaacttcgctgtcccaatcat

SEQ ID NO: 356 - DNA, 1318 bp, Zea mays
  misc_feature (1)..(100): optimal_loci_919_G1, chr1:4755594..4756911, Cluster 2
tcagagctccatcaccatcaacaacagaacaaatggtccccatacgagatgaccgtaacatgggctaggccagaaaccagtctctctcttctccttcatgggctgggccagcgcgccgaccccattgcggaaccagcccaatctagttgcacactgccgctatgaattcgtttcatcgcggacgaccggacgtgtccgtcaagtcttcctgcgccgtcctccgcgccggtagtcacccatacccgatcgtaaaccccgcgtggaggccgccggggacgggaagcaggagccgtcggcgtgccaggcgtcgacgtttcgctgagctggcggaggcgtgcgacgccatcccccacgtgctccaaggtactgctatcccactcggcatcgtccggtgcacgcggctgcggactctcaattcggcgccggccttggttttcgcagggaaggacctgatcgcgctggcgcagacgggtccgggaacacgggcgcgttcgtgctgcccatcgtgcagaagctgctaagcaaccgtcaggctgatcagcctttcttcgcttgcgtgctcaggccaaccggtatttaatttcgagtgtccgtggttgctattgctactcagagatctagcgattcagattgcgaggagcagtttcaggcgctcgggtcagctactggtctgccttgctcagtggtgagcgttatcaatgcaattatgcaagcgtctaaatgtatacgcgaatgcattttttggctgccagcgtctgaatgtggcaaatcgtgacgcatcgatacagctgtcagcgtctgcatttgtggatgccttggttctagctgacatttaattctttcaccagcttgttggaaatggatcgggtgcaacaagtgctacccattagcaaacgtccacatattgtggttagtatcatacatttcctggttttctctacttattccaagctaaagttcctctccgcatttatatagcgaaacatgtttttgacgactcttaagtacgttcccaacctgctgtgttacttcgaaatgtatacattaaaataaattacttctaaaaagctaccacagttggtcggcatccttatcaaatcaaatcctccttctaattgacctcttggagagagccattgcaataagcctgagaactactttataaaccagtagcgacaactatagcagatgtgattctctttggctcttttatacttccatgacactgaaatttgttgtatgttattatttatataactgaaataccctgtttaatttgattttatttcacatattgttgtgttaaccttctccgtaa

SEQ ID NO: 357 - DNA, 1140 bp, Zea mays
  misc_feature (1)..(100): optimal_loci_9250_G1, chr1:48692440..48693579, Cluster 2
gtcgggccctacgtccggcctcggtcccttgcgccgcctgctcgcggacctcagcgaccccaccatgggccacccgcccgtcacctgcgtcgtctcccaccgaccaccgtcccacgtcgtaatgggattctccttcgccgccgcgaaggagctcggcctcctctggcgccggacgcccgcgacctcccgccgggtctcgctctccaacaaaggaggaatatttagttagatatactttgatggttagggtcaaccaaatattgtgtatgtgttatctaactgcattcattttcttggacatagtggtactggatatatttgcagaaagtaactaaccacgatatggtgaagtttagtatgtttacttgttctccaaaatagattattgattctatgacccatttttaattctggatgacttaaatttcagagtggtattgaggacaactttgctactgtatttgctgctttgggagtaagcatggaaatagcccaatttttcgaacgtgactttgaagaaaatggctcaatgaaatgggtcacccttttttctgaatctggtaccaaatttattgttatatggcgatcagttattacactataacaaatgaaattttgatgagttgatgtgttatagactgatagtattaaaggcttaaagctgactcttgctgtctgttctctttattgattacaggccaatgatcccactattgtatggataaccactcctcgtattgctctgacaacagaagagtacttggcataaaatgtgggaaacacagtagcttttttgaatcataatatgtcaagcaataatcatatttagttatctacttattacagtctcctgtgtttgaactctaattgcatttgtcccattctttatgccctaggggtgcacactgtgcagttcaagcacaacggttgctataattttacaactgaggaattcaaatatgtcaccacaaaatacaaagtttcgtggttgactttaggtgattctgtgacttcaatcataatctcaaccctgtgttctgaattctgtgacttaaatcataatctcaaccccgccgcttggaggtggtcgaggagatgaggagacgggcggtggagaatgatgcaaaggaagagaaagat

SEQ ID NO: 358 - DNA, 1369 bp, Zea mays
  misc_feature (1)..(100): optimal_loci_93413_G1, chr3:6436597..6437965, Cluster 2
gaagccgctaaataaaaccaactgatcatcatcgtaatacaaaaaacgctaacggcgccatatataggatggggagtgcgatgaactagtcaagtcaacatatattagaccagaacaatgaaccggtgcaagcagcatctcccagaaggatctcttgacttctctacaagcaaagcagggaatacaaaatgctccatttcggcaacaagtgttttggtgttagatgtggttaacatttggaacaccggcgctggccgtctttgtgcaagtcaaccccggcctccaagataaacattgcagctagggcgtcgagttggttactttcacctgtagcacgcatgcagaggtgcaactgtgtgtgtctgttatcatcctctggccgcagggtaagggttgacatttggagtagctgactccacaagcaaatttaatgggagtaatcgcaatgatataaaaatcccctttgtgagagagtttatgtcatccaggtcacgttcatcgatctccgacgagagatacgaatgatgatgcattccgagagagagtccatgccagtagcagaagaaaacagaaacctgctgcctccgctgatctcatctcctgtatttcgggttcggcgctgacattccatccatctgtggtttgtggcttgttttgtttccgccgacgccgacgaaagacggcggcggcggcggtggcttctgaatactgaatacgctgcaggtcgtcggacttttctgcggacaggagggatggaaatgcgtggtgattttagtactgctatttgctactagggtagttgttgttcagacaagtcgccatgggaatgagatgatgagagggcgtgcgctttgcttgtagccttgtgcagtttttgcgctctgccttttggcactttgcattgcatgcctactcctactagtactcggggatggggaagctaattgtgtgcatgactgcacgggaggttgaagatgggcatccaagatgagtgtgtggccccatacgtacttcaatcacttcatgatggactgatgatgtgttgcaataaataattgtgtaaaggtctcgggtcatgctatgggctatggccatcgagaaaactaggagtatataattgaccgcgctcactatttcctatacttgtatgcctgtatgtatgtatgtatatcattgcacgcacttgcgcatagagataggataggatattcacttcttggcgctttcctccaaagacaagtgtttggggttcgcaggtcagagataagagtatttctgtatttgaaccccaaatcttggagcctgcttggctggctatctaccaaacactgccatactaaagttttggtaaaaaaaaatcctgaatcta

SEQ ID NO: 359 - DNA, 1356 bp, Zea mays
  misc_feature (1)..(100): optimal_loci_94020_G1, chr3:9455871..9457226, Cluster 2
gctgggcctcaatcttagtcacgatgggcggcacgtcacgaaatgaagcacgaattaaaaaacaagtgtttaaatggttattttatgctccaatatttttttctcttcaccaaagttatagaaaacattgatttatttttctcatatttttttactctatagcaaagttatgaatattttgaggatatatttttagatatgtataagttttttatacatgtcgtgcttggactggctggcacgacacgatcatcgacccgctgtgctttgggccagacagagtctacttttagtatctaaacatgatacggtctagccctaaattgtttcgtaccgacccgaaaaaagttagatcgaagtaccatgggcccggaccgtgggcatggtagcagacgccatgcgcgccttttaggcctgagcataccaatctagacggaagaaacgggccaagctgagaggcagctgcattggtgaaataggcccgctctgcgctcactagttgggcccgaacagaatagcaaaacaaagcgggacccatcgttgcgtcattccactttaacaaatctcgcacatatgtctcccttactaggttctatctaaaaaacaaaaacaaaaacaaaacatgcttgtggctcttctgcagcaagtattgcagctgacagccgagaagatgagttcgtaagagcagcagtcaggaggtgattgagatccagaagatgctttcccttctttctttcagctggtaactgaaacggcagctacgctacaatacgagtagtggagacccgaaagtgatccttagacgccgcctatagcctgtcggcatctctaggccgtcagttttcttttgcacgatatgccattctttcttcagatttggtattaaaaaaacaaaacaaaacaaaacaaaaacgtgatggcagtgtgaagaaagggatgcacaaacacattatccaccacttctcctttcatttgtttgaagcaggtttggaaactgtctgcttttccaccagctatcacgatttgcatttctgcaatcctttcagctcatatcttgcagcgcttgtgtatccaatcctttcagcaggtttggaaattttctacggtaacaatcatccaaaaaaaaaacaacaaaaacttcagagcgtacagaacctttaaacccaatggtaccagagctttagcatcgctcagacagacagcatcactcctaccttgatctgatgtgtatatacatgataacaaattaatttaaggttacgcgggatacctggacgtgaacccacagccaagttgaattggtccacatcatctttgacaaggattgaaatttggaggggctggcggattatgtgt

SEQ ID NO: 360 - DNA, 1133 bp, Zea mays
  misc_feature (1)..(100): optimal_loci_9629_G1, chr1:51005935..51007067, Cluster 2
catgaaagcatgcatgaaatgtaacttttcatttttttagcaggacgggatgtgctttttcattgagtagggaggagttggaaaacttaaaatcaatgaaagattaaaaaaatcagagtagaaaggagaaggtaaaaaaggcaagtaaaagaaatacaaggacaatatcaatgagctatccaggaacacctaaagcaacgactaaatgtacctttctttatggaagtgatcatcctaatgacagaagcatctgaaaaagtagaaatagatggatctttgaaaacttggatccaacagtacaatactgtaaaaatgacttcagcaaaaaaaaaaaattggttatccatagaggaagagaaaaatatgacactgcagtaccagaatggttgcaacatactcacatttagttattggcttagattcactcccccaccctttgtctataccttcctatcaaggtgctttttggttcgttgatttagtgctgtaataagttaacagagtaatctattaccattgttttatgtttggttagactataccgtaaaggattgcagtgggatacaatacccagccaattcaaaatcattactgctttttgactgtcagccaactccgatccttctttttggatcccacgctgcaaccaaacatagaccgataaccattcacattaaaagatagcaggtgcaataagttccattcccattactactaccgttgccgaaccaaacggcacgcaagttgtaacataattctcgatatatctatatatccaaacatcttagtataaaaaaaatcacagtaggggccccttctattcaggaacctctcttgcaattaatcagcagctggagcgagactgcccggatgtcatcttgattagagacttagaggataaaaatgtaacttttcagcaggtgttcttaaattaacagaaaaaggcgtactaatattagcgaggatatatattcttgttcgattagggccaaaaattgattgaaggctaatgatggttaggcttaggccggcctaatgctcatctgtctcctgtctcttaaacaacgcagtgcggtgtggtgctggaggacaccatacgtgcgggccactcaagagtcacttcggcactttgt

SEQ ID NO: 361 - DNA, 1147 bp, Zea mays
  misc_feature (1)..(100): optimal_loci_9685_G1, chr1:51402863..51404009, Cluster 2
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(172): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
  modified_base (164)..(164): a, c, g, or t
  modified_base (165)..(165): a, c, g, or t
  modified_base (166)..(166): a, c, g, or t
  modified_base (167)..(167): a, c, g, or t
  modified_base (168)..(168): a, c, g, or t
  modified_base (169)..(169): a, c, g, or t
  modified_base (170)..(170): a, c, g, or t
  modified_base (171)..(171): a, c, g, or t
  modified_base (172)..(172): a, c, g, or t
tgcgcgctggagcatttttttacgctaagtcgggtagcgcgggcatgcggtccgcccgctgtgggcagcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccccccccccacccccccattaactgttactatcattgttagatggaatttcgcacgagctagtcaactcccaagaaacagcgctgcaaagtcctctgcttgtggtggcgccgtgtgaaataatttaatttaaaaccgccaagttgacgtttgtaaatctactgtactacatattatgaaaaaaaaaatggttgcatacaacagccgggggcgcgacgggcggtgtggtcggattccacgctgggggttgaaaatctcggccacttcggctggattcttgtgcgccggggttttttttatagcaaatgacgagtagggctatagggcatcccggatataacatctctccgatttggtactggtctctttggcggtttactcgatatgaatatactagctagtcctacataagatgcatgcttctatatcgttgctctggatagatttggattccgtgtccaggctgtgctcatcaccaagtttttttggtcagcgcagcagctttgtttcgttgcgtcgtgggtttggacctgtccgtgctctgaactggaactggccggggtttaaacaaaaccggatgcggtcagagggagtccattggttcgtggccagcttggccgggttttgcattgcggagctgtgcccgcttgttggcttgtgccgtgcgcgcaaacggaggtcaaagtgttaagctacgttggaccattgtgctcgttgaccccccagcggcagatgcgggaggcagggcccttgtatatgcgagcccaatgccagatgcgtacaaccgctcattttgctgttttaggtctttaaaaataatacttcatgtagctactctcacaaataagtgaaagctgctaatccagagatcgttctaaggaaaatataggtatttctttggagagagagggggattcaaactacacaatatagctgttgagtaccatttgtgacactagatactacca

SEQ ID NO: 362 - DNA, 1163 bp, Zea mays
  misc_feature (1)..(100): optimal_loci_96967_G1, chr3:25924878..25926040, Cluster 2
accaacaagcgacgaggatctcgcgctcacacggcactgcgctgcacgtaaactaaagaaaaatccaggagagacgagagggtccgtggtttttttttacttgatgacgactgagctctcatcagtttagtttagctctaaatgacatggaagtatatatacatgctctcaagaagcactttttttgtttgacggcacccgtaaaacagcacgttgcggggcccgccagaccaccaacaagcgacgaggatctcgcgctcacacggcactgcgctgcacgtaaactaaagaaaaatccaggagagacgagagggtccgtggttttttttacttgatgacgactgagctctcatcagtttagtttagctctaaatgacatggaagtatatatacatgctctcaagaagcactttttttgtttgacggcacccgtaaaacagcacgttgcggcggagaaagtcggcattgaccatcaccaatacgacacctagttgctaaatttctgacgctgccgctactcatcatggatgtacacgtattccggtggtgtacctacgacgtacgtaggagtacgatctagcctgctctagagcaagaattggttggtgaggaataaacactagtagtacctaccaaggcagcgagaggaccaggaatgatatgatatacggaccgtgtgtgtgtgatctgtgatgtgatgtcataggggatcagcattcgcatctctctctctgtgcaaatttccatccgcaccgcctcttgcgtggaccattttcaattctgcatgtgcatgcgtggtcaagttgcgatatgcacgcgactcttgctgctttgtttattattttgttttattttttttggttcaatcaagcgacaacagtacctgcctctgcctgcgtgtttgaacaataggggtaggggcagctgggcgggggaatcaaagcacacacacgcagagtagtgagtgtaatccacctagcagtttggcagttagtatcacatagaaaactacataccaacgtagtaattacatattattgtggtgtactgaaaacgagattcatagaagtgcaaaattatagcatccgttcatttttctaagggtgattacatacatatacagggctcgtttaggagagctctggtgtcatatgatgatttgt

SEQ ID NO: 363 - DNA, 1096 bp, Zea mays
  misc_feature (1)..(100): optimal_loci_98130_G1, chr3:32243039..32244134, Cluster 2
tatagtatatcttggtgttgtctatgcacttgaaacattaaaaactaccttctagacaatatacagtaatgctagccttttctggtagctccaagagtgacgttggatctttctagctagcagttaactaggaccattaatcacatccttataaacccaacaaaatacttccattagttatttcgcattctgttttgtcggttaagacacaatgtagtgcacgatcagatttaatatagatagtcatacaattaagatgtgagtttaattgaacaacttggtcatctagtgccactagatgctaaatttatatgcatcacatataagcggcacacgtgagagcaagtaaaaaaggtttattgagaacactttgaaaacactaacttggctctaacatgtttggcaaaaaaaagagttagatgagaaagtaccatcgatgcaaattttcaaagtacaccagtgagacactggatatgaaaatggcccaattttagttcacatctttcggccgagcaccatggtgtctgttgtgcaccagataggatgtaccagaggtattcgatgaggcactagatggcctatcggatagggaactcagagaacatgttgaacacttaactttagccttataaggcgctagccgtgtttagtgtggcacgaggtatcacactggatagggcacttcaagaccatgttcttttgtgcggatcagtccaacactcattagatgtgtccggtgaagtatccgatgagtgcaccagatatctgacaagtttaatactagttcgattgaaagggcgccgacacatctggtgtagagaccaatgaagcatcagacaaatttgggtccctaatctctattttccaaatcataatgacagattcctttatgaggttataagtagatggcatggccaaccttagctggcatccttcgaccactaacacttgcatatatttcttgagccttgagaaacaccctccactcacttgcaacacatagttcatgacttgagtgagattgggacactcctagtgggaccaagtaactcggtcctagtcggggaactcagactcggattggtcaactcagatt

SEQ ID NO: 364 - DNA, 1234 bp, Zea mays
  misc_feature (1)..(100): optimal_loci_9832_G1, chr1:52255980..52257213, Cluster 2
cgtccaaacaggcccttattctaacctcacgccactgaaacactccactgtacaacatgggactagctagcttggcgtgcagatatcgctgaaatcaaatgtgatagcgccagaaatcacaagaaacgaaaaagaatagcaaatggaactatggaagctctgtgagcaggaggttttggttatttgcagttcaacccaatcttgccatgatgagggcatggtgatatcaggatgtggtaatcaaccactgccacagcgttcctgtttgcttagacttgccggcaacgtctaggcgccacattagaatagtcctcgtgtgatactccccgctttgactagctgcgtctgcgtctccttcacttgatcctttccgttgaattaacgaccgcgggggccttggtggactctaatctaacgcccaatagccacaagttgatttttttaataggtatataatttaatgtgctaaggccaccaaacatggtgatgacaaggaaactagtatgatttaaaaaggcctttttttgcgaaatgatttaaaagatccttgtatgaccataagtaaagggtaagtttctcattttatcttttgatatttatggctgctttaagagcatcatgccctcattccctctacctaggatctaggtcaatggctgatacaatacagtagtacctaacttcaaggacaggaagctgtttcattcttcctgacgacagcaacaatctactaatcatgcacgactggtcatatatttcaaccatctaaccactggccatgcttgctgcttcggttacatatatctatcccaaggtttacaaaaccagtcagaaccggcggtaaaaccgcccggtttactgaaactgtcggtgcgcggtaccggttaaccatcgttttttaattcattccaaatttaaaaagttaggtcttttttataaaaaacgaaaaccacgggtaaaccttcctattagctcggtaaaccgccctattggctcggtaaaccgccactttttaccggtaaaccggatttaatgtcaagattaagttccaatttagacatttagtggtcagtttagttatattagtcttgtgtactattgtatgccatatgtgaagatgttatatgctacatgtgaatatgattaacggtttgatactatttttttgtctagtttaagtgttaatttagtgccctgacattattagtgtttaactgtttatacaggacatgtt

SEQ ID NO: 365 - DNA, 2379 bp, Zea mays
  misc_feature (1)..(100): optimal_loci_9811_G1, chr1:52159463..52161841, Cluster 3
aaaagctccgccattttgttgtccattagttttgctctccatcaggtggccggcgggtctcgctcgccttctcaattttaccatgctcgcggcaatgatggccgtccccgtcgtcgtcgaagaagaagaggaaagattcggcgggtttctctgagaggcgggcgaatacagtgagagcagcgagacgtgatcaaagcaaccgcgtcctgatattttgttaccgatggctgctatcgctgtcgtgtctgccaggttctggaagtagtactgcacaagtgtcaagtttttactggcgctacaaattgacgtcgtcgccacctgcaggaattgatgcatgatcggaagagttcgtggagccataggattgtgcaggcgccggccgagagccagcagacgacgtcagagagcggaggcccgtccaagctctaggaagcttcctggcaggtgcgcgcgagagcggcggggagtgaatgaattgccgaaagctccacgccgccagccagccagccacctgcttctctggatggccacagagaggacgcgagaatttgcttgaaaatgcctccggacgatcggatttttgttctgttttgttttgctgacgctacgaacgtttcgatgattttgggaacgaatggcccgctagcgtggcttccggtcagagaggcatcactcgccgtcgccgcccagcgtcgctcgctccacagaacgacagatccttgcgatcgcacccgatctggatgtccttttagaacgcagccattcgttcgtgacgcccggtgcggtcaggtcggcatcgggggcaacccacccgccacggcagtcggcggccccgacgaacgtcagtgcgtcatccgtgccgtacccggctccggcgccacgtactagtactggtagtacttggtaggcagcgcgcggagggagctagagccggtcgctttccggccctgtccatttcgcacgcagtaaacttacgtggccaacaggccaagcacaacgggccgctagctcagctgggcgtagcctgtaccagcaaccaaccaacccagacggccaaaccaaagacgcccacagcacaacgtcgcgggggccgcggcaagcgcacgtcgtgctcgacggccggatcgggcggaaggaagcttcgcggcagcttcgtcctgggggcgcggagtgggggcggttactacagcctgcgggacagcggcggagtcaggtggatctcagctcagctcagggacgggaaaacgacgcgcgggcggcccgcgtggcccacgacgcgccggacggtcgcttggacctctcgtcgccgtccctatcacatcggtcagtgtagcgtactgggttgcctcggcgcggcccgtgcgccgtgcttatcttatcttggctcgtcgtcggcctcctccgcgccgcggtgccgaccggaccgacgaggtttccgtgcgacgcttctcttgcctgggactgggactgggcaaacggacgtgcatgcccaaccatgcgtggcgggacttgtgcggccaaatgtgggtgcgcgttttctgcggtcaaaaaggcgggcggggggtggcggcgttcagtgcagtgcagccgccggccggactatacgtacggcgctggatgatacgcgatgtgtgacctccgttccgcccaccacgctgtggactgtggtcgtcgacgtgccggtgctattccgtgctggttttcctgcgctgttacgagcagcagagtacaatccacgtttggttttttttctctccctgcgcctcggtcgcgggcgcaccacggtcatgcatgcacgagcatgacggagagagacaaacgtttttttatagatgctcgatcgaattttcctctgttttgtatacatttctgtttgtttgctgctgtgtgtcgtctcgatatgttaattgagcttgtgcacgcgcgcgtttcacgatttttttgttacgtgcacgtggtcgagcaattagcagtatttgagttgagaagaatacagaatactcgtgtcaactaaccacactatttttgagctgatggtatatttctcccgaacatttttagacccacacacaccgtttacatactctactcttgtctgtccgtacctatttgttctcgtaaagattgaagcaatcatgtagttttttttatttgagatggctccgtgattccaaaactcccctgtcgtacctgttctctaagcatatttttgtagattatctgacgacgacaatatcttgccaacatctaccacccgccgccgccgttcatacgctagtagtattttatctgttaccacatcttctgacgacacaatggcaactccaacgagcagcgattattagaagcgagcatctcgggacatgattcagtaggaca

SEQ ID NO: 366 - DNA, 2114 bp, Zea mays
  misc_feature (1)..(100): optimal_loci_10697_G1, chr1:57254686..57256799, Cluster 3
ttatattctaacaattttcatattctttcatccacgatgttccgagagacgaccgtgattcctgccaagcacacgatgcatccagcaccggtagagtggagagctcaatcgctagccggtgaatacaatgcatagcgatgcatggagctccgcagtccacagttccacaccgacccatccacctgtgaaacgatgcaagttgccggatcctggaggcctgccctcgtctcgacccatcgctttctcgttcgtttttttctcgtccgaaacagccgcgcgcatgcatcgggaggcccagatggtccatgcatccacaatatcgtcacagttcagaggcgaaagcgagcgccttgtctgtattttcatggcagtggcgcggcaccccatcacaactcacaagctgccgagatcggttagctatagctcgcatgcctgcgcggccggggagtggaacgaaccaccagcccatctcacccacggccagtcgtccatgtctgtgcatgcgtgcgctgccgtgcttcgtgccactcgcgcatgtatcacgggcgagcacaccagcgtcacgcatggagggcgtctttattaatttgtccccgcctgcggcagtgcacatgcatatttgcaacagtatacaggctgcgggagtggtgttcgtaccggttggttcaagtcgcgccatatcagctatcaacagtactactaccgatcttcttgctatcgattttcgccatcccttatctaaccagcgctctaatacataatctttagctttagtctatacccatcttaacatcacattagtttttttagacttttagttgacaagaaacatgcgattttactaaaataaaaaagtatccaattacataattaagcaaataaaactatataacttaaacatgaaaacaaaaagtacataattcataaatataactaataaactaccgctcttactccatcttcctctaccacctctttgatcgtttctcccttctctaatttaagctgctttgtcaactttttcaaggctaatttgtaggttctttttgtgtcttcgtccatatcggcaagtgaaacgatccaacaatttattaaattacttaaataatttagtttgagcatttatctcactagacttgtagtgcttcttctctacattccttctacgtagatgaagactcgttactacttgttgttgggccattctctttccattgagctcttgtcctatcgtcatcaataggatgtggtgagtctacacttttatgtgacactaggctatgatcaccgtccattttgagacaagatcttttccttagattacttgtcatcgctatcgtgcttcacacatcacttaagctgatagcgaagagcgcgtcacatgtgctcgagcttgaactcagatttttaggcttgttgaagaaactatatttggccgctttaagtagcatagcatcatctgctccactcgaccaggtcatgtacaagtggttgtagatgcagttaaggaggatgatctttcggttgctcgtcgaccaccattttttcaattgcttggggtacgatggtgagaagcttctgtgaaggagttgtatctattgactatttgcccctggaatgatgatccctccttatcattgccatcaatgggatccaccaattatagtagccacacatgcatctaaaaaatatgaacctaaaaactattatggacctaaaacatatgtggactttcaaaaatatgtgtacttaccagcctttcattcttcactctttgtgcaatcccttcatagctaaaattatggagtgccagagtaagcatactagttcaaagcgacatcactgcatatgtttggtgacattgtcgtggctattggaggacgagcactgtacgaagtaggagcaccaaacgagagagggaattgcggatgagaaccatatggaataacatatgtaggaggagccccataatccatatggaggagcacaatatggatatccatatggatatggaggatggtatgggtaaggaaattgtggtggctgctccatatgttatcgattggtcagtaccaatccagatcgaccatgtgtaaccggtcggtcagtaccaa

SEQ ID NO: 367 - DNA, 6844 bp, Zea mays
  misc_feature (1)..(100): optimal_loci_109456_G1, chr3:107457514..107464357, Cluster 3
  modified_base (663)..(663): a, c, g, or t
  misc_feature (663)..(663): n is a, c, g, or t
  modified_base (1975)..(1975): a, c, g, or t
  misc_feature (1975)..(1975): n is a, c, g, or t
  modified_base (2194)..(2194): a, c, g, or t
  misc_feature (2194)..(2293): n is a, c, g, or t
  modified_base (2195)..(2195): a, c, g, or t
  modified_base (2196)..(2196): a, c, g, or t
  modified_base (2197)..(2197): a, c, g, or t
  modified_base (2198)..(2198): a, c, g, or t
  modified_base (2199)..(2199): a, c, g, or t
  modified_base (2200)..(2200): a, c, g, or t
  modified_base (2201)..(2201): a, c, g, or t
  modified_base (2202)..(2202): a, c, g, or t
  modified_base (2203)..(2203): a, c, g, or t
  modified_base (2204)..(2204): a, c, g, or t
  modified_base (2205)..(2205): a, c, g, or t
  modified_base (2206)..(2206): a, c, g, or t
  modified_base (2207)..(2207): a, c, g, or t
  modified_base (2208)..(2208): a, c, g, or t
  modified_base (2209)..(2209): a, c, g, or t
  modified_base (2210)..(2210): a, c, g, or t
  modified_base (2211)..(2211): a, c, g, or t
  modified_base (2212)..(2212): a, c, g, or t
  modified_base (2213)..(2213): a, c, g, or t
  modified_base (2214)..(2214): a, c, g, or t
  modified_base (2215)..(2215): a, c, g, or t
  modified_base (2216)..(2216): a, c, g, or t
  modified_base (2217)..(2217): a, c, g, or t
  modified_base (2218)..(2218): a, c, g, or t
  modified_base (2219)..(2219): a, c, g, or t
  modified_base (2220)..(2220): a, c, g, or t
  modified_base (2221)..(2221): a, c, g, or t
  modified_base (2222)..(2222): a, c, g, or t
  modified_base (2223)..(2223): a, c, g, or t
  modified_base (2224)..(2224): a, c, g, or t
  modified_base (2225)..(2225): a, c, g, or t
  modified_base (2226)..(2226): a, c, g, or t
  modified_base (2227)..(2227): a, c, g, or t
  modified_base (2228)..(2228): a, c, g, or t
  modified_base (2229)..(2229): a, c, g, or t
  modified_base (2230)..(2230): a, c, g, or t
  modified_base (2231)..(2231): a, c, g, or t
  modified_base (2232)..(2232): a, c, g, or t
  modified_base (2233)..(2233): a, c, g, or t
  modified_base (2234)..(2234): a, c, g, or t
  modified_base (2235)..(2235): a, c, g, or t
  modified_base (2236)..(2236): a, c, g, or t
  modified_base (2237)..(2237): a, c, g, or t
  modified_base (2238)..(2238): a, c, g, or t
  modified_base (2239)..(2239): a, c, g, or t
  modified_base (2240)..(2240): a, c, g, or t
  modified_base (2241)..(2241): a, c, g, or t
  modified_base (2242)..(2242): a, c, g, or t
  modified_base (2243)..(2243): a, c, g, or t
  modified_base (2244)..(2244): a, c, g, or t
  modified_base (2245)..(2245): a, c, g, or t
  modified_base (2246)..(2246): a, c, g, or t
  modified_base (2247)..(2247): a, c, g, or t
  modified_base (2248)..(2248): a, c, g, or t
  modified_base (2249)..(2249): a, c, g, or t
  modified_base (2250)..(2250): a, c, g, or t
  modified_base (2251)..(2251): a, c, g, or t
  modified_base (2252)..(2252): a, c, g, or t
  modified_base (2253)..(2253): a, c, g, or t
  modified_base (2254)..(2254): a, c, g, or t
  modified_base (2255)..(2255): a, c, g, or t
  modified_base (2256)..(2256): a, c, g, or t
  modified_base (2257)..(2257): a, c, g, or t
  modified_base (2258)..(2258): a, c, g, or t
  modified_base (2259)..(2259): a, c, g, or t
  modified_base (2260)..(2260): a, c, g, or t
  modified_base (2261)..(2261): a, c, g, or t
  modified_base (2262)..(2262): a, c, g, or t
  modified_base (2263)..(2263): a, c, g, or t
  modified_base (2264)..(2264): a, c, g, or t
  modified_base (2265)..(2265): a, c, g, or t
  modified_base (2266)..(2266): a, c, g, or t
  modified_base (2267)..(2267): a, c, g, or t
  modified_base (2268)..(2268): a, c, g, or t
  modified_base (2269)..(2269): a, c, g, or t
  modified_base (2270)..(2270): a, c, g, or t
  modified_base (2271)..(2271): a, c, g, or t
  modified_base (2272)..(2272): a, c, g, or t
  modified_base (2273)..(2273): a, c, g, or t
  modified_base (2274)..(2274): a, c, g, or t
  modified_base (2275)..(2275): a, c, g, or t
  modified_base (2276)..(2276): a, c, g, or t
  modified_base (2277)..(2277): a, c, g, or t
  modified_base (2278)..(2278): a, c, g, or t
  modified_base (2279)..(2279): a, c, g, or t
  modified_base (2280)..(2280): a, c, g, or t
  modified_base (2281)..(2281): a, c, g, or t
  modified_base (2282)..(2282): a, c, g, or t
  modified_base (2283)..(2283): a, c, g, or t
  modified_base (2284)..(2284): a, c, g, or t
  modified_base (2285)..(2285): a, c, g, or t
  modified_base (2286)..(2286): a, c, g, or t
  modified_base (2287)..(2287): a, c, g, or t
  modified_base (2288)..(2288): a, c, g, or t
  modified_base (2289)..(2289): a, c, g, or t
  modified_base (2290)..(2290): a, c, g, or t
  modified_base (2291)..(2291): a, c, g, or t
  modified_base (2292)..(2292): a, c, g, or t
  modified_base (2293)..(2293): a, c, g, or t
  modified_base (4555)..(4555): a, c, g, or t
  misc_feature (4555)..(4654): n is a, c, g, or t
  modified_base (4556)..(4556): a, c, g, or t
  modified_base (4557)..(4557): a, c, g, or t
  modified_base (4558)..(4558): a, c, g, or t
  modified_base (4559)..(4559): a, c, g, or t
  modified_base (4560)..(4560): a, c, g, or t
  modified_base (4561)..(4561): a, c, g, or t
  modified_base (4562)..(4562): a, c, g, or t
  modified_base (4563)..(4563): a, c, g, or t
  modified_base (4564)..(4564): a, c, g, or t
  modified_base (4565)..(4565): a, c, g, or t
  modified_base (4566)..(4566): a, c, g, or t
  modified_base (4567)..(4567): a, c, g, or t
  modified_base (4568)..(4568): a, c, g, or t
  modified_base (4569)..(4569): a, c, g, or t
  modified_base (4570)..(4570): a, c, g, or t
  modified_base (4571)..(4571): a, c, g, or t
  modified_base (4572)..(4572): a, c, g, or t
  modified_base (4573)..(4573): a, c, g, or t
  modified_base (4574)..(4574): a, c, g, or t
  modified_base (4575)..(4575): a, c, g, or t
  modified_base (4576)..(4576): a, c, g, or t
  modified_base (4577)..(4577): a, c, g, or t
  modified_base (4578)..(4578): a, c, g, or t
  modified_base (4579)..(4579): a, c, g, or t
  modified_base (4580)..(4580): a, c, g, or t
  modified_base (4581)..(4581): a, c, g, or t
  modified_base (4582)..(4582): a, c, g, or t
  modified_base (4583)..(4583): a, c, g, or t
  modified_base (4584)..(4584): a, c, g, or t
  modified_base (4585)..(4585): a, c, g, or t
  modified_base (4586)..(4586): a, c, g, or t
  modified_base (4587)..(4587): a, c, g, or t
  modified_base (4588)..(4588): a, c, g, or t
  modified_base (4589)..(4589): a, c, g, or t
  modified_base (4590)..(4590): a, c, g, or t
  modified_base (4591)..(4591): a, c, g, or t
  modified_base (4592)..(4592): a, c, g, or t
  modified_base (4593)..(4593): a, c, g, or t
  modified_base (4594)..(4594): a, c, g, or t
  modified_base (4595)..(4595): a, c, g, or t
  modified_base (4596)..(4596): a, c, g, or t
  modified_base (4597)..(4597): a, c, g, or t
  modified_base (4598)..(4598): a, c, g, or t
  modified_base (4599)..(4599): a, c, g, or t
  modified_base (4600)..(4600): a, c, g, or t
  modified_base (4601)..(4601): a, c, g, or t
  modified_base (4602)..(4602): a, c, g, or t
  modified_base (4603)..(4603): a, c, g, or t
  modified_base (4604)..(4604): a, c, g, or t
  modified_base (4605)..(4605): a, c, g, or t
  modified_base (4606)..(4606): a, c, g, or t
  modified_base (4607)..(4607): a, c, g, or t
  modified_base (4608)..(4608): a, c, g, or t
  modified_base (4609)..(4609): a, c, g, or t
  modified_base (4610)..(4610): a, c, g, or t
  modified_base (4611)..(4611): a, c, g, or t
  modified_base (4612)..(4612): a, c, g, or t
  modified_base (4613)..(4613): a, c, g, or t
  modified_base (4614)..(4614): a, c, g, or t
  modified_base (4615)..(4615): a, c, g, or t
  modified_base (4616)..(4616): a, c, g, or t
  modified_base (4617)..(4617): a, c, g, or t
  modified_base (4618)..(4618): a, c, g, or t
  modified_base (4619)..(4619): a, c, g, or t
  modified_base (4620)..(4620): a, c, g, or t
  modified_base (4621)..(4621): a, c, g, or t
  modified_base (4622)..(4622): a, c, g, or t
  modified_base (4623)..(4623): a, c, g, or t
  modified_base (4624)..(4624): a, c, g, or t
  modified_base (4625)..(4625): a, c, g, or t
  modified_base (4626)..(4626): a, c, g, or t
  modified_base (4627)..(4627): a, c, g, or t
  modified_base (4628)..(4628): a, c, g, or t
  modified_base (4629)..(4629): a, c, g, or t
  modified_base (4630)..(4630): a, c, g, or t
  modified_base (4631)..(4631): a, c, g, or t
  modified_base (4632)..(4632): a, c, g, or t
  modified_base (4633)..(4633): a, c, g, or t
  modified_base (4634)..(4634): a, c, g, or t
  modified_base (4635)..(4635): a, c, g, or t
  modified_base (4636)..(4636): a, c, g, or t
  modified_base (4637)..(4637): a, c, g, or t
  modified_base (4638)..(4638): a, c, g, or t
  modified_base (4639)..(4639): a, c, g, or t
  modified_base (4640)..(4640): a, c, g, or t
  modified_base (4641)..(4641): a, c, g, or t
  modified_base (4642)..(4642): a, c, g, or t
  modified_base (4643)..(4643): a, c, g, or t
  modified_base (4644)..(4644): a, c, g, or t
  modified_base (4645)..(4645): a, c, g, or t
  modified_base (4646)..(4646): a, c, g, or t
  modified_base (4647)..(4647): a, c, g, or t
  modified_base (4648)..(4648): a, c, g, or t
  modified_base (4649)..(4649): a, c, g, or t
  modified_base (4650)..(4650): a, c, g, or t
  modified_base (4651)..(4651): a, c, g, or t
  modified_base (4652)..(4652): a, c, g, or t
  modified_base (4653)..(4653): a, c, g, or t
  modified_base (4654)..(4654): a, c, g, or t
gtgatgttgcgatctgtctgtctgacgatcgagcgtgagagtgtcgcgatgtgtcgagagtgcgagtcgcgtgagtcgtgtcgcgacgagacgtgtcgatgtgtgcgagcgatcgatatgtgacgatgcgatgagagcgacgagtgactgagcgagcgagcgcgagcgatgtgcgatgtgttctcgcgagtcgagagtgtgtgcgcagagcgacgagcgacgatgtgtcgcagagatgcgcgagatggcgagatgtgcgtgcgaggtgtgagatggtgatcgatggcgatcgatcgaggtgtggcgagcgagtcgtgcgagcgcgcgaggaggacgtggagacgagtgcgatcgatcgagagagcgagtcgatcgagctcgatcgagcgcgacgcgatcgcagagcgagagcgagagtgcgacgagagcgagatgcgagcgatcgattgtgtcgacgcgagttcgagagtgagcgagtgagacgatcgacgcgagagcgacgagcgatgcgtgcgcgacgcgatcgcgagtgtgtgatgtgtcgacgtcgtcgacgagcgagagagagcgacgatgtcgagtgcgcgatcgagacgtcgatcgacgacgatcgcgatcccgagcgacgtgcgagcgtggcgatgtgcgagtgtgatagcgtgngtgcgatgcgatgcgcgagcgacgtgcgatgcgcgatgcgacgatgtgtgtgtgttgaggtgtgtgatcgagcgaggcgtgcgacgacgcgattcgccgacgacgagtcgatcgtgtcgagtttctgtgcgatgtcgcgatcgtgagtgagcgagtcgatgagtgtcgatgtttgacgaggtcgaggagagcgatagtgtgcgcgagttgttgtgcgatgtcgcgatcgctgacgagtcgagcgatcgacgagtgtgacgagatgtgcgagagtgacgactgatgcgtcgagacgatgcgagtcgacgatgatgacgacgcgatatgcgatcgagtcgcgacgcgacgatgagcgatgcgagagtgtgagtcgatgtgctcgatgtctcgagtgtcgatgtcgaggtgtcgacgaggtgcgtgtgcgacgctgagtcgatgtgtagcgagcgatcgagcgagcgatcgtgcgatcgacgatgtgtgtgcgagcgcagcgattgcgagcgatcgacgagagtgcgtgtgagtcgacgagatgatgcgagcgagtgatgtgtcgtgatgtgagagtgatgtcgatgagcgagtcgatgcgatgagcgagagcgagtgctcgttgttcgtcgagagtgtcgtgtgcgatgtgtcgagcgactgtgtgtgagatgtgcgagagcgagcgagcgacgatgagtgtcgagtgtcgcgatcgcgacgatgtgagtgtgtgtcgatcgcgagcgcgatgatgtgtttcgagtgcgagtgtgttgtcgtgagtggcgagcgtgcgatctgatgagcgaggacgaacgagtgcgaggacgcgaggtgtgtgtcgacgatcgacgtctcgatgacgcgacgaggtgtcgtgatcgccgagttgcgagcgcgatgcgcgtgcgatcgcgcgttgtgcgagtgcgacgcgatgtcgagtcgacgtgcgagcgacgagcgtgtgagagtcgagcgagtgcgcgatgcgagctgtgagtgtgagccgacgcgatgctgagtcgatgtcgactgatgcgacgagtgcgagagtgtagatcgacgagagcgcgagcgcggatgttgtcgctgagagcgagcgagtgtgcgatgctgatcgagcgatggcgtcgagagcgactgatatggtcgagcgagtgcgcgactgagacgtcgcgcgagtgatcgagactgagtgtctgactgacgagagacgagatgacgactgagtgcgatcgagcgagtcgactgagtgatcgactcgagctctgactgtgacgcgagctgatcgcagatcgcagacagatcnatgactctcgatgatgtgctgaggacgtgacgagtgctgacgatcgacgatgagagtgatcgactcgatctgtctgacggaagacgcgtcgactgacgcagatgctgcacctacgaacagtaatctgtatatctctacgatccatgtatgcaggcagtagctgcactgcgagaatagatatgcggcgagccacgagtcatgcgaggcgagtgcacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgagagacgcagagcgacgacgacgcagacgagcgagagcgatgcagagcgcgactgagcgaggcgacgtgtcgcgagtcgagagtgacgaggtcgacgatgatgcgacgatgcgcgatcgagcgagtgtgcgcgagatcgacgtgacgatgtgtgttcgtgagtcgtgcgcgagcgatcgacgacgcgagacgcgacgatcgacgacgagtcgatcgtgacgcgagtgcgcgatcgcgacgatcgatgcgagacgcgatgagacgacgagtccgatcgagtgagtgtgagcgagagcgatgagtgtcgatcgctgcgatgcgatcgcgatcgatgtgtgacgcgtgtgcgacgtgagtgttgtgtcgagagagcgatgtcgcgagacgatgcgacgtgtgtgcgactaccgattgtgtgtttgtcgatcgtgagcgatcgagtcgagatcgacgagtcgagtgtcgcgatcgcgatgcgcgatcgcgagagagtgcgtgtgtcgcgatcgcgacgatgagcgcgagtgcgacgatgtcgagtgtgtgcgtcgacgagttgcgatgatcgatgacgatgcgagatgcgacgacgacgacgagtcgcgacgagacgacgagtgcgcgagcgacgatcgacgatgtgtgtgcgcgacgatgatgcgcgcgacgagcgaggagcgatgacgacgatcgcgacgagcgatcgcgattcgagcgacgactgagtcgagacgacgcgacgcgagagtgacgagtcgtcgacgacgtcgtgcgagcgagcgatcgcgcgagacgagtcgagagtgtgcgcgacgtgtgtgctgcgagcgatgtgtgcgagcgtcgcgacgatcgcgactgtgtatgagtcggagagatcgcgagcgaggcgtgatgcgacgagagtgtgttgtgttgttgcgagcgagtggcgacgagtgtgatgtgagtgtcgatgtgcgtggcgatcgtgcgtgacgagcgagtggtgcgatcgagcgatcgatgtcgagatcacgagacatgatgagtgtcgagtcgtcgagagtgtgtcgtgagatggcgcgacgtgtgaggcgagtcgtcgagcgatgcagcgatgcgagttgcgagcgatcgacgatgcgaggcgacgtgcgcgagcgcgagagagcgaggtgtgtcgtgacgacgacgcgcgagatgagcgagtgcgagagtgcgagtgtcgattcgatgtggtgcgtgtgtgcgagtgtgcgagcgacgacgacgagcgtcgcgagtgtcgattgcgcgacgatgtgtgtggcgcgcgagacgagcgagcgcgagagcgagtgtggcgtgtcgagcgtgcgtgttccgagcgaggcggatgtgtggcgagcgagcgatgcgtgcgcgcgtgtcgcgatgcgcgacgcgtgcgtcgagacgatcgttcgagagcgtgacgacgagcgagtcgatgcgtgacgcgatgacgacgagcgatgcgaggtcgatcgtgcgtggcgcgtcgagtggtgcgacgagcgacgatgtgtgtcgtggcgatgtgcgagcgagcgagcgacgacgcgtgtgacgtcgacgtgcgatgtcgatgttcgactgagagtgtgagatgttcgatgttgtgtgtggctgagatcgcgcgaggcgcgagcgcgacgagcgagacgatgtgtgtgtgtgcgatcgagttctatgatcgatgcgatcgatgtcgcgagaacgcgtgagcgagcgacgtcgagtcgatcgagcgcgcgagcgagattcgtgagtgagtcgagatgtgagatgatgacgtgtgagatgtgcgatgaggtgtgatgacgatcgatcgaacgatcgatgcgacgcgatcgagcgacgagcgcagagctgtcacagtcgatcgcgagcggacgatcacgagaccagagcgacggagcgcgagagaggcgggtgtcgcgacgcgactggtcgcagtgcgtgtcgcagacgctgagtgcttcgagtgtgatcgatgcgctggactgtgagagcgcagacgcagcgcagatgcgactgcatgagggtgtctgagctgcagtactctgcagcatgcagcgccggctgctgcagagccgcggagaggtctgcaggactgatctgtctgcagtactgcagcagtagcagctgcgcagtatctcgtatacctgcgagcgcgatacacatctgctacgtgaaagccacgcgacaaggcacagcgagcagagcaacacgagaaatacatgctcgatcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagtcgacgactgacgcgatgtctgcgagtgtgcgcagagccgcgtcgacgagacgcgatcgtcgatgacgcggtgtgcgagtcgatgtcgaggcgcgatgctcgatcgcgagtcgcagacgagacgacgagtcgatcggtgtgagacgatcgagacgtgacgcgacgcgaggcgagcgatgcgacgagtgcgcgagtcgatgtgcgacgtgagtgtgacgagtgtgcgagtgtcgcgagacgtgatggtcgcggcgtgctgagatgctgcagagcgagtgagcgctgcgatgaggcgatgatgcgtggatggcgagtcgagggcgatgtgcgacgagtgtcgcgctgagcgagttcgacgagatgagcgagcgagcggcgatgtgtgcgcgtgcgtcgacgaggtgtgatcgagagcgagcgattgagcgatcgcgatgtgtcgtgagcgtcgattgtcgacgacgtgtcgagatgacgtcgagtcgaagtgcgagtgatgttcgagtgatgtgtgacgatcgatgcgacgagtcgtgcgtgcgtgtctcgacgatgtgcgagagcgatgatgtgagtttgtgatgagtgtgtgtgtcgagtgagtgtcgtcgcgtgacgatcgagagatcgagtgagtggcgtcgcgagtgagcgatctgtgtgatcgcgatgttgatcgacgtcgacgagagttgacgagtgagcgagtgcgacgtcgcgagacgtgcgagacgacgtctgatgattgatgagcgacgagtgtcgtgcgatgtcgagtgtgtcgtcgtcgatgtgtgatgctgatgagcgatgtgcgacgatgcgcgatgatcgatcgcgatcgcgatgtgtgtgtgtgtgtcgacgcgagatcgctatggcgatgttcgtgcgatcgatgcgcgcgatagcgcgcgatgatgcgcgagatgtgacgagatgagcgagtgcgcgagtgttcgagcgtgcgatagcgcgagagcgatgtcgatgtgcgagcgtctgatgtgcgcgagcgacgagatgacgtgcgcgagcgagatgtggtgtgagtgagtgtgcgacgacgatgcgtcgacgattgtgtgcgtgtcgcgtcgatgcgtgtcgagtgtgtgggtgtcgtgagcgatgcgagtgcgagtgtgagtgcgagagcgatcgagtgtcggcgagcgaggtcgagagtgcgagcgagtgttggtgtgtgttcgacgacgttggttagtcgagagtgagcgtgcgagatcgcgagtgcgacgacgcgtgagatcgcgagtgtgagtcgtgcgcgagcagacgattggtgtgacgatcgatcgagtgtgtcgagcgagccgagagcgatcgcgatgcgatcgagagatcgacgcgatcgaggagatcgagcgagcgagatgtgcgagttggcgatcgatgtcgatcgacgacgacggacgttcgacgtgagacgagcgcgtgcgagcgaggcgatgcgcgacgagcgagtgcgcgagagcgcgagacgtgtcgacgagtggcgacgcgagaagctgatcgagacgagagtcgatgagtcgacaacgcgatacgcgatgcgagcgcgtgtgtgtgcgtgatgcgtgagatcgcgagcgaagcgtgagtgctcgattcgattgtgtgagcgatcgacgctgtgagtcgatgctgatcgagctgatggtgtgatgtgtgtgcgatcgctgagtgcgcgtgtgagcgatgatgacgattcgagtcgagtcgacgcgagcgcgcgagaggcgcagttctgtgacgatcgagagagtgcagagcgcgtcggatgtgcgatgagcgcgatgcgatgtcgcagtcgcgacgtcgagtgcgatgtgcgatgcgacgcgagcgagatcgatcgtcgacgacgatcagacgacgatgatgacgagaggtgcgcgatctgatgcgatggcgatgtggctgagagtgtgctgatgtgtgtgtgcgagacgtggttgtgacgcgcgtacgatggcgcagctgacgagctgatgtgcgctgagcgactgtcgcagaggagcgaccgatagcgggctgtggctgctgtctggacgctgtatggttcggtagcaggtgatgctgcagtggcgcggcaagctgcgagctggcgagtcagcggatcgtgctcgctgtgcatggcagcagctgtagcatgtgtctgt

SEQ ID NO: 368 - DNA, 2272 bp, Zea mays
  misc_feature (1)..(100): optimal_loci_112750_G1, chr3:129034860..129037131, Cluster 3
gaatcgattcttcttttttttggtaagcatctgagacaaattagattattgatcctaaccatggttagtttattgataatagtagtagagatttgtggagtaaaaaaatagaaggcaagctacatgttttgttttgtaaaatagaaggcaaattatagttttaggaaaatccttagaaactgatcccctgcaatgaacacaggagcttgcaagagtgaccgtgtttttgtaacgcgacagctcatgtgtgagatagccaacaacaggtatgcgtcatcattcatttcaaaaagggacgatgcctcttttgagatatcagtgaagcaagcacacctgatttagctacaatgtgatgaacgaacaaatgtttcttgggagaacactattttagttgtagatcttgccaacatttaaattttgagattattaatatgagagccatgaaagatatatttgttacatggagcaagcaggcattttgcccacaattttaaaaataaaaagcataagattgtcaattgttggcacatgattttctataataataaagtggagaacggagttgtatcaaacgtgttattatgatactacaacttgtatttggagggtgaggcaataaaaaacgtgttatcatgtgaaatataaagactgatggttctcattgtaatatgtgttcatgcaacataaacaacaacaaaaagataagagaacattgaggaaaagtataaataaagtgaattcatccctaaagcatgagctctaatttactcaaaggaacccaaaagaggagcacagtaaacatgcccatatgcaaacaaatgcgaaattattctataataaatgtcacacaaatatgatatatgtgccctccatagtgccagccaccttaaatcttggtgtttgcgtgtatttagggatcgacatctcaaggttgaaagtcctgccctgtaatcgctacacaactctaaatgctgctacaatgctagaccattttttgttgccttatgaactaccaccacctgtaatgacaaaatgtgtaaaattgtcatgaactacatacatcaagaaaagaaaaggtcaactcaatccaccagatttcatacctgtcatatggaagatgaacaatctcagtacaaaagcaaggaaaatggaggcttgtttagtgcatatttcatggttgtcatagtaggaaatgttgattctttaggcatgatgaaagggaagaagaaagtctcctcttcgtaagccgccctatctgggaaggtcaagttcaaggtaaaaacaaatgaatggcaacattgacagaaaaaattatggtgcagatgagcattatgcctcacaccatagaatttatctggataattcatatcaaatagataagagtgtgaggcatgagaaaaaaagaccatctcatcttgggagattgctaacaagtcagatgttggaaatgatggtgacgtcaatatatctgccatgtttgatgagaaataagatgttttgccatttgcatctgcatcccttccttctccagaacccattttaataaatgaacagtgggtgtgctacgacaagtgtgagaattggcaacttctactctatgggatgaatcgagatatacttcccaaaaatggcggtgtagtatgcagagttggttgtaagttcatccacttcgttcaatttcttgcagtggtggccttgctgctccaagatcccattgaatttgattaagtgttgttaaatgctttatttggtttttaagtgcccttattttggtatttgcaaatcgttgtaggcctcgaatgaatagttgcaaaataactgaagatgaaatcataggagccctttgggcactttatatggttcctacacctggaaataacattaaggatggtggccatgataatgctatgacaggcataggcacaactattgctccaacgtttcatggaaatataatgtctatcatttcactagtttcagagggttcatctttagatggattgaatattagcccattcatatgaagagatggattacaggtggctggtgagggagaatccacagtcagagtttggggattatgaaggggatacgggtacagtggctgcaaactgctgatctacttactgaaggtgatggagcaggagcttcttcttgcaagagtccaggacgtcccagagcttctttgccccatcactgccgctacaactggaggttgtctgagcccgagaagacaagaagggcgcagcggggggatggcgtgggagggagg

SEQ ID NO: 369 - DNA, 1465 bp, Zea mays
  misc_feature (1)..(100): optimal_loci_116807_G1, chr3:153776773..153778237, Cluster 3
tgacaccctgtagtaattttagcatagtgaaggtccacggttacaaaatgcatgcacataatagcccatcactcatatgtacgacacacaacaacgcacacacgtttgtaattcacacatcctctctgtgtcggctccatccatttgtattgcagccatctccggtctctccaatccacaattcagcccctcctttgattttattctggatccgccactggcactgacatattaagaggcgcttgatttgttaaactcaatattaagggggtgtttgggagtggagtatttttctctgcttttagagaatattgtggtatatgtgatattttttataatatggtgtcgtttggtaacatcttcaaaaactatgtttgcaaaactgtggttttggctatgctacagttttctcacggtattggaaacttaggtcactgtggtaaaaaataatgtggatatatgttgacatttcaaaatggtagtattggttttaaaataatttgtttataaacatgggctaagtatttctttaactatgcgtatactctagataagctttgtttgacatggagtcacggagcatccaagaaaaaaaaaccacgtcacatcgagaatccccaacccgttggcatcagggctcgaccgttgtgtagcgggcaggttcatttgttcttttttctttgtaatggcaggagattgctttgctcacaaataatacatgacgttgattctgttcatatttttaatcgtatacatgccatcagctatactctatttgtagaaagtatatgtatcaatcgagtgttttaacacttggttgttctctcttcttctctaaacatgtagcctttggagaaaaaaaactcgatggccatgacgacagccagggaggaagaaagagatgacgccagacacggtaaggagctccacgaatacccttatttgaggcgaggcccgttactggcgtttttttccgtgaggtgcaggcctgcctgctgaatctcgccgtcagatatctaagggcccaggagagaccgataggcccaactgcctaacgtgcacagcgggcccagccagagatcgcaagggtcctgatgccgtcgtgccgctgccgccccccacagcctgagcccgtcatatcacggccagaaaaagcctcccactacactacccatccgatctgatgataaaaagagagagaaagtaaaaaaaaaaagaggcggagcaacaaaacggacaccctttttttgccctcctagaccaaacaatgtaagtacgtacactggacaggattggaagttggaacaaggaacagcagtgattagacttgagcgaagcaaacaaaggtactccactctcggcgtcggttggtttatattggacgatgacggtgaaagctcaactacaaccaccgccaccgcacaagaaacatgagccgtcttaacagcagcagtagtactatata

SEQ ID NO: 370 - DNA, 1724 bp, Zea mays
  misc_feature (1)..(100): optimal_loci_117888_G1, chr3:159860232..159861955, Cluster 3
tatcacactaaaatttgataccagcctaatcaaatttgttacggccagtaatcgagcgtaaatcattattattaccatttgcgttacatttcttgaaccaaacagtagcatgcatatgttttttttataatatagattttttttgaaaaatatgtacgttctcgtagatactactacttgtgtcaaagcgtggtactggggagagtctgtgtggttgtcctaaggacaccccaataatggttaatttttttgtaataaggacagcaaataaataaaaatgttgatgtgacattacaattaatgagagataatgaaattgattttttttataagaaaagtatgtatgtttatagagaaaccagcaaaaaaagacagtgataggttatgatatcagagataaggtagttgactgaataaaaaaagcaagaaaattaagaaaccatccattgagattaaataaaatatctatatatgtgtagcatctataataactggggggtatatatagaaactatatcacgatctatatgcttttatttaaatcccaagtcccaataccttgtaagcaatgtaaatgagatcatgggcggcgcgttattcgtattcttcccggttgccatcacccctttgtcaatggttttccgataccggagccgcgcgcatccgtcatgtcatgtggcagcagatgcatgagagcagagcagcaagcaaaaactattgggaaaaaacaaacaaacaaatggttctgcgcaacacgctgagatatttgaccaagctagctaggggcttcccgtgtagcttcaggaggcaaaatcaggcccgcgctcaggctcgaccagccgagaaagaagatttgaccaagctaacatctgtactatttcatccatctctctcgaaacgacgaattgctactgcaacgtttctagaacggctccgcggttttatggctcgagccgaaagcccagccgaaactatgctaagaaactgcacatgggggaattctgcagttgcggcccaccacgacacgacacgacaggtcatcctagcttcagcagccgttggattggatgtaatgtaacgcggcttagatttcggaatgtcgacaaaagctgggtgtgtattgcaaatgcatgcacggaatggaataaagctgaaaagaaagaagctatatgcgtgctgcgcaaaaggaaatatggaaatgccgctggtgctcatccggtccggggccccttttcctcccctccgatctccttttttttttttttttgcccccgctgcttcaagagactttagatcagaatgaatgcccgctggatgctgggggctttgggaaagccgagtcgcatttggtgccgccgtggcggggctctgaggtcgggtcgggacgagcacgagccggccgggggacgaagaaggggccatgcatgccggcgtgtggcgtgggaggtggccaccggagccagggaggtcgccggcgtaggagcctgaggcacacgacagaatagaaacgaaacggtactgagatctctctgtgtgtgtgtgagtgtgaccagtgacgatggctgccgttaataatttctattcaactctacgacaagatacaaaaaaaaaattaatatacgattttctaaaggacttaaccaaaacgacggatcaagtcttcatcgttttggcaattaaatttcgtaaagttggatcgtgtttttcgtatagaagtatatata

SEQ ID NO: 371 - DNA, 1494 bp, Zea mays
  misc_feature (1)..(100): optimal_loci_117891_G1, chr3:159865916..159867409, Cluster 3
tccatggcatttaacgccagcgccatcagtcggggtcacgctactagactagcggtgctgtgctgtgctgtgcatggatcggcagaccctgcggagagtccccgactgatggatatgtatggacagacgagcaacgggcgtgcgtgtggtctgggtggtgctagtcttctttctcccctctctttactcccgacttcaaagtccatggcgagcacgtgcacgagagcacgccgcctgcttttcgctgtgaaacccgtgaccttgctcttggctttggctttacctcttttttttctgtctagtatagtgcaacgcgatcgcctttgcgtcgcggttcagggttcactaagccgcttcccttttgtgtctgtgtttttttctaaagttttactagcagctgctctgctactcctctcccgtcttccacccaccacgggccggtcaaaaagagcacgggtagggtagtaattaatcatcactcatcagatctggggtccgtccccgcgtcctcagagctgttttttttgcctgaaaagggatcatgctaggaattaatatgccgtttggtttacagaatgagccactgcatcatattctgctcctaaaatttttatatgatttgtggaattgaatgatttgatctatcattacctcattcgattatctcacaaattttgataaatggactcgtggtgcactattttattttagataaagtgattactcaaatcaaacgccctttaagatcgccatctccttccttggtatgatgaagagtaaaagtggccctgtttcttatcatcatgtatctgtttttcactctctccacttcatcagatgacacatgcaattcggtcctcctgagctaaaataccaaaaagaagaagaatacgagaaaaagacgaggagaacaaagcgggggtagtaagctacggagtgaataaattgctggagaggagagggacagatggtagtgggagtgggagcagtacaagggatccaatacaagaccggaagaaaaaaaaaaagagacccgaaaagtgtcgcattgcacgctttgccactaccggatccgcgctcacaccttgtgtctttcccactcccataacccatgattctaccccctttatcaacaaaggggagaaaaaaacgggtaaaaaggagcaagcccgtgaaagaggcaggcgatgtatgtttatttcctcccctcccctctctctatatatatcctctccttcgtttcctcgaacaaaagtgattttcagattcgatccctcccgcacgacacaacgggcggaaccaaaaggccagaacagactgaacctttttttctctccttttatatatatgtgaataagggcctgtttgagagagatttgcttcaaaaacttcagctttggttttccagtttcactataaaacaactccagcaaattgttaaagtgagttccagtagtgtttggtttgtatatgagcttcaacttttatagtaca

SEQ ID NO: 372 - DNA, 1885 bp, Zea mays
  misc_feature (1)..(100): optimal_loci_117981_G1, chr3:160569485..160571369, Cluster 3
acgccaaagcgacgttcgtgtgagccacaacggagcacccctcctcctttctctacgaaggtggcgtgattgtgtggccacgacatcgcttcttcacacggagttgccgtcgtcgtgccgggaaccccatcccatcaaacgcctcttctcgccgagctatacgacaccaggagccacatgcccctccccaacattcgcgctgcggcgcggtcgtccagccacgatgtcgcttcttctcacagagctgcacgccgcctggatccgcacccccttctcgccctccggccttctcacgcccagcgaaactactaggccccgccagcctgacgagcggcagcaggacgagtggggtttcaaaacctccatggtttgcatcaacggcttgcccaccaaccggtgttgatgaaggtcctcctccatggtctgcattcaccattgtcggttacagacgagtttcctcaagatgcactgccattcacatctacttcatagtgaaacctccaaaatgattttttttctctacacgacctccatacctaataaactatggatagaatcctttacataatttaaatttttttcaaactattggattataatccatgattagtttaaccgaataatttttttgagtatgcttagattatttggagacatgaatttaatttcagtccatactagtttaaagttggattggtataaattaacaaggccttagaaagtgagctcgtggaggcagagatgtggatgattgaggattgtatttataggcaccgattgacgtacggagaccaatgcgcggccgcgggtgctgagtcctcctgaccaattattggaggcgcgcgatgagaccagtgcagatgatccgatggccgtaaacttttttttccactgggaaacagttaatagagggcagagaacacctatacgtacgtcagagttgaagtaggcattcagatcgatcatcaggtcggcgatgacgacgtgtagggtaaacgtatcaatcagagattcagagagagatggcaatggattggatgcctgcatatgctgcggcattctgcgtgcgtcgtccacggcgaagaagctagggtatgccatcatataggtactatggccacaccgtatatgcctgccacttgcatggcctggtttagtcacgatgatgcgacggggcagatgaacgatggaaaacgacctcttcttcgttcgtccaatcgttcatatctggccgctgtacgtatattctgcgtcgttagaacgatggtttattatttatctttgtatcataacaatgtatattacagtactgaattggattggattggatttgaagtccaatgttctgatcttttcgatcccttcatctgtaatgagtgatggtgaataaataacaacatccgcttcgtcagggaacgaagatcaaccaagaaagcacaaggtacaagttgcacctgagtttaattagtgcctggaggagaggagagaacaaaaaagcaatatgccaataagcggggacgcacatctatattatataggcagcaagagcttaaatctgtaattaacaagcgctttgttatgttaaagaataatacaacgaagagtaccaatatttatacttacacagttataccatcaaattaatatcaccaggtacaccataatgtgtgtataatgtgtgtatacatatgcatacatacatacacacaatgggagtagggcgggtggggcttgagcccctctacggatcctcaacccatagaacccccagaattctctcctaaaatttaaaatctacatagtacgatgtcatggtgtatttttatggtttttaaactattaaatatgtctattgcgaattatttagtgagattatattgttata

SEQ ID NO: 373 - DNA, 1807 bp, Zea mays
  misc_feature (1)..(100): optimal_loci_118016_G1, chr3:160766668..160768474, Cluster 3
acttatatctttctcgaccttttagctgagctaaaatgtaatatttgttcttgtcagattaatataactttgatattaaatttgtttttatggcatttttactaggagggttcaccacttggtttcacgtgttgcactaattgtttgccgttgtaatgctcgtgtattgttctagtattagtgtgttcctgagccgcgtgcatcgactgatctccaatttttcatgcctctcgtctccagcgagcgcgtggtgtgcagcagtgcaagttagctaacgacgcgtcattgacggttgccattaaatgttaaatcagtgtttacttccgtcgtctgctgttgtctcaccgacgcttttcttctccctgcacccacacaacacaagcgtggtcaactttagcgccaacagaaaaagaaaccggccacgataaaacttggcgcaaacgtgaaaaaaaagaccgcacagtccatctgcacggcgcgctagcaagaatagaaagtggcaatcataagtcatgctgccccatgctccgtggtattgtacaatgcaaaataacagcacaaaaaaaaaaagagatatcatgtgttcgtgggtcacgagtggtaggcagactagcgcttccactgtgtctcgacgcttggtcggtcacttatgacggatcggtttcgagccagtcatggatccacttgagtggtttttcttcggcacgctcggccccctgttcggttccgtcatgctgaccccggctcagtgccgtgagccggatatgtccgggggctagttgttcaagggtagatgttatctgtctactccgactgaccatctagccctacttgctagaggcctttttccccgatgtgcttactgaccgatgggccccaaagaccgaggattgtatcccggtcacccttcctctattctaaaaagcgatggtaatagatataaatttcatgaaaccaataagaacatgatgcaactaaacaaataaaagctagttttagataggggagagtagcttttttgttttgaagaaactgataattcaatttctataaaccaggacgtaaattgatatgtttagaattactctagtttctataaactagtttcttaaatactggacaccccaacttttcgctgaataaggtgaatgtgtacccaatgtgaatctttgaacgggtgcatcatacgggagtaattgtttcgaatcgtcttggcactcgtatatgagaatcttgtctgcgcaccaataacctgttattgcggctatattgtgcctcatttttttagcactacttaaatgtacgtaaagctcataccattctttttaaaataaaaccttagaaagttactgggaaatgtactagttgtctaaattttcatcggcacataccctggtgttgggttgaattatgtattgtagttttctttataaaatgcgtgctcacattggcaaagataaggaatgtgtagtcttctgtagcaagcttaaaaattattaacaagtcttacgaatatctgactcttcaaaccttaagcatcaattcaggtagtgtcaatattgctggaaaagcgctctacgagtagcatctaacgcaggtggccaaagcaaactcctgctaccatattccgcctcacatagtcacacatatattcgcgcgtattggagcagagcgggcggcagagacgtatcgtggaggttcaactcatcgataagcacatatatcggcgcaaggaattagtacggtatagtggttattgtactcataacccttttgcatgttgttcaaattattgagtttatatact

SEQ ID NO: 374 - DNA, 2941 bp, Zea mays
  misc_feature (1)..(100): optimal_loci_121962_G1, chr3:184356153..184359093, Cluster 3
acttgtaggcagcgagcgcctgatgcaatgcaacggagagcgcgcggttgttcaagtccaagccaccgacgtctggttgcagtaacgaactgcgaggatatggatggagccgtcgatctgaactcagtagaaaaaatggtatgcattgcatgcatcgctgctcccgacaacttccgagaggggtcctctccgctcgtcgaatacccgccaacagtgttcaaccaccgatcgtagtcggtagtcatgtctgaaccacgcctgaacccacacgcaacgcctacggtacggcgtgcccagcctgcatccatccatgtctccgcctccggtacggtggtgctcgagagtcgagataggataggagtagatgcgcgcggacgacgtcaggacaggttggtgcatgggaagaagcttcctgtgctgtgccgatctcattctatctctccactccagtgcggggacgacctgcatccccgtttacagctccagtgctcaacagctccagtgttggtttctcgccgtgatcttgtggatggttcttctgagctcatgcctcaatgcctggcaagtgccagtaactgccgaaagtaacaacacctcacgcttctcacatctcgagagattcagacatgcccatattgcattcacagaggcaattcaagtgcagtagtggaagtccagcgagtgcccaccggagcatgcatgcatggcgctcttctctcgttctgcaacagtccgaggctccgagcaggagcactagcagcatagagctcggctcgcactgcgtaccactctgcgcgatattgacagagagacagcagggttttactcggactgtggaagagcttgtgcttgtctaccacaagcagcctattcacgtgcgctgacagatgggacgctgtgaaactggacaaaacatgggcgggccgcccagagcggcgatgcttttgcttcgacacggcgtaggaaaacagtcaagggtaacatggacatgacaaaaagcgagaaaaaaaagaagaagagaggaaagcaatagtctgtgagcaggcaaaagagaaacaaaagggtttgacgaagcagagatggcgccaatgattgcaatgattagcaggacgcgatggcgccaataagggaggacgggtgggggtggggggggggggggggggggggttgagatattggcatcagccacagtcatcaggagaggctcctgcccgccggcgtggaaggtttcgcctagggcccttgtgcttggcccgggctgatcgcccgcattgatgatcgcgtggaaggtttcgcggaccgcaggggtttcgtgtcgtctcgctgcagcagtacgtgtttcacacaggggtcgccgcgggctcggcgacccggctgcaggatcgatcggcgcttcaagttccagcagcaggacctgccctctgtggcggtgcacggatgcgttcggcgagacaaggacctgccgtgttttgcattctcgtgtcgtggtcgtggtcgtggctggtggcagtaccagtacgtgcgcctgtgcgagtgcgagagcctactgtttgtctgcagttgttggccgttcaattcacttggactggacgtaccccgttccgtcacggggccgccggccgtgatcccgtcacagtagacaccacaccagtaagtacagtctttacccaagcaccgtaggagtagagatcagagcaaccagtccctccctaaaagaaacgatcttgggacggtcaacgcgactgctggcgtgccggccaacctcagagatatgcaggtcgtctgggcactgcagcatgagttcttagaggagccgaagaagggccctgcttcatcggtcatctcaagcagtgcctctccatcagaggtcttcaactgcccattggaccttccctgcagttcagagcaaacgctgccatatttttcagactttgaacagaacatcccgggcacgcgcatacactgaccgaactgagttgcagagaaaagcagtgaacgtatacatatttcgcagcaccgcaacagtaagctatgctactttgagatcttggcacttcttaatttaggcagtaaggagtgatggatatagacattagactagttcttagatatcttagactgttgaattttgtgaccgcatcttataataaaccggcagtgtctcactaaactatctatatataccagggcatgttacctgaatcaatgttggaagtggttggataattatgatgcatatttgaaaaccattcatattgtggtcgtctctgcaatcttctaggccatctggaagtctagaaacaaagtgtgctttgaaaagacattaataaaatctcctaaagatatcatctgtcatatgcatgtgcattgatgaacttttgggcaggtttaaacaagaaggagctccaggacttaattcaggagggcgctaagctacttgttacttgttagggccgccagcatcaagttagctagtcctgaggataatcagaaagatgaaaactccgaagaaatcattgaagattgatgcaaccgagcgaagtcgttaaattctagaagcgaagttgttgaattctgaaagtgtgcttggctggtgtctgctgggattcatctttattttcatgtttggtggatcgatggcccctgtgtgggtgtttttctgttgtctttagaccttttggttgcctccgtggctgaggtggtttcaagtaaaattgggtgctggttggttgaggatagtctctgaatcagggaggtactctcttttggttaaactttgaatgttggtgggtcatggacgaatagcctaggtagtagtttgttccttgggatttctgttatgcatggtatgttcggatgtatttctgatatgaaaataatagaaatgaggtctcctcggttcaaaaaaaaaaaggagcagcactgctgtcaaactcgttcc

SEQ ID NO: 375 - DNA, 1588 bp, Zea mays
  misc_feature (1)..(100): optimal_loci_12197_G1, chr1:66316230..66317817, Cluster 3
ctatcatggatgtcacgtcccattgtcgtctttcggggacggctggcgccccgtcgcgttcccattacagcgaacgtacgtgaccacgttcctatttgaatatgtacgtatcattatgtacttgacgagagggaagatgcatgcatacagttaagcagaccgggtcagcgattctctcctcgattatcccgcccacaagacaacagactatttttcttgtgtacgtcaatggtccagtcgtggaagtattaaaaaaattacaactagcgatttttttttgttttttgtagacggtccacacgtacggtgaacagttggcgagaaacagtgtacatgcatgtagaccgtgtccgcggtacgtacgtattacacaaattacgcatttttgtacttttttaaaatataaaacaaatcacagtatagtaggtgccagtggcacaaacaagaatagtagtagctagcaggctgacaccaccaatagacagttgacacaaacaaaaacacatatatacatgcagcatcacaccgtctagttctcagcttctgagttctgacacaatgagttggagtagatcataaacgacagtagtgcggcatatatatgacatcacaattcagttcaaagggttcaaactttaaacacaaataaatacgtcaacaaatagaaatacagcatcaaagatcgatcaccattattccatgtgccgttttcttgcaaaccgagggttcgttggcaatggcagcacggtgcattatattcctgaagctggtgacgacgtggtccagccggccagtggacgtacgaacgtcacatggaacggtgtgtgtgtgtgtgtgtgtgggggtgggggggggggggggggggttctggcggccaggcagggagcggggtccagatgtagcgtagctttcccaatatcaattttatttagggatacgaccaattaagacacacaatccaattaattaacgtatttatgtttatacattaggtttagcgtagctttcccaatctcaatcttcacctccctacgtgctttggttgggtggcctacggacccaaagcagcccaacatggtacagccagtggacgtacgaacgccgcatggaacggtgggggtctggcggccagggagcggatctgcatgcatattattattgtatgtacgggcggtgccgtcggatcgggacgggaacgggagggggcggcgtctgcgaaagggagggggagttcgccattttcgaagctcccaaaaacgggccgcgcgtcgcgggagcgggaggtccacgcgctgggaaaatcaacatggcgggcgggcgggcgcgcaggacaacgccacgagagaaacgggcccgtgtggttcgtccctgcgtgtggcaggcaatggcagtctggcacccagcggtgtctcgtaccgcgtgcgcgcgtgaacggcgtgggcgcggcgttgggttgggcaccgtgtggggcgcacccgtcacgggatacgtgcggagtaggtgttccgaccagaaaaaagcgggatgttgtctcaactcttatctctactacaccttgaggctcgagcgagggcgtccaccgacctca

SEQ ID NO: 376 - DNA, 2449 bp, Zea mays
  misc_feature (1)..(100): optimal_loci_121999_G1, chr3:184452843..184455291, Cluster 3
tgtgcatggagggggcggagagctctcgccgccgaagtacttcgaatccgtgatatagaagggcatgtcgttggaaggtggatggaaccataattatgatatagaaggggacgaacaattcagcaaatactatatagtgaaaaatatcgtagattatatacacatgcttatactaatttgcgtatagtatagataataaattaacaaaaaaacttgcaccatgcatataattgtatatattaattaactccaacagagatcaaaataatttgtctctacgacaattgtgcaaattaaaagcttcgattacatcatgagggctaatcatagctgtcaattctatatcaatagttgatcaagtaacttcgcataaaatcatctcccgtttaatttcgtagatgtgttttgataagttttgtagctaaaaggatctctaagttgagaccggaagggtgaccattaatcttaatatataatccgtgaaccatttgatgatacatgaaacttttacataatttggcaagacttttttatcaaatcaacaagtgatcgtaacgtgttttggcgctaaatggttgtatactgaaggtgaagcatcaaattcatcgcgcgcagctactatccggtgacaattttggactgaaattcatcgattttatcattataggaacgagattgatgcttaaaaatgcgacaaatttctcctggatagagaaatttattttgaccaaataaaattctgtatccctgtgtagatacaattttagaaagtacacatctgtaaaaactctcccttttatgactttggttactttcagcttattatttatgttcaacagttttgagacttacagttgagctatgcttatcttgtgccatgtgcaccaatatatagccgtggtttaaatagtgtggttgctattgttgatgtctgctgaaacttaacatgtgtatatcatccctgtctagatccctgcagcttgccgaacatgttcgcaggagactggaacgttaaccccgcaagctgcatatatacgcagtcgatcagtggatgtcttcttccagtccggccgccgctgagggtgaggagtggccgacatggaaggaaggaatgatcgggggagagggccgcctacgcccgacgctcttggtttgaggaggaaattcctgacacggttgctttacgccggaaaagcagatcaagttgtgcgacgtacgagagtcataaagttgggagatcagcgtgaggtctcttcggcacgaacgatcagctggaaatgagtgacagagagagccatcgttccgcgcagccacaagctgccaccagcgtgctgcgccacaagttaaactgaactgacctctgagattacccgagttggatccgctagctagcactgcgaacctgaggccatctcgattctctggacaagttaaaagaggttgaggctgcctctgtctcgctcccatttgtggagagtagaatatagaatattccggaacacgacccacttgaagccagcgtgatccttaaaacacagaagtggctgtacgtagacgacgacggaggcgcagctatcgcattcccgaacgaatgcatttgggtcatcggcctctgtttttaactgcctcacgtagctcaggttcaaagcatccaagcaagcaacagttctagccaccagtaccaccagcacagtgacgcggacgccatacgacgcggtctccaatgacgccaactccccgtagccaggtggccacccgcgtcactgctgtacgcggcaaaagttgacacggcacgactcggtactttctgcccactgcactcgccgaggtgcgaggatgattttttttttctatcgcgtggcagtttcacggattcgtcacgtaagaaaaatcgcattctatactgtgcgtccaacgaaacgtgcacacatccgacgcggagcacgtaatccttgctgggggttgggggcacccgctttgtcccattgtgcgccgcagaggatatttttttcacttatatctatgatatatgtgtcctataaggaaacagcagaacgccacgaccccgcccgcgcagaaatatctcgctgctgaccggcacaacaacagtgacacagcacggtcatgcatgtactagcagtgcagagcttacacgcgacaaagtaaagaaaacaacgtgatactacgctgatctgtttgcagtggcggtactgttttgcctctgtttttatgatatatgactagcttgcttgtactttgctacggtttatatatatcatatataaatagatactaaaatatttatttaaatataatcattgtttatttttatacactatgagttatcttgtgccaaatattagttctaaacttctaacttgaggacaacaaagtagaaaaccatatatttcaggccctgcacaagagaaaaagttggtaggaagagttt

SEQ ID NO: 377 - DNA, 1500 bp, Zea mays
  misc_feature (1)..(100): optimal_loci_122800_G1, chr3:188663359..188664858, Cluster 3
tggggcctttttttatatagatgtttatattgataagacatgcgcgtgttcataaaaatgagaggatggtgcgtatatgaaacgtcgatattgtgatcgacaaaataaaagcatagttgcctcttttccaagtcgatatttttgtaggtactcttgttgtcataaaagtgtctctctaatttgaccctacgttaggccatggtgagtcttagttggtttatatggtaataccatttgtttgcgatgtggaaccaatcatgttagatttataatgaaatatataaatttttttataaaaaattatctattttatgttataaacatttgcagtcttaaacctaagttagtttatacaaaagagtatcatatctttatattatgaagtatttttattttactttataggtattggcacacatctcgatacactttgtggaatttagaaaattctaagataaacccgagtatttttttacggaacaaattgttagaaagcgacaccgtcggcaggcggcagccgaggacgtcctgaccacgatgtatgggtgcgggtgcagccgtgaagggcgagcaaccgaggacgtacgataccatctggccagcgtccgcatgtgctcaatttccggtgcccgttaagcgtccgtccgtgcagcggtcgtccgacaagaccaggcgccgctggcacaggcgcaccacgcacagccagacctgacccgtaggccgtagccggtactagctcgctgcgtcacgtgcctcacggttggcgccgtgatgtcatctgaccagagaggcccaccgcccgtggtagcacgctgcacgcatccacagccccgcaccgtttgaaaagccggctccgccgtatttctgtgccgagcggcgcctgccacgcatcgtgcggccttttgcctgcttttggtcgccgctcgccacagtactccgctggacggaaaggcgccgcggcacggagaaccaaaattaaaggagagcggcgtagcgtctgcagcgcgggagcgccgcaagctgcagcggcgccgtgcgggagggaagtggggactggggagtacgtacacgaatcgtcgtctgtggagtagtgcggcgagcccatcctctgggcgctcgctgtctgtgtccgactcccttcccttcccccccaaagcgtagatgggacgggtcagtcaacgtccgccttgagagtcgtgggaccctggcggcggggcgggcgcagcgcagtgatgccgtgtcgcgctcatgggagcagctcggcccgtgccgcacgtggtgggaaaatctgagggccaggccaacgcgacgccgccgacggtgtttgaccggattcgtggccgaggcgtcgttgcgtcaggctcaggcttctgtcgcctcgcctgtgcggtactagtacgctgcgtgcttgcgtgggacgttgatctctccgtctgctttagccagcccaatagacgttgccgcaatgttatactaccacggtagactcctcacagccgc

SEQ ID NO: 378 - DNA, 1596 bp, Zea mays
  misc_feature (1)..(100): optimal_loci_124694_G1, chr3:199034474..199036069, Cluster 3
ataaaaatggagagctatctccgacgaagaattctctattgacattcctactctcgacatcgcagttcttagaaaagagatatgcaccctattgccaagataagcatgcgaagctcaaataagcagcggtagaaccgaaaatttggtccaaaaataataaagcaggaaacgttgagaaattagtacctatggtaaaactctgctgtacacacagccgattccagcaaacttatcccttcccatttcttcttctataccggctgtttccccgagctaggtctgctgtgacgcaacgccggggaaccgcgcggcgcaacgtatcgtttccagatttaaatttcctctgggcactggaccctgctttcgcgcggttcgccgccctgtcaccgcgacgatggcgcggacagatgggaatgggctcccgggcttcgcatttgggcgttgggcgggatgaaaagtgcaggcggcctgcttctattctgccgatggttggcaggctcccgctcatgcctacaatacacccaagcggatgattcaataggcgcagccgccctgttccaaaccgagaggcgttcgtgatttgcctcaagcgcttggagcattgtgtttgtgtgcaccaaagccaaacgacccccctgcaaaactatgggttgctacagtactttgtacttacccagaagccacagttccgaaggcagatcaggtaccgtgagatcttatgtgaattttctgcggtcaaaagagggataaactataacccatccgtcctataaaaagaatgaaattctagcacaatttcatattctagtatcttaagttaactaattacagattaaaataccaatatttatgatatcaaataaacatcatcagattaattacaatatacattattgaatattttttgagttatagatataaatactagtattcgttagaaacttagttatacgtaaatgacacgtaactgcgttctctctttttggactaaaggagtaccaacgaaagaaaggtggtcttagagttataaggtccaaacatcatacgaccaatatatgattcgtattttaataaatattcattgaagcaagtaacatgattagaaacagaaaaacaaatgaggatgttttgaatacctcaactagctcaagtcgatttactgtcatctgaagaaagaacaacatgtgtcgatatcaaaaggcagtaagtattcctgtgagaattttcagatcatgaacaaattgaatagttacctcattttcttcatttgtgccatttactaaggtctcgagtgctttaatttttgaacggtacttgtcttcccgggtcttgatgatgctattttgctgtgaaaacaaatgatgtgttacaggagttgctttctatgacaataaatagcaaataccatacatttcttatgtgatccgcttggatagcaatgcggtgctcaatctcttgaacaacattccttagcaagtaaacaacacgctgagacaagaacgtgctgacattagtcatcaagaacaaatgataaataaacaatagttccagacaatatattcattgaaaatcgttgaaaatagacttacatgtggt

SEQ ID NO: 379 - DNA, 1791 bp, Zea mays
  misc_feature (1)..(100): optimal_loci_124875_G1, chr3:200123954..200125744, Cluster 3
  modified_base (751)..(751): a, c, g, or t
  misc_feature (751)..(850): n is a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
  modified_base (771)..(771): a, c, g, or t
  modified_base (772)..(772): a, c, g, or t
  modified_base (773)..(773): a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
  modified_base (787)..(787): a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (1523)..(1523): a, c, g, or t
  misc_feature (1523)..(1622): n is a, c, g, or t
  modified_base (1524)..(1524): a, c, g, or t
  modified_base (1525)..(1525): a, c, g, or t
  modified_base (1526)..(1526): a, c, g, or t
  modified_base (1527)..(1527): a, c, g, or t
  modified_base (1528)..(1528): a, c, g, or t
  modified_base (1529)..(1529): a, c, g, or t
  modified_base (1530)..(1530): a, c, g, or t
  modified_base (1531)..(1531): a, c, g, or t
  modified_base (1532)..(1532): a, c, g, or t
  modified_base (1533)..(1533): a, c, g, or t
  modified_base (1534)..(1534): a, c, g, or t
  modified_base (1535)..(1535): a, c, g, or t
  modified_base (1536)..(1536): a, c, g, or t
  modified_base (1537)..(1537): a, c, g, or t
  modified_base (1538)..(1538): a, c, g, or t
  modified_base (1539)..(1539): a, c, g, or t
  modified_base (1540)..(1540): a, c, g, or t
  modified_base (1541)..(1541): a, c, g, or t
  modified_base (1542)..(1542): a, c, g, or t
  modified_base (1543)..(1543): a, c, g, or t
  modified_base (1544)..(1544): a, c, g, or t
  modified_base (1545)..(1545): a, c, g, or t
  modified_base (1546)..(1546): a, c, g, or t
  modified_base (1547)..(1547): a, c, g, or t
  modified_base (1548)..(1548): a, c, g, or t
  modified_base (1549)..(1549): a, c, g, or t
  modified_base (1550)..(1550): a, c, g, or t
  modified_base (1551)..(1551): a, c, g, or t
  modified_base (1552)..(1552): a, c, g, or t
  modified_base (1553)..(1553): a, c, g, or t
  modified_base (1554)..(1554): a, c, g, or t
  modified_base (1555)..(1555): a, c, g, or t
  modified_base (1556)..(1556): a, c, g, or t
  modified_base (1557)..(1557): a, c, g, or t
  modified_base (1558)..(1558): a, c, g, or t
  modified_base (1559)..(1559): a, c, g, or t
  modified_base (1560)..(1560): a, c, g, or t
  modified_base (1561)..(1561): a, c, g, or t
  modified_base (1562)..(1562): a, c, g, or t
  modified_base (1563)..(1563): a, c, g, or t
  modified_base (1564)..(1564): a, c, g, or t
  modified_base (1565)..(1565): a, c, g, or t
  modified_base (1566)..(1566): a, c, g, or t
  modified_base (1567)..(1567): a, c, g, or t
  modified_base (1568)..(1568): a, c, g, or t
  modified_base (1569)..(1569): a, c, g, or t
  modified_base (1570)..(1570): a, c, g, or t
  modified_base (1571)..(1571): a, c, g, or t
  modified_base (1572)..(1572): a, c, g, or t
  modified_base (1573)..(1573): a, c, g, or t
  modified_base (1574)..(1574): a, c, g, or t
  modified_base (1575)..(1575): a, c, g, or t
  modified_base (1576)..(1576): a, c, g, or t
  modified_base (1577)..(1577): a, c, g, or t
  modified_base (1578)..(1578): a, c, g, or t
  modified_base (1579)..(1579): a, c, g, or t
  modified_base (1580)..(1580): a, c, g, or t
  modified_base (1581)..(1581): a, c, g, or t
  modified_base (1582)..(1582): a, c, g, or t
  modified_base (1583)..(1583): a, c, g, or t
  modified_base (1584)..(1584): a, c, g, or t
  modified_base (1585)..(1585): a, c, g, or t
  modified_base (1586)..(1586): a, c, g, or t
  modified_base (1587)..(1587): a, c, g, or t
  modified_base (1588)..(1588): a, c, g, or t
  modified_base (1589)..(1589): a, c, g, or t
  modified_base (1590)..(1590): a, c, g, or t
  modified_base (1591)..(1591): a, c, g, or t
  modified_base (1592)..(1592): a, c, g, or t
  modified_base (1593)..(1593): a, c, g, or t
  modified_base (1594)..(1594): a, c, g, or t
  modified_base (1595)..(1595): a, c, g, or t
  modified_base (1596)..(1596): a, c, g, or t
  modified_base (1597)..(1597): a, c, g, or t
  modified_base (1598)..(1598): a, c, g, or t
  modified_base (1599)..(1599): a, c, g, or t
  modified_base (1600)..(1600): a, c, g, or t
  modified_base (1601)..(1601): a, c, g, or t
  modified_base (1602)..(1602): a, c, g, or t
  modified_base (1603)..(1603): a, c, g, or t
  modified_base (1604)..(1604): a, c, g, or t
  modified_base (1605)..(1605): a, c, g, or t
  modified_base (1606)..(1606): a, c, g, or t
  modified_base (1607)..(1607): a, c, g, or t
  modified_base (1608)..(1608): a, c, g, or t
  modified_base (1609)..(1609): a, c, g, or t
  modified_base (1610)..(1610): a, c, g, or t
  modified_base (1611)..(1611): a, c, g, or t
  modified_base (1612)..(1612): a, c, g, or t
  modified_base (1613)..(1613): a, c, g, or t
  modified_base (1614)..(1614): a, c, g, or t
  modified_base (1615)..(1615): a, c, g, or t
  modified_base (1616)..(1616): a, c, g, or t
  modified_base (1617)..(1617): a, c, g, or t
  modified_base (1618)..(1618): a, c, g, or t
  modified_base (1619)..(1619): a, c, g, or t
  modified_base (1620)..(1620): a, c, g, or t
  modified_base (1621)..(1621): a, c, g, or t
  modified_base (1622)..(1622): a, c, g, or t
atgccgtgaaccgtgctgcgcgctacaggcggccacgccggggccgagccgcgtgcacggacgaacaggctacacgagcgagcgaacgaggccgcggaccgctgctgtgtacgcgagcgagttgctgctgcgaacatgtcctaaacgggctgccacgtttcgcgtgtgccgcagggggcaaaacgatggggctgccgctggcatccttctacatgcagggcgcgacactccacggcgtcgtgcttcatattcgcgaattcctttcgcaaggcgctgccggtgcaagccaataagaggacaacggcctactgggcaaacagcccggccagcctgacccctttccccgatttatcttttgaactttcggccagccagaacacagggtgcaaataataagaccgctgttaaatttagaccaattgataataagaacctctgcctctccaatctttccccgaaacatccctccttgctgtatttttaatatatttaactgcactgcgctcgcttagtgtcctactaggtgtcgactcctaccattccctccctttccgtctgctcctctatcctaccctcccgggtcctctcatcacaacagattaactatattaatcgttttttgttgattgagaatcttgcggtattgtataaagccataacactatttattatcgctgtgtgggagttgtttaggagaaatacctcataattatcctggagagcttttctctcccccctatttctaagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgcgttaaggcaaaaattggcccgctgggctgtattttcattgagcaaaaatttttggcttttaatttcgatgatgggcgcccccgccctgtggcagaagttccaccgcacaaactcagctgcggaaagtacttcctcaatacgtcttcccttaagccttcctcgctgaatcttcttgaccagctctccgcctgtaacatgttcctgcacaaagtatattttggtgttggtggccatgtcctcatagagctgtcgatgtgtggatgcttaacaagcttcatcgcagaaagttctcgctggatggatcaatgagaccaaccttcataaccttctccttatcaatcactctgatcgcgacactttccgaagtcgccgtgttacgagcatggtaaaccttggcaaaggtgccttggccaagcaatttccccatctcatacttgtgcaagagaacgttccctttatgctctgccatctgtgcctgtgtatgctacgtatggtggtggtggtatgcacacagaggtcacttgcttatccttgacagttaaaaaaaatgagacagcaaagaggtcgagagggtgtgaagacttcaaccgtctgcgccgagatggtgatctaagaagacggtgacccgccacgtcgagccaccagaatcgggaagccaccgggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagggagaaagaaagaaccgcgagttcgtggggagaaaagaagatgacagggggcgacttgctgagcttatagtggccccaccgggaggcgcgcgatgggcaactgcccagtgcgcgcgtagcgtcggggcgggcgagccgttggggctgctaggcgcgcgccagccg

SEQ ID NO: 380 - DNA, 1788 bp, Zea mays
  misc_feature (1)..(100): optimal_loci_126208_G1, chr3:206588323..206590110, Cluster 3
taaagctaaacaagaagtcatgtcgggccagattaaacgggtggatggaaacccgcagccacgcatcgtcagtatactgcaagaatgatacgtggtttatgctgcgaccgaagacgaacagcacaagaaaacaccgacgtcccagcagtgcattcttcccgccgatctatccgagatgcttactactagtagtactccgtactaaacaagtggccgccgtgggacggacggacgtgtataatttgtcttctcgtcccttggacgaaccttatctgcagccagccaaataatcacagatagaatatcgcatctccgcattatttagagggaagacaagaacaaatggttggatatatagataggcacagctaagctagcacacagcaggtatatatatagaaacagaaataaagagaggataggccagtacagtagtagtagcagcaaatactggtggcaacggcaatgtcagcggtcagcacccgtcggtccaacaggcaggcaacagctgcaaattttgtttctgagggggctgcacctgggctgggcgtgcgtgggtccacacttcatgtgaatgccacgctcctcactcatcccgtctgtaggtccacccctgaacctctcaagccccataccgtggggcctgccgccctggcccccagcactctgcggcgctgccattcatttgcatggatggacgatggaggcaacattggtccatgcatggtggagccaacattggtctatgtcagatgtacaacatggaccggaagaagctaccttccaaacaatgttttttttcagttttaaaataatattacggtatttaatgatactatagtattgtaacttaaaggtcgtttggtttctacaggcaaaacatagttttaaatatcatggtttacctaaacccgtggtatttttggagtttacgaaactccactctcagttctcttctctctacatatattttatttttccaatgaaaccaaacagatatcggttttgagtaatgctatgattttattgtgataaagtaatatcgtagtatttgtgtcatgtgtaattgtaaactatagtatcttaaaactgcaatatttcaaaactgcattcccaaacaggccctaaggggtattgggaaacaaagtattttttggagttttgaagcaaaaccatggtattgaaaataccattttttttgccaagagacagggacggacctagaacaaaaaaagagtgggggcacacttataaagatggacactaaaatactagagcgaggacatctcaattaggctcaaggcacttaatggtaaaaatctagacactagtacttgtaacaaagcaatgagtcgggcctaggccctcactcccttgtatgtaggtccgtccctgccaagagatgtttgactgcattgtaaaaaatgttttgaatgccatggttttatagatatcatgatatttttggactacttcaactcaaagttttttttgtctatgactagtgttgcacatatacactaaatacatagtttaagatattttgtctccaaacacataattctaacagcctgtttggtttacaggaattggtccgaatttaatcagtttccatttctcgacccgtttggctgtccatagaattcaattcaccatttcagccccttccctatccctgaaattttagcctgtgcacatttcagaccctcacccatcggaaaagggtcagaaaggtggctagggttagccgcccgcatcgctcgccgctcacgccgctctactccctgc

SEQ ID NO: 381 - DNA, 1677 bp, Zea mays
  misc_feature (1)..(100): optimal_loci_127020_G1, chr3:210543790..210545466, Cluster 3
ctagggttttaacccgtgcgcccatctacctcatcaccatccaccaccacagattcttcgtcggtgtcgctcgtccgcgaggtctggtcgctagccgatctactgctcgggcgcgagcctgcctagtctccagccacgggcgtgggcctgcctggcctctagccgcgggtctgtcatcctctaggcgcaggtgtgtctgccttcgaccaagggtgcgtagacctccacgcacgggcacatcggcccccggtcgtgccaccgtgagtctgaccaccagccacgggcgtgagcccatccgcccgtcgtgttgttgcaccaggcgcgagcacaccagcttcgggctcgagcacgagcccctgtcctccccctctttcttgctaatttaggagatgtaatactccttctcgtcagaggacaacagttcgtcgtcgccactgtcgttgggtaattcgacctcgtccttgacggtacgcagtcctgggcgtcacgggagtggcgatgtggtgggagcagtgcgggagacgacatcgggagaaggcggcgggcaattgaccacgtcgttggataagaacggtgggcatcgcgtccgagccgccatggtaggttgcctaccaaaatcgggcgctggtgtcggtggccttcatcgaggcctctcctcttttgtcggtgttgtagttggtgggttggtggaggtcgcagtgacggtgtgacgagcattgatgattgtggtatcgaggactccgacgtcgcacagcagacagcacacagggctcgtacccatggaacgagcaaaatccttatgggtacatattggagatcggtgtctcctccactcgagccgaaaacgaaggaacgtcgccactagtgacgcttgtgcgcggtgtggcgtgggtccacagtggggtggttcacggtgatcagttctgtgaagcatggcaagccacatgcaggtgaagccattgatgctcatttgcatgatggcgttgtggatgatgaagccgatgcagtcgtcgtcaaggactccctcatatgcactgatgaactcgcggatgacgacgtaccagtgtttcttcacaaatcgatgaagagtaagcatcggcattgtcgttaccttgttctccttttcctcgttggagttcttactatcttgtcctttttcggtgatcgtggttagcatcgagttcttcattgcgtgccttcggtgatggacttcttcctcagcggttggagacgtgcttgataacgtgtttatatctcagagagattgtgggaatgaaataagagaatgaatcacttatgttctatttcaataactgttaatagatatatacatagtgaacggacgacttcacacccgtgcggcatttgttcagttggtgtccgttcagcttgggcacgtttatatggctaattatgattaggggagattagtaactactaatcttctggtgtcttcttgttatctctggatgagatcactgccatctttgttcttcaacaccatctaccaaagttttgacgtgatggcaaattcctagcatcatcaactttgttgtactagtgtgtcaagctcttcacgtgcttgggttgaaaggagaacgtgcacaactttgagagattatatatgttctttttgatttgtagcaatatggattttagtgaaaaaatattcaataa

SEQ ID NO: 382 - DNA, 1910 bp, Zea mays
  misc_feature (1)..(100): optimal_loci_127250_G1, chr3:211737471..211739380, Cluster 3
aacctgaacgcatgaacgacggttgcgggggctgagcaggtcgcctgaactgcttccaagtttctggtgagtggtgaagcagcgcgactcgtcagagtcgcagtgagcgtgcgggctgaagaggcatttcatcagtgctgagactgcctccaacaagtagcagccatattggccagctatttggatgtttgcatgtccatgcagttttagttggccagctaaaattattaactttgcaacagaccatgcaaaatagctggacatcacaagtaggaaagaaggtaaaagtgagccgtacataacagatgcatatggggccaattagtcagggacatagacatcaaattagttggcgtgtgtcgcggcagccattctacctttcctctcttttggctaccatttttgctgccgcatatggctgcctcgttggaaggctacagtgcggtatgaacaggcaaattgcttttgcatggcggaatgcctggcccgttggagtcagcctgatcgctgaggaggtccattacaccttacacgggcctgtggccgtggtcctctactaagggcttcctctgcggctcagattcggcccatccgctgcggcagcgctgagtgggagaaaaccacgtcgtactccgacgcggatagcgacggtttcttctgcttcatcacagatgtgaagattcagtttcttgtgcacaagcggtttctatatttcctcgttaaatcgtttgccatattaataaaaatatatgagtgatggaacgagtaatacgcatataaaagcaaaaaaactacagtttatattctgcatggtaaatacccttaataatctctccctagtctcttcacaaacccaatatcttaataatctcttacaaacccggtagctgaatatacagccagattctgaacgaccagatcatcgttaagagagggatttataagggtctattcagatccattagcactaaaaattagctagctagttattaattttgaagacgtttttatcaacagttggttgaatagggaggtgaatatgatcatccattagtaactctaaacctgcaaataaaactaatcgttagcattttaactaatgattaatatgcccgtttggaatcgctagtattaatttcacctgctaattttgaatgctaataggttcgaacagatcctaagcaaacaaaagaaaacaactttccagtatatttttttaagactcaaatggctttctcgcctgggaacaggcagttcagtgtgttcatgacagcgacgtgttcttgagagtgcatgattagtttgctgcgatgtcgctctgattctcagggcatgtacgtttttagttcttgtttaaaagaacgcatcccggcccttccgacgacccaaactgtacaggcaacagacaacacggtccagatggagtcggtgcacacgtacatgttgtctcctcctcagctcgtttagttataacacaccaccaccataataatcatcattatctggatcactttctgaattattcagtgcctacatatatgtttattcggttggttagtttgctgcggttgttgattagagaaagatggaggaactatgggagagacgacactgacagcatttgattatcgagatactactatagatgttaacatttggtctgcatgcccgtctgtgacccaatagcgcttcagattttcactgaagtaaccacaagtacaaccaatatgatcgcagaccatattatatgccttatttaaactgcactcatgcaagaggactcaaacaaagtacaagtgtcttcaaacaggctgacccactgtctctatacttctcaacgttataagttcataacagaccgctaaccattttaatagatataaccagcttggatggaaaaaagcttcggt

SEQ ID NO: 383 - DNA, 1685 bp, Zea mays
  misc_feature (1)..(100): optimal_loci_127788_G1, chr3:214318347..214320031, Cluster 3
aatatctagtatgtgtgccatatgtattttttttttgtagggagatctatcacactggcttgctactaggacctcgcatgttgtatagccgttgtaccactctatacatcaaatatgattggtgtggcatcgaaacatacagtatttttactagtaccagtgttataaaaagatgcgagtattattatagcgatatattcatgtcaacgtgattattttggtaaagttgaatggttcgatgtgtattttcacgaagtcgaatgttgtcaaatgcatcattcattccagtagtactacttgggatcgactagacggcgaaacgaccaatcggcttgtgcgtcagcgtggccgaattgcggtcggagcagaacccaagtagggtgcagcttttcatgcgccgctaggcagtaggcacagactcccctcttttgtccgcttattattattacatgtgggtttccttttgggcccacacgtcagtgtccaaaagagctgaaaacccgtcgcgtgcaccctgtagcccgtagggccacgcagccgaaagccctccctcctcgggtctcgggactcgggaggcatcaagggtctaatctaacggtaacggccgaaagggaggtggcacgcagcgcactgacttgtgggtccatccggccattacccctccttgcagccacaagttgcgtcgtgtcaccagcaacaacagcaagcctttctgcgcctgcatgccgttacacttgcacatggcacggggaaaagtgactcgactccagccctttttactgccacaccgcccagcagcgtgaattgacttgtgtactgagcttctgactgctgggaccatgggtcccggtgcagtgcagcgcaccagcgcaagactgcagggaaggtacggtacgtgcgcctcggtcccgggcgggcgcgtgagggagaaaagtaaaagctgccgcggaagggctagatgccctgacctgacctgacagtgcgatcggggtgtgagttctctgccgcgtcgggattctcaccactgtaaaaaagaaacaacaaaggaatcagcgatgttatggccgctgtcttgttggaatatacgtcaacagagaagggaaaaaacgtcacattttaacagcaaatataataagcccaattaaaccaggtgacagcagtagtacacgcattacctgaaacagacgcgtcactgaaagcccgaaaagtgcggtccggtgccatgcatgtgcgacattcatgtgtgagcaccccacccggcggcacgttcccaagttttggaatacccgcaacacagatttgtggtaccggtcctccgctcccggccggcagcatacatacatacatgcaaacgcagcgccatcagcggacaaagaacaagcggaagccaggaccgtttgatgcgcgcacatgcatgtgcgatctggcacgcgtgcgtacgtgctagcgtgcatgaccagtcaatgaaacaccctgagatctagattagattatacacccccaacacaacgaccaccaccaccaccacacacacacaccccacccccacgcccgggttccagttcaaacttggaagacttaggcgctgtttgattttcttagtcactagactaaattttagtgactaaagtttagtcgttaaagtatcccgtttatttccattgactaaaccggactaaagaaca

SEQ ID NO: 384 - DNA, 1516 bp, Zea mays
  misc_feature (1)..(100): optimal_loci_129164_G1, chr3:221246027..221247542, Cluster 3
gacaccccctctagcttcaaacaatacggaacaggccaatgcactattcctgagagtcgcaagacatcgcaaaatccccctcacctccgttcaattcacaacttcacatccccgagcctcaccggtcaccgcacgctccgacgagccagagtccctggacacggcgggctatgacccggacactacccaaaacctcgttacaacgtgttccccgcgacgacgaactctctggaactaggaaacagacagcaaaaagtccacaaggatctgaccacggacccagcagggaaaggactcggtgagtggtactccggcgaggccggcacagtagatctggggtttagaactcgaagagctttgcgggctcacagcaaggatgatgctcgcgccaaaaggacgggagaaacacgaaggtaaccagtcgacagggaacagcagcacggcgacgatgtctggcgacgagcccaccgttccagttcactacaagcagtagagctcaaaagggaaactccgtgagcatcacatgcactaagtgatcctggaacacaaacatatcaaccgagaaacactttgagaagggctgtccacgaggagatgaagagccggccggcgtgatcaccagaatggtggacaacgaagacgacgacgtggggcgagttcaggtaggatgagcggcacaacaaagttcactacgagcacggggacatggatggataaatcactctctggttaaggatacgagtcatgagaaggcggggagaacactactacaccggcggccacggtaacggaaagggcacggtgaacatgcagtgtttgcccatctcactatgcacacacagagaggctaaaggtttcatgaaactggacacgcgacctcataaccgtagcacacgcaggaccaaaatcacagcagggcagtaactgattgacagagaagcaggcagacagcttagtcaccactaggagataagctgcagacttctctagcctcagatatttgagtgctcaaaacttatccttacccacaaatgccaatgcctgtttcacttacccaaactgaccagaacagcaagggaacacagtggttgagatccttccatttctccacaacctgaactctcattagttacctacaccgagcctttcatttgcccacattggcttactgtcaaacaccacccaaccacagttacaaagtcccagctgaatccagggagtgagaagctttaaaacaccccgaactccagatctccaaactgaattcgagcagactgaaccaaagtttcagccacctgaactaacttgacgcccaactgaacccccatcttttccccacttttatcacacgattccaaatggtaacagggaacctaccttaacataaattgctctccaaactaccttctatatcttttatacagagtccttcgtccaaaacctcatgaattggtcacaaaagagctccaaaccgagcacccttcactacaattcagttttcagtaactgaacaaaa

SEQ ID NO: 385 - DNA, 1465 bp, Zea mays
  misc_feature (1)..(100): optimal_loci_129793_G1, chr3:224444326..224445790, Cluster 3
caccaggcagcgctcatgttcccccagcccaaacccgactcggtgcaaccaaccatgaatcaaacgtgctgataggtgggtcccacaacacgattgcaaggaaataaattgtgagcctataatcacggagccacatgtctcataccatttctagttccattaattacgcgcccctccgaactctagttcgcacagcgcccggagctccaaacccctcgccatgtcgctcactcctccatctcgcatcgccacatcattgccaccaaatcgggcggcgacaaccaccatcggcatctgaagtctcccacacgagcgcatgtggtggacgtcgttaagcatcttaccccctttcgtcgtgcttttctcaacattttgtgactattttcctcaccgttggcttttatagtgtactgtagtatattcagtaagatttacgaagtctttttcacaattagatgccgatagttttaagtcatcgaatgtttgtgtttcacaaaacaattgtgtgttctgtttcacatggatatcccaatcaggtgcggggttggaacatgatgtcagcaccttaaaccctagtttttttacaatgaaaccttaatttatctatggagcagatacttttatacaactttttacttggcaagaaactggttcaaaatatagaaactggatcaaaatatagaaaatggttcaaaaagttttcgctgtggagatccctcggtcagtcaatgatatcaacaacccgaatgacctctgcacgccctggtgatgccatacgacaaatgaaacaaacctatgttcagagcaacacaaagcgagctatagatcgggtaaaaaagatgttgatctcgttggaaacccaaacgacgatgatgactacccctaaaaagatctgtcaagttagatttgccaagactcgaacgcctccacagccacacatgtcacacaggtctggaccctcgtcttcaccaaaacaaccaaagacaaataaccccactgaaaatcctcttaccaagcaaccagcagtggttaagaatacatgccacaaaaaatccaaaggcagaagagctcaggtgtgtgttaatgctactaagtttttatttatctaatcagttatatgtaacaacctagcatcttatactttttacaataaaatttaaagttattgtgttactactatagctagaagccatatatgccactacaaccatctcacgctagatcattccttccacgtaatgacttttgttttatgcagtgcatatgtaggttttacgctttaaagcacacatgttgttactatgttttttacattaaaatgcatatttttctagtgtatatacattttcaaacagaaacacaacatcaaattaacattgtgtatatatgttttcaaatagaaactcaacatcaaattaacattgtgtatatacgttttctagtgttcatttttacgcaatatttg

SEQ ID NO: 386 - DNA, 1475 bp, Zea mays
  misc_feature (1)..(100): optimal_loci_134004_G1, chr4:12071012..12072486, Cluster 3
actgacttgccttcagtgcattgaaagattaaattcgaaccgtcttgccctcccctcttttatatggatggtggtccgctcccatcgtcgtcgtagggagcacaccgtggccgccatgttcgaggagactgagggtgcgctctccaccatgcttgagcaatgtgctagacctgatcatgttgggagcactgtgctagacatttacaccatgaactccatcatcggggcgtatttaaaccatggaagaacagattagatggagaagagttaaaatgagttttagctgatgggtgttgtggtagataccaagacgttcaacatcatgatcaggtcttcagtaaggctggcatgtatggcaagatgatgttgatatccagatacatgaagaaacggttcttcacaccgaccactgctaccttcgacacaacaatataacagagtgtttcggacatgctgctgacatcgaaaatatggagtactatttctgacttatgaagattcagggtctcaaacccaaccccatcatgcctactgctctctatatgacaagtatggagatatcaaaatcatggaggagatgttatagcttatgaaggagaagagatgcaagccttacagaataacttatgccaccatgattccggcatacacttcacatgggatggatgaagctgctaggtttgctggagatgaaagtagaaatgtttgataaacaattgctagtaagtatctttcagcctttcatttgttgcaagatctcatatttattgtcccatgttaattcgatcaccgggctttgtggtcttattcttagagtagggaccggtttctgagattgatggcaaataatgcatgcaattataaattattagtcccaatctaaggttgcagaaatgatgttgcggcgcatgcaagaggtccttttggaaaagatagcatcgaatccatccacaacaggatctaaacaaaaaggtcgtggcaattggatgcagagccatgcagatgtcgaggaaagtacaagtctagaaccctttataaattcctggttcaataattagtgccatggtcagataatctatttgtttgaggctcatatttaggacaactgcacaacatgacatatggtcagtttggtcattgtgttgtcaccaaaaggccacacatgtcattgtgttgaccccattgctagttgtagcatcttctaagtaagactgagaggctggggatcaagagcatgaagtagcgtggatgacaacgtcagctcatgaacaaatcgctggtggaggcacttgcaggtcacgtgagttctcccagtggcggcggtgggagcgagccaccggccatgcagtgctccctgtgatggcggcaagggcacactgcgatggtggcgctcagcggtaggtggtgatgtctcgcctttgcagaaggagctaggacctatacatgttcaatcgtatgtgtcgggccagcccggc

SEQ ID NO: 387 - DNA, 3392 bp, Zea mays
  misc_feature (1)..(100): optimal_loci_137693_G1, chr4:31118968..31122359, Cluster 3
atcaatatttttgacttcctttacaatattcttcgaagccgagataattcaattcatgttggtgcaacatgaagtagccgtagcatgaagtagcaacaacatctgcttatatggcgtatactcccagtggtgactgcataaagcatgaagtagtagcatatgggttctatgactttttctttatcacagcaggatgaagtgcacaatcatccatttggaaatatggctgaaacaactattgcttctatggtgtatacttcggtgactgcatcacaacctgtaatgcatcaaactatgggctaggaaaagaggacttcattgtcatgtatttggtataattttatctgctaattgttcagttttagtctagttatacgaccatgaggccatcattttggtctaacaatatgcttattgtgccaagccattcggttacttgcagggctctgctgttgtttaccctgggcattaagatggtctagatggccactgtgacttgccttaggggacaactcatgaatattaattatgtcttgttgtaatccaacaagatctgattgggatgtctgatggtttgtttcatcttgtggttgtgagacattttgtacttcctaaacaaggacagattaattccaaacttagaatgagcactgcatattacagtggttgtgagacatgttgcctgatactggtttgctctgtgataatctttggtctgatccttccaatgaagcaacgggctggcccatcaatgatcgaggtgtttcactcacatttagaccttatctgccaagcacatcaggttcctatgttcttatagatgtgacatacttattcttttataaactacaaagtgtattaatagtttacttatgattttgcattactgaaattaaggttggcaaagatggatatgagtttttttctagctgtcaactcgtaacaatattttagcccctaactactgttgaaaatttgacaaagcttcatgcatgctaagtcttggaatgttaaccagtgctctacctatgactgctcttggggctgttttgtgtagtttgcttctaacacaagttttaaacagagacttatcaatgtcgctaatctattttgatttattttatatgtgctgcttctaattccaatctagtttggccttccctacaagtgcaacctaatgcatcctttaaactatttatgtttggggctttgtttcatgaacttgccgaagagtgaggcgcacgaggcctcatgacatggcgccaggttaggtacatcctccgttgtccctccctagcacctcattcatcaatggtattttggttagcgatcaagatgtgagaatcaagcataggagtgccttcactatatcggtgcattggttaaaggtagtggtgtcagcctccctgatctgtcctgaagcgagaaaatgaagggcaaaagcaagaacaatttctaagtggggtttcaaagctttatttactgactatgcgttattgtttctgatttcttggggcgtccttgaattggtcctgtttctgcaggggagagtttatcagacgagcgagtgaggctacatcaagaaactcagggcgtgcatctggtggtacatggagctggatgatggatatgtggctgagtaggagaagctaataggacctggaggatgggtctctgcgttctttgcttattggtatgattgtttagatatccgcagattacacacactatttcttcagcgcgtctcctcttcctactaaaaagtatccatatctctgttattgcaatcaccataaacctgattagtccagttcaggtactccgtactatatgaccagttcatccatggagaacatagatcgctactcgctagcaatatagggacaggcatcctggcgcgcggctcccaaatttcatcctgtcttttagcgaccagaaactactcactacataattgtttgatttttttctatgttttaaatcattatttactgttttttggcaatatgaaaagactaagagtacgtataattggtgcgatatcgataatgtttgccacacggattttgcgtatcataatgatgtttgtcgttctttatctatttttcatgcaattttgtttttttacttccgtagcaacgtagggtcacggacctagtgtatatataaaaaagatatagctcactaaagatatgtttggtactagtgcatataacactttgtaggattttatttatttgtttttttgaaaaaaaaagctctagatagaacactatgtcgtctatacgtgggtgggtgtcatcatcgtcatcgaataaagaacaaagcaacataggctacatactgacgtatgtatacatcattggcagcagcttttacttgcttagtcattcgtacatggatggagcggcatatatataacataaacgccagttgcctttctcttttgtggataattgagcgcgcgcgagagcagcattcgaggcacgttgtagcagtagtagtagctagcagtaaaaactaaatactggacgctttgaagaatctgagttcccggaccgacacaggacaggacagggcagggcagggatcctctctcgcttctgcttttgctgctgtcaccactgaccagtcaccaccacaccaccactcagcaggacggtcaacatctatagcgccggattgatgaggtgcatctggcacaaacagcatgggggctacgagactcgggagcacgaagagcgggccaatcatggagctccagctgcaaaccagccgcacaacacacggacaggaggattttattttcttttcttttgttttgcttcctgaggcagctagcgggcgggtgcgcgagagtgagagcgaaaggaatggaatcatggagctaccagacacggtgcagagagagagagagagagggacggaggcccacaggcacccggcagtggagggagatcgacgggatgcttggggttcgttcgatgccatgttccgcacatgcgccaatgcatgtcgtggcatcgaagactcctctctctctctctctctctgtctgtccgtgtggcggtggggtccgccggcccgtgacggtggcgtgtagtagtgcttgctggcagtggcaggaccgacaaaaggcggcgaggcgagacgagacgagatgccatgcttggaagcttccccatccatgcatgtccatcctggcggcaccaacactagacacgcaacaaccagcccaatcccgccgtgcacgccaacgcccatcttttcctgcccgcgccgcgcatccatcccgccgtttcgcatgggcaccaccagcagcagcgggcagcggcagcggaaaggcaggcccgcgcgccaacgctcggccgtcgcgccagccagccaaccca

SEQ ID NO: 388 - DNA, 1555 bp, Zea mays
  misc_feature (1)..(100): optimal_loci_137713_G1, chr4:31255767..31257321, Cluster 3
attactcttaatgtcctcactttctcactatgatcatcaagggttttggcatatgttgtccgtgtgcccattccaaatgacccccttgaacttatgataaacttgaaaaaacatggttaaatctatgtaggcaatcaggtaaaattttgccaccacacagctagttttttttttcttctctccctccataatgtgatgaatctagagtgtcctcccggcccattctctcaataatttgagaatgattacctcatgatgatacatatattagtagcgctagtcctggcagctatgaatgatcagagtggctagggctgccagtacgtcttccatgcagtaccagtactgtacgttgcatggggaggccctcaatcctcatccttgtatagaagagaaggcgagcgaggagggggaaagggtgcagagagtggtcagagcctgcactgttttgtttacggcgggccaacgctgaggtgacccatcgtcctcgcctcgctttccctctcttgattctctcacgtcgtcgtctccggcctgttggtgctgtctactgcagtggtcgtctgcagtcagtaatctctctgctccttccccatgcaatgcagagcttcttcatccgcatcccttgccctcgtctccgatggcccggcctctttgattgctgtgaattactatctctctctctctctctctctctggtcagcggtggaatgcatggtggcgcagtcttcctgaccgtcgcttgtcaggtgtacagctacaacatgtggttgagagtgcacgccacgagctctctgctgctcctcctgacatacgtatacaatccggatgtttcctcgccagttacggcatgcggctgacaatgtggggccaggcgacagccggtcagctggagctaccttcacagacgtaagtgtagatgatgatgatcccgtcggatactatccatctcttgcacacgccatttgattactagcgtaatctccaagaaaaaagaagagatctcttcatcgtagactcacagaggactagcctccgtaaagagaagtatactttagttagatttataccacatcaagaattttaaaaattaactaagtaataaaataatattgcaactaacatcaagaattaacaacaggtatcttagttttgtttaaatgtgatctactttaactagcctgcaaaaagatcaattttaactaacatgctatactttaactaaccaacaatgcatggctcttatatatgtctaaatccggtgggtctttgactaaacccttacttattatgttggctctgttttatttagtttttaccatagaggatgcaagttgagacgtttggtgattcagagctcatgttggtcatcaactagttcatacgatttcacaacaactggaagaaccgtcgactggatggaaaggagggttacattaactgcagagaatccaaccacttcatcgcaatcgagaccaccagcaacggtgaatctaaccctgaggtacatctctctacccatgaaatggcaaccgagattgatactttgcacaat

SEQ ID NO: 389 - DNA, 1622 bp, Zea mays
  misc_feature (1)..(100): optimal_loci_140389_G1, chr4:48163643..48165264, Cluster 3
tatatgctagaccgatctatacctaccctcattagtttttatttaccgtggcgcttcattgcatagtctttatcactagtgtagggatacaaccacatcaatatcaatgttagtttttttacctactcgaatttaaaacagagcatgactgatgattcaaagaaagtacatcaaataaaaaaacacatagttcatagaaaacaaaattatttaaattaaacaaagtacataaaacacaacaaattttaaaacataaaaaactactcatcatctctcaactgctttcatgttttattggtcatatatttaaattgtttaaccaatttttaattggcaacatatgagccttctcaagtcatcattcatgtggtcgatgttctgatccatcaactttgtgaactacgcgtacagtttttcttaatttaacatatcgttgaccatatagagtagcttctccatcatcttgttctggccctgggtctcgctgctgcttgttgctggtcttttacccttatgttgtgatctggccctattacgaacaatagaggtggttcaacactaacggatgatgtggagctataatcgccttccatattgaggcaagattgcttgttcccatcattagagctagagtcattgtaccgcacacatcactttggttgatgatgaagtgcatgccacatatgctgcagcttgaattcaatttcgttgggcccactgcagaggctatccttggagcagctagccatcattcgtccgtcttggacaagtcgcaaacaagcgatagataccattgaagagtgtgaccttttggttgctcgtggaccaccaatccttgacctgcttggtggtacaatggtgaggaggcttggtggtagagttgtatgtggttgctatttggcccgaaatggaaaactctttttgtcattgccctcaacatggtcaatggagtgtattaaccacacatgcaactacaaatgtacaacctcaataattgttctctagttacaaagagtgtggaatccatatagtcatatatatacttagaagtctttcatcctccatcttagtccagtctgttgttgttggattgcgattcacaagattacacagactagttggaggcacatcattgtggctgtttggtggcactatcggacctgagggagcacaagaaagagaaggaggactattgatgaccgttatttcatgatcttggccatcaactatccataaggatgaggaaaactcaatgacaaagtgaataattttactactaagtgagttcaacaagttgtgctgaagtatttggatttagttgacaaaatatagtaaaagggagtgaaaatagacaacaattgaagacaagggccataccatgtaagaatatggttggtcgacatgtgatgggtacacaaccacctccatgcgcagccgactaagggtgagccacccccacttggtcaatatcactccaaagttgtcctgcacatgtatcacgatgggaacattacaacttggacatgttggcacatgaataccacatatttgagatggaagaacaacatctcatcaatccatgtgcacaaatgtaagggccaagaaagaaacacatatttgat

SEQ ID NO: 390 - DNA, 1540 bp, Zea mays
  misc_feature (1)..(100): optimal_loci_14380_G1, chr1:79261014..79262553, Cluster 3
taaattgcttttatgaggatgtttggaactagtcagctttgaaaaaatctacttagcttcgaatacgtcaagccaaacaccatagcttcgtgatatttgcttcaccaagaaaaggtgaagttggagttaacttcacctttcttaggtcctttcttaggtcctgtttgggacggttccagctctagaaaattttatggagttaataaagtaggtcattatatgctctagaaaatcgtgtggagataaagttataagtctttagaagacattttgaagctgtaacctaagtcattccaaatacctccttatatgaattagtaaaaagtgtgcttctaaaaaaacctagtaaagttagggagtaattactcaccattactgccactgattaaaaaaagtttccttttttaactcccgtatggagccgctaaccctaggcgcagacgctggggagaaatcgtcgccgagctcgtgtgcagcgccggctagcagcagcggggagggaggggagagaaggtacgcctcggcgccgagggcggcgcgaagtccgcgaccagccgaccactgggagcgtgcgcgaggacagccgggacctgggcttggccggccgtggtgcgaatgatcacacaacttatccattttttctgaaaatggtgaaaaagcttccacgatatgggtcagttccaaacaccatatactggatggttcagatcctgctgcaacatgtgatgctccccgatccactacaatggagccaactgtgtctcttttatagttttattgttaccaacaaagaccatatactactgttctatcaatgttttgaccacagacatatactagcgctaaccaaacaaataaagaatttgcactcagacggtgcccatccttccatgaaccaatcggaaccagcatggtctagatggtggctttccagtacggggcgacatccatgtcttcgtcagcgtcgtcgtcagagctgtccggggcctagtttccatctcaatatacttgatctcggcggagtgcccttctagcagcgttacgacagtgatatccctgtaaaaccgtgcgggcttcctctccacaaggagcgcatgttggctctcgacggcttgggcagcggcaggtcgcggaacagcaggttgtcgtcgaacacgtcacacagcaggatgcctatccagagatcgacccagctgatggtagccctcgggcctccgaggatgatattggtcactcgttccaattcctgaaaggcatcaaaatgaggcagcacgtattaagaatgatgaccatttccctttcaatttatcttcagttttagagataaattgattgttgggacagaacagaaggctgagacctcaaatgtcctgataagcatgttccattcaactacagaaccaatacacccatgtcctctagttacttgctacatttccgaaatattctatgcaacgggataattatagtacaactatgcggacctaaccacaccaagcattccaccctcctgagaggcttacaagtgggggccaccatt

SEQ ID NO: 391 - DNA, 1440 bp, Zea mays
  misc_feature (1)..(100): optimal_loci_145696_G1, chr4:81772624..81774063, Cluster 3
agaccctaccaccactatgaaggcgtgcaactaattgttagaaaaatgtattgattcaaagtatgtttagctgtagtttatatctttctacctcctcttgtagatagagttagattgcatcacatatcttctcttgtattcccaaatgcaaagtaatattggttccatctctgttggataatggatagatgatcggtttgtgccatatcttaagaaaacaaaatatatgtgagttgtggtggggcttgtgtttttggctgatcacatcccctcttttctttttctgatcatgtcaatgaatttatgtgtcaatctgaattgtcttttttttaaagatccaatatgttctggtatctaaaaaagatttgttagattgcaagcatatgttgcgaggtcatttaggcctcaaacagattttttttgagggaataaggcacatcttaagatctgattgtgttgttgatttcggtttcatgcgagtagagattttgtgccgtcgcaacgtacggacacatccctagtgatttattatgatcctaaacaaggaaattgatggtaaccaccttttttgcacaaacaaaaaaatatcaacaaaaaacttggagtttcggtcggttttttgtggaacttgtagagcagaaaaaagaatatctgtttagggaaacttgttagccaactcaatgacctgatgagcgaaacaaaaatgcttgcagcccttgttttgaagctgaaatcgaattccccattttatgctaaaaaaatccccttttaccaaatacagtacagtgacgtcttcaatatctaatagcgttcaccttaatcagatggactatactcacatcctccatgatgcagaaactagggtttataatgactagctaggattcattgttgatagctacattgtggcatgctaggagaattcactcagcacataggccttgccagccagtgggcaacccagtcatgtgattccttcactacagcagctgaggtaccaggcttgcacaatgcaccagcttgttggacaaggttgtgaatgctttttattaaattagttttaaagaatgcattgcataaggtgagagaactggctaagtggcaaacgatgctgtgaacgagcgcatctctatttgataactggctaagtggccaaggtcactccggacaacatcctgcagtgcagagtttgtgtaatgtcaatccacgagtaggattggtgtgcagccaagcaaaccctaaatgtcatgacaatacatcttgtctgtgactccgcaaacatatatttaataaaaattggagtttgagtcttatgtgacgtgattttttccctagctccaaccaatcattttgaacactctatcattagccagaagatgccatgtacagtttactgagtaccacaatcaaaatagcgttggagcaactgccctcccatat

SEQ ID NO: 392 - DNA, 1437 bp, Zea mays
  misc_feature (1)..(100): optimal_loci_145958_G1, chr4:83215092..83216528, Cluster 3
tccatccaaaaaaactaggtatggtggattgacggagtctccacccaaaagagtcacagactcagagacacataatatgagaacatatctaataataaagcaatctgtgtttgatatggatccattatagaatcatgcataaaaaggttctagaaaatatatcgtatatgataaggtattcaagataatacctcaaaaaggcaacgatgtttggtccatgtaacaatattaaatatgcaacaaaatataaatgataaacctgtcaagtagaaaaaagattagttagtgagagtcaataaataaccatacatttagtttataatgttgtgtgaagtcttaccactagatactagcctactaaatctctaaagctttctcgcaggcttagaaaaattcatcctacgttctttcatggcttgaaatgccttcttaattttctcaaaatcaagacttttaaagatctccttctcaatatagcataacatacatagatcaattatagaggttgtgttgagacgaaacaaatccgtagagggaatgtggttgtcagatctatggttttgggagtaggaccattatgtcccggaataagttgtttagctctaaaatatttagggctatgctaggaatgtgtaatagtctctataaataagaggagggttgcctcaaccagctatctctctagcatctacctagcggtttagtttttacgatttctctcttgtaggtctctccctctagactactattaagatatgcagatgttttagaagataaatatttacctatgtattgagatctggtaagcttggtccttaccaaggtggttcatggtgatgtgaaatccattttcatgctctcttgagttctcgaagctttcattttttattttcccttctcgatttcctctctttgatcatttgttggatcttttcaactaagtttttggagatttttgggtttaatagaaaaaatgcaaggaccatcaagaatcattcacaccaagtggtttaggcagattcaacttgagcaccgaattctaatgtcttgattgattttgacaaaaaccccaagttgagcgcttatttttagatcttcattaaaggtttaatcttttggagttcaagttttatggacgccttcaaaacttcaacgtgaaagtttgtgcaaaattatagctcaatcaagtttatttggaatgtttttttgtcttttggagctttagtttggactgctcgcagtagtcagcatggaattgccgctcgtggagcagcaataccaggaagcaacgatgctgcgtgtgagcatagtgttgtcgtgctctcctagatggctcattgttttgagttctttcggagtactgggtcaccgggtgtaatacccaacttttataaagaggagttaatactcctatatgcatgattagacttgcatttg

SEQ ID NO: 393 - DNA, 1881 bp, Zea mays
  misc_feature (1)..(100): optimal_loci_14904_G1, chr1:82163311..82165191, Cluster 3
ctagctagctagaagcttcttctgcttatacgctttatagaatctgatgtgatctggccacatgttcacctcagtgcttggctagcgttaagctccagctagcgtcaggctctacagttctactgataggaatcggagacatgcatgcatatatgctctgtgtggcactaggctaaatttgggagagaatgacgtttgctatacgagacaaattttgcccaactttattttctctcttttctagagctgtctcgagcgaggttcgtggttatcctgcgctagctaaatgtttagctctacgacatatatatagattagcatttttacaagtagggttcagagagcaggagggacggcactgtgtctctcactttcacgtctccatccctctcccctttttcttcgcggccttcatcatccgatcccttttttgcgaaatatgctccgcatcgtccctgctgaatctgatgcaaaacgggcaggaacgggggcttcctccggtttcatgtgtcgtgtacatatatatcctccgcttgctattcaactcgaaatgatggaatccacagaccgtttctgcatatctcttcacacttctagcatgtgaaagcagtgatggcaatgaggagttcgggtcggacgaagaaaaaaaaaaactgtctgggatcgcattcgtcgaagtaattcccaacccacgatcaaatctatcgggtttcaagtcacctatgaattctgtatcattctacacttttaaacaataattcagctataaacaaaattaagtatcaacaatatttgagttgtattttcggattttaaggcttctcacattgagaagcaacagaagtacagaacatttcttaaatcattagtcaagtactattgcattttagacatttttgtgtaaaataaacaatgagccaaatttcggatgattgcgtgcgagttagcatccacgggttgaaatagaaaatcacacacccatacccgtaaaacttcatattgggtgcagatgcatccacgagtcaaaatcgttacccatatacccgcacatatcgggtcgagtacccatcaagttttaggtctacacgctaaattgcggtgaaagaaaggtgttccgtttctggtgcaaaattggcaacggaaatgaactagcttagtatgtgctaccacattgcactagaaacgatctagacaactatggcgtgtttggtttcttgtctaagctaaggcggccccacaactcgtctatggttaaccgctcgaatgaaattaataactaagcttagacagagaaattaggcaagttgtgtggcgcatttgtccattctacttctaatagaaccttcaagaggaatgaacgtacgtgctgagtccattatttaccagtaaaaaataatttagtttggcgcacatgaaaagtaaccgaaaacatatatattggccatctttgtcatccatctctcattttcttgaacagctccgcttgtatatctacttttacgagatgtggtccgtcaacagaaatttgtgatggttttaatcatctcgattctctgaatctctcagttcagccttttaaataaaaatgctttgaattatgggtgcttgtttcgtaatgataaggctaactgggtatagaatttgagagtattgtgattcaagcaataaaaaacaactcgagttgttcgttttatgtggcctagccaaggtagcagctaggcatacatattcagcatgattagttaattaggtggccgagtgtggtctaagtcgtgtgagcatggctcgctagaaacggaacgatcctaggtacctagggtacctacgcatgcagtctatgcagtctggagaggtgattttttggcaaaccctgcatctgca

SEQ ID NO: 394 - DNA, 1887 bp, Zea mays
  misc_feature (1)..(100): optimal_loci_155853_G1, chr4:151731736..151733622, Cluster 3
gaaatgttttcaggtcgatcggggagtgtaaacggccgacgaccagtatcccattcccataaacagtgcccagccgacctagacccactagtaaggttctgacttaaaacacctcttgccacgcgtggacgaagccgtgtcgtttgagttgatggcagcgttttgtccagctgctgttcatcacacacaacttcacacccatcaatttctttgtatggtattccatccatactctgtatatgtagtatatggcatattcctatgtcttcaatatataacatgtatttagttaatatataacatgtataatcagagtttgctaaatggtaactaggtctgtctttttttttaagaactttcaggatttattttcttttagcatatctcataaagatgaatgtggagctccgttgggccatttagttatcagtaatgtacgtattggtggaattgttatgattatactttacatcaatttatttaccaaagccatagagtaatactgtattatggaccgtcgtgttgaaattgtctaagagctttgttcgtttgtgcatgatcggaactgttccagttgatcaaagctgtttatataaatcagagaagtaatcctagctaggaattatttcagcccactaatataatccgtaattaagatcaaacgaacggggcaagaagaacgttgacgtctgctttcaaccgtaatttgatcgcagcaaagtcagccgcttggaagcaccaaagtcttgagcaggtagaatgaacagcgacggacacccagaagctcgtagtgtgatgcggaacggagccgcgcgcgcgcaggacatggatctctgactctctctcccccaagccagcagcaaacatcgatcacgatcagtcgttttccgtcgacgcgcgcgggagcagtgtgcacagcactgcagctagcgagcttgcgaggccattgatggcaatcacgcacgcagatcctgcgccaggtcaacccggcccgtacacacgcgctggagcgcgctagctagctaggctggttccgtccgcctcttgtgatcctcggcggcaacctggccggcggcgcgccgacggtggcgatgattcacacacacggcggtcggcggccacgaccgcgcgacgacggttttgcccgtgcgagaccatttaacaaagggactaagcggatgagcccacaatgccatctgtgcaccgacccgagtcgctgtaggaaccggcgaacccgcctcgtgtgccgccggcgggcgccgcccacagccagggagagcggaaccaccgcgcaggtcagctcagctgctgtcccccatcacatgccgtgccgtgcgccaggccgcgtccccccaagacgagtaataagtactacacgcgtcgctcggtccccgcgcgtacggtgcacggagagccggagagggtacgccacaggtggccagcggataggcacgcacgtcgcagcagcaaggtcggcgtcgcatgcatgggcgggaaaacgatcgcatcgcatggctggctgtgcttccgtttccgttggtgtcgctgtcgccgcgctgaaatgctgagtgcagctatagcctataggataggataggagaggacagtacgtgccggggggaaatccacatgtacatacacacacagtacctgtttctagctcgctgctacagtgttagtacgtacgtggaccttcctggcaggtgcatgccacatttttccgaggcatgccgtgccgttcaattactcgatgggacatgcacgtggtgcttgtgacagtgacgacggcatcacgcaaaataaagctgacaggaccgcgccagaaaggtttttgttaccgttgacaaggttacatgtgttcgattttttgtgctttgttaaaaaaaa

SEQ ID NO: 395 - DNA, 1635 bp, Zea mays
  misc_feature (1)..(100): optimal_loci_156388_G1, chr4:154295987..154297621, Cluster 3
atgatacataaaaacaataaactttggacggttgagaacaagccgccaaaaacacgatacaggcaaacaataaactctgtactgtaagtgcattagcttacagtacagtcatcttttccttatgtacagtacagttggtccgaggcactcgatctgggcgcgaacacgcactacgagagcacccagcacacgttgtagctgtaatcattccgatacaggtcgatcgatggaggagattccattccatctcggctcgacggctcgtctctctctctcctgctttctggccttatggagttgtgggtgtggcgagacactggcgtgagcgtgtcactgtcagccgcgtaaaaaaaatacgtatagccaatgacccattgacccccaccagctgaagactgatgagcatgtagcaaaccgtgccgccgccactgcccgttgttcagcgagtcgactcggatgtgagtttggccgtgcaccgccgacggcgccgagctgtgggcatggcctagctagggtccgttttttgtttcttgtttctttgcagtgcacgcgggagcgcatgcaaccacaatgtgcgaccactttcgtctcttgcgcgcccgaacccacgatcgttcagcgagaccacagtgcatcagaccaaaattggtcctcgtgtgccgcctaatgaactctagaacgctgcggcaagaaactacggagtatgtcagaaaaggagaactcttccgtcccatttatatgctttcctctttttttttttgagtgcagtgctaggtatcacgtcgtgaactcacgttgtgaacatataaattaagtgagtctcgttttttgatatcattttttgagtgcagtgctaggtatcacgtgaaccaacgaggcccagatgttatctcagctcagtttggcccgatatcgaactgctcggtccaattaacagtaagagaaaggataagttcaaatgacgagggtgagcccaccgagaatctgccgtctcagaataatagatacctgcacatattcctctcgaaaacaaactgtagagatgtatgtaaaaaaaattaagggcctcacgtgttctcgcgttgcatctatttttcaaatctccaatgtgattttacctttattttttccaatattaatattttgtgttttcttttcttttttgtaactgaaggcaataatgtttgcctcttcctacaagacgatttgtatgaactgagtttaaaaaaaaaaggctggttgtttgtcagtgtccgagaaggtcatacctagatgtccacaagacgcatatacgaccagtgtgtggaagcgaggagatataaatccagggagggaaaaccttccctaaataattcaatgtcttattcaaatgacacccctaaggtttcttaacatgggaaaataaagggatcccaaggaaatccgagtttccaaactagaccataggacttgtttcggtcaggagtggattggggaggaacaaatcacatgctagtcaaaattgaatagaaatggattgtaatcccatccgattctcatgcaaccgaaccagaccttaaaaactttgctataggaaactactatgagacctagttgtcgggaccactgttctcaggatcgatgcccctggaccca

SEQ ID NO: 396 - DNA, 1697 bp, Zea mays
  misc_feature (1)..(100): optimal_loci_156548_G1, chr4:155016275..155017971, Cluster 3
tggtttcatacacatctaatagtgtggcacatcactattttagatcacatgacatattaataaagataaatgaattttatgggatgacatttgttcatggggatgaaatcatatcaaccaatttccaaggtcttggaaatcgtgtgaatcctccattgagagtggtttgtttcatttttcacatattttactgatttctattggttgtttagttgcagcatttaattgtcatgttagtctatgaaaatagtaaagtaaaattttgaatcgagaggcaatgttttattatttagtttcatgacacttttgatgatgtggcagtgttggaaagagtgttatgaaatgactgttgtgagtagcctaagctccacaaattaatatctagctaaaatgcgccctgctgcttttgtcagaactcagaagccacaaggcgcgcgagcagaaaccagcgcgtatttggagaattaattaacgacggcaggtttatatcctcccattgagatggattcgcctgcatgcgcccggtgccacagccgcgcgcatagagtaaaagaggagtaataatctaagtaatcactgatctgcggcagtcccggtcccaaccccgacaaaaatttcgaataataataataacttttgcttggtttctgtagcgtttcgcgtcgtctgcacggcaatgattgaaagtctcactgatgcatgcgcttcgcttggcatcacccatcagccatcattgctctgttgcattggattaagtgagtgggatggattgagcagggcggtgaaagcgcaccatgcacgctcgctcatgccgtacgtacacacctgaccatgctatgctaactctccacctcgcgtggacgctagctgtggaaagcaaaagggcatcgcagatcgagtgctccgccccgtcgcggcaacgatcgagccaacagcagccggcattcagggccggcgaactttttatgaccgccacccgccagatatgccgctgcccccggcaggccggccggccggccggcaccgcctgcaataaggctgcaaccgccattgcggaggaaaaatgcatggcgccgcgcaaagctccgggcggctccggcagggcatgcactgaattccactatgccgggggggcagagggaggggggatcgagagccgcccaagcgctgacatctttacgaattgaatgaagcctctgctgccacgcgagcgaaaaagcttgcggcggctttctggtagtagcgtcgtcaggtgtagccaaaaccctagggcggcttaatttctggtagcgtcggcatgcgcatgctatcatcgcgccacgaccgagcgcccagcttgagctagccgccgatagtggcctatacatactcgggctacgcgagtgcggaggcgcggacctgtcgcagtcgcaggcagctcctccggccggtcgtcgatcctcactcagcttgtccacgtacgcccagcggcgtgcatgcgtggtggtactgtgctttggccttttcaggggttcacgtacggcgcgtgcatgtgatgcgccttcaacgatcaggccggccggcatttgtcatggcgccgatcgaagcctgacgacgaccgtccgtccgtacatgcagggcctcctagctcctagccttggccgcggtcactactactagctcgtcgatcgagggttttacttttaccatcttcattc

SEQ ID NO: 397 - DNA, 2313 bp, Zea mays
  misc_feature (1)..(100): optimal_loci_15961_G1, chr1:88511259..88513571, Cluster 3
gtgcttccatggtgtcaagagggtttctggcaccatgaaaaacaaagtcgagacaccgatgagctaattgagtttactaatacgaggaggaactttcatgattggaggtcacctcatgttagtcatgatgcaatgctaggggagtggcacatggagattggtcatgctcccctagggcccatgtggctaggccatgcaatgcccctatggccttgcacgccctaggcgaggtgtggacagaatactggcccataaataccatgatatgcgggcccatgaagccaaagccaccagatggaggtcacgacagtgaggattatgtgagattcctatgcctcctgtggctcataatctgagttgttagaacaggtgtcaaagacagctccacaaaccaatgaacatgttgatgtttccatagtcatgctacatgataaaacatagctaacctaaaaaatgcacttggtcccaacatagtgtgccaaatgtcattgcatcacatcatcatggtacacaaagttccagaaagagagagagagagagagagagtttggagggagcacgacataggtcaatggtcatattggatctgtgcacgactaggagttagcatgtaggcatcaagagaggttcaaaccataatgtgtgtaataccctacgttatattgatactcattgattgatgaacacaaaggagaaacaaaccataagatcaaagactagtgagcatcaagactttctagttccccctcatcttatggtttgtggtgggagttctaatgtaatgttattaatccacccaaccttctaggtgaagagtgtggcatggtaagctttgttgcatctaactaaaccacttgggccatattaaattgaattccctaggctagagtcaaatatccttaaatgttgctcacactctccattttatagtccaaaggaagagaaaggttacacgaacctcggatcccaccagctaagacacaattatttgttttttatattattcttggagatgtactaaggtccatcccatggtcatggtgttgtatcagagacatccttctcgaggtgattgccatacctaccatagaggtaggtatgatgagttgtgtctctcggtgtcacggcctgtgccgcttgccacaagatagttggtagtcggtgttgtgttttatacttgattatatttcatggtacactctaagtgctcgtgtctgtctatagggtgaatgcacatacaatataatgatcttgagtgccctgacgcctaagccatgataacaacacgcttgttaggcatgtaatatctcttatataacacttaatgtgttgtacctaagatttatctatgatgctattgatatgggcatatcattaggccactagatgtggggtccaccctttagggccatactatccctagtggggcccgacacatccttttatcttgtgataggatcacacttggatgcactgagtccattgtctttttggtgcatttggccctaaaaggtttgaggcctagcttcttccatgaggaaagctagtgttcttaaagatttcagggtcaatagagggtccctagcatctgagtgttgttgcataatttagggcccaaactacatcaaacacatgtcccatcatgccctagggcacgaggggccctaagggcctattctcatgagtgctccatggcatgaggcccttgcagttttatttacatgagtgtcttagggtaccaggagcactaggggctttagactactaactattgtctaagggcacaaggctattcaagatccctttagtcctcctatggattttgactagacattatgtgccttagtgcttacatccttaggtcgcctcggggccagatgggctttgtatcgtaacttcataagttttgtatagttatttatttggggtaccctgatgtcaagcctcccgacataaagctcctcctctggtcagggtcaaaggaaatattcgatgcttggagcctcagaagtggtcaccccaacatagtggacctcacaacagctttctatactagaatctttgaaggtgccttaacaactacctaggataatcttttttgggtactgatagttatagtccaagatatcatagccatattcaatgtcttaatgtttagtttcgtacacatacaaatcatggccggtgaaattgtatttagttgcttatattgttgtgtaatcacctttatgttttatagaggtctcatatatatgttccaattgtgatagggtcatgataatatttgaatttgtatgtcccattcacttgtgc

SEQ ID NO: 398 - DNA, 1577 bp, Zea mays
  misc_feature (1)..(100): optimal_loci_159987_G1, chr4:175124436..175126012, Cluster 3
acagctgtactcttgatccatattgttacctgttgtaaggtgagagtgtgagatgtcctttaggatgacatgacaatgacgcacgcccgtccgttggctgacagagtaccacgggaaatccaatccttaaccgccccggcgtccaactccgtccaatccatatcctttgatccggacctaaagcacggcatggacctgcaaaaggcaatcctatgacaaccgggacaacatttatcaaagcgctgcaatttgcatgcatgggtcgatcaactttcgaggattctataataatatactcctatctcctacacgctgctcctatggaaagtgggagggagtagagtagctaggagtacgacctcttcgctgatgtggcctcggtgatcgagtttaggttggacgagagaaaaatctttgttgcacctagacagcaatgtcagcgtgggttcagctcggatttgcgcgaaaaaaacgtgaaggatgcaccatgtacgtgagcatcatcggtactggcagctattatatctcatctcctatacgatatcttttattttaaattttactatgtaaacaatgtaatctacaaatttataaagttttaagagctaaagcataatttttttaaagtatatccctttgctcttctttagagttttagagcaaatctgctttatgtcaaccacttcttatattcctctgatgcacgttaaatacttaattagatgtatatttagtttcaaactttttatgtatgtatttgtcatatacttagatgtcttatacatatactcagaaaaaaaaatctctgcatagctagaggatggatgagcgtgttctatatttcaaagacactttagatgatacaattaaggtcatggttggatcctcctaacttattatttgctaatgactaataattagtcgataaatacttagctagcaaaaattagttagtgtatgtttggagacttggctaatagatgtcctttttctctttatacgatctattagcacctattagtaaggttaaatggcaaatgggtaaatagtttgcatgccttccggctaataattagtcaatttgttagccaacatgtttggaggttaaagtgttaaaattagctggtaaattgttgccataagaatccaaacaaggcctaaaacatataaagaaagaaattttctctagacagggactagcagataagcttttacggacttccactggtttctgtctaaaccggtaaagcttggctgtagctagatcttagcatgatcatctactccacgcagctaattaactactcctgctaagcagacacgacgtacggtcggtcgggttattgccggtgcaagtaatctccggataaggctactagttagtagttgctcgccactagccatgtgagtgggcactattatatactaccgctactactagtttgcacgcatcattattcatttgccgtttggaaacatggactggaacagtagagatctcactaaaagttgtttaaatgctcactatagagcttacgcacggtggagtacacgttaatgtggctcatccagacaac

SEQ ID NO: 399 - DNA, 2128 bp, Zea mays
  misc_feature (1)..(100): optimal_loci_160808_G1, chr4:180205627..180207754, Cluster 3
gacatagaaggctcctaaaacacgctctttgtgtcgattgggctctcgtcgattttaattttgctgatgtaagtgtcagaagacgttctatggaggaaatcttgcattaggttgacagataaaacacaaagaaatgatttgtttgaaagtaaagatactggacgggattagaggagataaaatctccttgtttttcgaaatccttttcggcgaatgaaagcaactactgatactgtaacaaagcacctcagggtctggcaactgtcacggttcttttttacaaaccattattttttacccgtcattggctcactacactaccaggagggtgatctcattaccgacacatgaacaggagaggcagagaaggcaacagctagcaacagtatcatcctgcttcagatggtacgtgattacaggagcacctggatgattacctgaaacggagaagacagcaggtgcatcacccggtactattccgccccgcactaccactaattgcccgcgcgatcgatctattactgttttactgcctcctcgaacccgatcggcctgcatgcagtcgaggatcgagctctgcctctgcgtctgcctgcttgggagagcgaagaggagagatgcctgtggctcctctcatttatggttgcgtcgccagggcactgtgggcgtctcccgccgttgctgcagcgtgcagcgcagtgcagccttctctctccagccatcatccttgtcaatttctcatggtgcgcagcgctgcgtgctcgtgcagtggcgggggagacttattaaatgtgcattgaaccccagctcagaaaggcagcagcagggccacaggcgaggaatggatcaccagttcacccacacgagttttgacatggcgtgtgaattcagcgttccacttcgctgcctgccagcttccagttccccgtttccgctttttttccaaaatgcccatctgaagaaaaagagggcacggaccgagctgcagttcagccgcttcctttgacattgacaaacttgggcacggcgcagagccgcagcctgctcgtgctgctttctgaacctgtatagcctggaattaaagtctaaacatttctgcacgtttttggaagccaaacaaacaacccagcgagtgagtggccggtgcccccacagcaaaccgcgagaggaacacaacacaaagcgcatactacatgataactgccgcaaccaccaaccgaacctgcttttctgccttgcgtttgcattgcggccctgtgtgaaacgcgccatttttaacaggtttctcctcctgccagaacggaggaacgctgctaggtctctggggaagaatggaggacgcgcactgcgcacaggaagggttacaggaaccaggttaatttgtagcgcaatgcaaagatggagcgaggaacagtagcagacactgtaaaacacgcgtacgtgctacggtgatcgaatccggtaagcggcagcgagatcagctcagctcgcctggctctggctcacatgcgcgcggaagggaatccggccggagcgcggcgcggccccctcttgtctcgcagatgagacaagcggggaagcgatgcggctttacactgtgcgatcacgcggcaaagcattggatggacgagcgggcagatcgatcggcacgggcgagggcgagtaaaaaatggttgcatgcagttgccgaccgcgcggagtgctcatcgtagcggtcgcaagacttttcgagagacaaacctctgtgggccggccgttgctggttgtgcaaagtttatatacagtaaactattcaaaagctgctgcaagtaggacatgcaactatgaacgagggccgtagcttttgcccggtgtggcgataaggatatgagtggagaggtcagttagcatgggtgattgttttcgccatgccatctcgtgcccaccgccttgcatattgtttacagttttgccacgagttaacacttagatgctgtttggttaatgaaatctaatacaggtggcagcaacaatgatctatactcaagtaccaaccgtaataagttcacaccgtctaatgcaatggtcatgcgtcggtcgaagtagcatggacactgacttgcaatggagcacgcaacctgcgtaggca

SEQ ID NO: 400 - DNA, 1542 bp, Zea mays
  misc_feature (1)..(100): optimal_loci_164095_G1, chr4:197734662..197736203, Cluster 3
taaaagataagatcgaatagcgtaaaattatatgggctacgtagacaggcaggctggcctggtacaagcatcattggttcatacgagtagagtagattatatttgaaccaaatgaagtctaaaaaaaagcctgtacagacacgccgctatttacagtacatcgctaaagacaactgaagatccgtccgtctatagaaccgatggagctcggcgtcggatggtggcaggaggcggtggcggcacagcgggcaggtggcgtggtcgtagtcgatccaagtctcgaggtaggcgcggtggaagaggtgaccgcaggggaggcggtgcaccaccgacctcggctccaaccgcgccaggcacacgcggtagtcccccgccgcccgaccgacggaacctgctccggaaccggtccgccagggtgggccccgtcaccgcctttctgctgtcgccgccgccgctcgtcttcctcctcctgcgcagccccccacgacggtaggcctaggatcagcagtgcggcgcgcagcagccccgccaggatcgcgttgtacagcaagaaccccagcaggctgtcgttgggcgccgacatgctcgagatgcccatcctcgctgtccgccaccgatcccgatctcggttggggtgggattgggaggaggatttggggggccagccccgggagggaccaatgttacaatttgggcggaggaggtaggtcgggtgcgtgagggaaggatagagatagtggtgggattcgggtggaaggagctcggcagtggtggggcggcgcaaccgacgccggtcccacttatgccgtcgtaagcacgccgccgggatttgtgagtttatgacattcatcacagcatcggccttgccacagccgaacactttgtggctgggctccccactgcggcggcgccgccgcgtggcgtgctacatgtgaggcgaccaggagccgccgctcatgcatgctgacatggcgtccggtcccccgcactgcactgcacggcggcacgggtgtcgccgctcgccacagtgcacatgcgcacacaggtgtgcagtgcaggtctgattcgctcacgcactcaaggtgatgggtggaatgatgtgtggatgggatgttgtgcgccgtctctgctgctgccgccgccgtgccaacactttgcaggtgcaccgacgtccctctctccccgcggccgcctcggcaactgaggctgtcggtccatgtaactgcgtggccccagcaaaagagcccaccccagatgtccggagcgacttgttgtgccctgaaggacgagctactctccctgctacatcgtcaacctctgctactccatccatagctctgctcgcctacacagatatatgataatttattctgggagcaaaggctgtatatatgcagatgctcacaactgcattgcatcaccgatgatttaaaacttcattttaatttctacgtttctgcatcacatcatgtgcaaggtgaagtgttatattgtctctgtacacaaatgagccgtcttgtcttacaattgcgtgtataacgt

SEQ ID NO: 401 - DNA, 2481 bp, Zea mays
  misc_feature (1)..(100): optimal_loci_16436_G1, chr1:91265495..91267975, Cluster 3
attggggcgcatctagttcgttccctaacgaaaccaacccactcgtgttcacacagcagaagcttcacaggtaccagcctcgctcgtcggtgcccgccgcctaaacgccctttacacaacgcgctgtgctgtgctgtgctgcgctgggctgggcttgcattgcccatcaaaagttcatactatattctagcgcaataattcgcagaccctcactaaaaatcccgcccaaattcgatgtgacagacgggtcgattaagcgaaaggccagagccccgcgtccgaaaggtcagtgccatgccatgcgcccgagagcagagcacatccccacgccacctctttttgactccatctgtccgtccttgcgctctccatgtcatcccacatgcccgtagcagaagggagaagccatgccttttgaccgctggccgtcgccggaaactcatttggctggcaaacagtgtgtcaacaggacagttttatctgtcccggacgacgaactcgctgagcatcgtgtgctcatgcgtgcgtgcatgatgccgtgaagatgttggaatctccgactctgacgctgggccagaatggaagtactgtcgccattaaaaaaagaaatacgatcatctctagactcactggcttacaactattttagcattgctactgttttccactgtagaacggacggagagagagtggtacgctatacgttgttgcggcgcgacctgtggtggtcacggacacggtcctagaggcgccgagccaagcctctgaaacaggagaccggggtcgccatctgcaggcacacgcatgggtagggtagaccggtagagccgagacgagactatgcttcgaggaaacgcgcacgcagggggggtcgagatcagatcgaccaccagagacaacagcggctgctggtgctgactttagcatttcaccggctaccacactacacagtgatcatcaaacaccaccgatcacggaattgcctgcgacccctgctcgtcgtgagcatgtgcgtccgtccatcggtcaggtcagtttccggtttcttttccgcttcctttttggggaacgatcgatatggtcggagggggtggggtgggtaaccgtagtgcgtgcagtgcaggtacggtgagcgcgcgatggtacggccaaccgagcattatgcaagctcacgcgatgctgtaccgcgcgccactgggtagctacagacacacgccactcacctcgccagctacctagctggcgccaccttgcattggtgcttgcttggtttggacccaacgttcatcatcccgtcgccggcggttgaagcgtacgtagatctacacgtgtacagggtatacgtcaccgacagtcctccctacttggtttagatctgagagtataccaacctctcacagatcgacggggcagctagctagtcgcaaggaataattggggccggattcggtcgtcttccgtgtcgctcgcacgcatgcgaggacgacgacccctgctggtcggcggcgacaatcatgcggttgcggtgcgatgcaacacgcaaggcgcccgcggccgtggccgtgtcgcgcggaatcttgccacggcggcctcttgttgctctctgcagctacgtaccatgccatgcgtgtccaggaccagcatcgattccgcccggtacggtactaaaatactcgcctctccaccacgccgcacgcaagttctgcaccccggcaatgacgcgcggtatacgccggtacggccgggtacatgtacatcacttgtacacaccgctatagcagtccctcgggtggctctcagtagtcagtacttgctgcggaactatgcagctggtctccagcacccatgccgccgtgcctcacctgctttagcaacatgccctacgtacgcacgcaatgactacagcaggatggcagctgtgtggttaggactactaacagtatagagtggcacatctgggcttcgattccggaacacgttctctctggcagcttgatgggttctctagctgcgcggacacacatgatgattgcgacggctgtgtagagagaagagaaaggagagagtgagaaaaggcggaagggcacatgggcatggatgatatgggagagatacgcaccggggcaccgccgggacgatgagtccagttcatccgcgaaagcggtgttttgacatggcagcggggcagatgatgatgatgatgatgcatgtgacggccaagcgacccttcacatgctgtcgcgagacgccgacggatccatctcgtggccgtgggccgattcgtcaaccacacgtataggcctgctgatcagccgggttttctttagtcacaaggttctttagtccgagttaatatactaaccataactaataaacatcacaatgtttgatccatagtttgtctcaactttgtaatacttgaaccacagctacctagtctagcaatatgaaaagttagtaccactatttaaattatactcc

SEQ ID NO: 402 - DNA, 2323 bp, Zea mays
  misc_feature (1)..(100): optimal_loci_166977_G1, chr4:212225057..212227379, Cluster 3
tttgaaggaccctccgggagggggctcggtcgagacggtgcctctttggggaagacccctgatgaggaccttaggcgaggcgcggatctggttccttgctctcgggggacatgtctgggcagagagaactttccgagcgtgttttgagggtttaatctggacacccctaataatcacacccgacactatcaaaaacctttaatggtcaaactgggacttttctcttcatatatcttaggttgcccacgagtctaaataaaccgactcttgaggcgttttctccagcggattgaacgacgtctgtcgtcaacctcaatataccgatcttcagctggcaggctatagatggtcaatgcaattttctcatcactacccaccttttatatgtacaccctcaagctccccagctcggtgttcaaataaattgaaaaatttagaaaatattttttatggaggggagctgatttgcatgtaaaggaaaccaccacaagcaagcctggcagattgcttgttgaccaaaaaaagcatgaaggaatgggagttctcaatctcaccacgcagaatgaagcattactactgaaaaatcttgacaagttctgtagctttttcatcttcgcgtggttgtttgccaaaggcgacccttgttcattactactacaaataacaaccggtaccactgtaaaggatgaaaacgatgcgtcgtgtttttttttggtaagacttagtgctaggtagagagaggtgagcatttgttgaataaaaaaagaaaacggaaaggaaagaaaagaagagaaatactgaggcgggccggggcaggccctggctgggtttccaactttttgatgccaacgattgcatactcgttcagactgctgggcagcgttgggtgttgatgtgtgtactgtagctgcacctgcactatgaaatagtacatacgtacgtactccctcgatgatctgaaagtatcgtgtgtgtgtgtgtgtcgtattttgtagagttaaatattttttaaacttgactagatttttagaaggaaaacaaaacaatattaatatctgcacacgtttaaataggtttactataaaagttataaatatcctctgagatgtgcatttatgcacagcgatggcagttgccgtcggtttgctgccgcccacacgacacgacgccccatgtcactgtgtctgcacggcatacatacaccagagtacgtggcaggggcatgccatgccgcatgcatggccggccctgcgccctcgcgtgcgcgtagggcactgttgctgctactactacgacccctgcatcgcactgcattgtcctgtcccattcgactcgatcgagtgctgctgcgcaaatggtgatgctgccgtttgttctaggctctacctactgatgaatgtggtggaccgtgatgattggtgagccatgcatggcctcgagagaataatggagcgatcggaatgtcccgtgtggctggccgtttggctcactgggtacaatacaggtacagaccatgcactgatggggctcagtgaatgcagtgggaaccaaaccgatgagaagcgagccctaccctacacttcctactgtgttaggcatgggccttgtgtgctcccccgccccgccccacccctgtgggtatctcgttctctcgtccacagcctgtgggcctttttttctctcgtcactagccaccgagcagcgagcactgccccatgccaggggtgctgccgtccctgtcccgtttgagtgagtactctagcatttaagtagtttaaaaggattgaagagtatataaatccttaatagattaaaaactctcacaatgtagatttaaggttaaactaggacgaggtggggtaatatcatccctcgattttttaggatcatgttgtcacaaaaaattactctggtatttacctcgtcactatgtgactctaatctaaacattatagaaattatggccgccttctttcattccttcttatacattcaactaaacacatattaatccacttcaatcactctcatttctagggtacttaaggtgctggtgatacaccgtggtccaatttttagcaaaaaaaaagtgtagttattcttcctactctcttcgtttcacatcgcaagtatttcttacctttttttctaaaagagataaacagcgaaccgacgaagtacaaaaatcaaaacatgccccagttgctcgcagtcattatacttgacatattttgggccagataagcatacaaacacgttttagcaattagacgcacggcgttgctgcacgtaaaagctctcttcgtttccagcttttcgtttt

SEQ ID NO: 403 - DNA, 1544 bp, Zea mays
  misc_feature (1)..(100): optimal_loci_173693_G1, chr5:7687555..7689098, Cluster 3
ttatttacatgaaacagtcaggagagaaggtatactttcacaaattgcacgcaaatctttgcactagactaaaaagttcagttcagttcaggttggggggcaataaacatgtaagttctttaaatgatgctttcaggttggtgatattgttttgccacctccaccttgggctaaaggcagttgccagagaattcattaggaagcatcggcgggaagcactggaatcggattacgtatctgagaatctgcaccattggactgatcttatttttggatataagcagagaggaaaggtaataagcatctctacacttgcatttgatccccagcagtgctgttgtagtacaaatatgttttggtttgaaataaggatagtgtcttctttttactcttgaacatatatacaggatctgtgaacacaaactgagctgttatttttgccttcttattgaagtgtcttctatctagccaccagttcattatttgactgccgagcaatttgacagctggttcttcgtcttgtgtgcgcggtaatacagtaacgtgtcgtgataacattgtcgctgttggtctcgtggcatcttccgaaggtagatgcgagctgggcctccgctcgatctccttctgattcctgcatggatctgaaaagaaacttggatatgtttgactatagtgcaatgcaattcctgaatggagcagagcagagcagagcagggcgagaggcgaggcgaccagtctccacttctgctgcttggtccaaaaaccgttataaaaagtcgcggggttctcgagacgggattttgtttgcgggcgaggacagggcggggggcgcgcaagggcgaggccacgttcgcctcctccgcgggaagcgccgcgccgccccgcgacacgacacgcatgtgccgccccgcgtttgactcggcgccgattggcaggcagctcgccggcctcggaatcggatcccccttcgcgctcgccgggtcagcgacagcgcgaggattgtttacgccaccttggccggcagcgtcacccgtccccatgtgacccccaaccgggccggcgacccggccgtccgtccgtccgtctctatatataaggaagctagcagcggcgtggtcgatcaccatgtgcatggtgtgttgagctagctgcctgtcgcgccgtgggagccgatcgagagcgtgtgagcccggcctcttctgcgcggcggcggatggaccggatcggaggaatggtgtggtgtgagttgagtgaagtgcccaagataaagggtgaagctgccagcatgatctaacgacggcattgctctgctgctgcagtgaggcttgcgagtgatggttagatcatgctgtgacagtttcactctttccctttgggcacatcgatctcttcccctcctctctctctttcaattctctccccttttgcaatcagactcgtcactcgcgcacaaattccaccactcgccaccctccgtatgggaggcaatcgtcggggatttccggcccaaccacaggttgcacagcctccgtgtcaggaatgcc

SEQ ID NO: 404 - DNA, 2444 bp, Zea mays
  misc_feature (1)..(100): optimal_loci_174020_G1, chr5:9824285..9826728, Cluster 3
agtcacgcgataaataacgtgaaacgcgagcgcgcgcatgacagcctccataaccatttatttatctcatgtgaagaataaggaacacaaccacatataagttggttctcttttatatagatgagcgacataggattaaagtctcataccatatctacacatcatcttgactttcttattgaattgggtcacacactagtgaccctaattctaacaaggtcgtcatacgagcaccaaacgtcatgccaaaaggaggtgctcttcccgtcgtagacctcacaggtggtgatagcacggtaaaaagagagatcaaggattaaatttagtttaggttgctgtcaggaacggaggttttaacaacttttctctcgctaggcttgtggttttcatactactagtgatagcagtagtcagtagtgcgtgttttccctccggatttggcaaagcacgaagaactatctagcagcagttcgtacagcttttgtgagattaaaaggcgcccaataaaaaagacaaaagttgatcgagggcaaagtcccaaagacgaaggcaaatccagcgaccgaaagcagcccccctcccccctcagatgcagcgcggtcaagcggcgccttcacaccaggggtccgccagcgaggagtgccgactggcggcgagtgcggacgtcgccgtcgcatcgcgctcgccaggtcctggcgtcgccaccaacccggccggctggcgcgacgtcgaccatccctgcgctgctcgcgcacaaaactctcccgggccaggccacctctagttgactagcagcagcagcagcttgcggactgtggactacgggaagcgtagtcacgtctagttgcatcggttgccaccaccagagcgaacacccacacaaatactcgtttgtttagctgttttcctagttttgacatgtgccattacttgtcttgtttgggcctcgactgagacatcgagatcgagtccactacagagtagcactccagggctttggatccatggctagtagtccggttttcagaaacgtgcgtgctgcggtgctggcctggcacttggcaattgacaacttgacagtagtacatggggggtgtttctcaagggcgcctcaagcctcatcaagtcatcagatgtttggcatgttgcttggtggtgcactgcagcgcttgcttggtcgagagagattaacaagtactatagccccgatccagtgatgtatcatctgtctcgatcagcctactgcaaccgcgttgttccccgcgctcgccagacgtctccgccgtcgccggcagtgcacgcagcattattatagtatagtcgatggatctctctttcatgcatgcagctgttttggttgtaggccatgccttgccagccactcgtgtttggatgcttatctgtcgtcgtcttctgtgctccaaatctcgcatataatttgatcgaataatggtcactgctcacgtggagtgtggcttcgcagtatgtatcgcagagtatatgctacaacgcaccacttcaggcccgtccatcagcgaccatccagggcctcccctgatcccctcagaaatacaagcacagcgcacagcaggccgtaggcccaatagacggtccaggtctcggaagctgaatcgatcgcatcggcatccatggtccaccacagtgctccagtacatcacagactcgccgttctgtccgtctagtgtggcaattgccattacatcagattttttttctcaaatccattgtaatagtaacaatataggcaccaaaaaaagttaatatggttgtatctgatatatactacagttattcatactagggagatacttacatgttgtactagtacaatgcctgtacacaatgattacattgaaacggaacaacacatatattattattgacctatctcacaaattctttgccaacaactaatgtagtgtagctcccaaattttaaatcggctatccagactcaatctcattattttatttcagatgatttcaattaaagcattggttacagaacatcctatacagtccctagaaaacagataataaactatggattgaacgggctgactccgagcagacatactcaaactctgaatcactaaggtcatttcccttccttctcttttagctactgagtactaagaacgagcaaggcagggttggattagatgtgaccaacaatactaagataatcatcacaaagaactcattgtatcagcttcgacaagagactcaagcaactcttgttccgtacttgtatttacatgtcccattactttccatccatctgttagagagatggtcctgaaatctccaatgaccattcgggcatagacgagcaagggacagggtgcgtcacacgttctatgttgttagaagcaagtaaattcctcgagttgatcgatacagaccatcttcagagatggcacc

SEQ ID NO: 405 - DNA, 1723 bp, Zea mays
  misc_feature (1)..(100): optimal_loci_175846_G1, chr5:20103339..20105061, Cluster 3
agaccaaagccacaaatagtcattcgaaggatccaacttctttgtaatagagacatcaccttcaacaaccatggtctcttgcaaaccaatgaacttaaatttatgaagcccaataaggttcctgataaagggggcaaccccttttttcctgatacctctacaattccaaagaagacccatcatttggaaaactttttatcagggatctgctcagcagcactatcagaggattccccagtgcttttgatctttttttggccaagattttcttgtgcctttttatgatgaattctcatgttttttagtaatctctctctttttctttcttgattgaaccaaaacgaaggcatctgtttcatatccttcatggttttgagtctctttttccatatcattaatagtagttctatcattttcacccttttttgcaacaccaattcttttttcctacccaaacattgtctagccaattccatttcctttatcaagtcaatagactccatgtttgtgttgtccatattaacccccatctttttgcttatataaattatttcagtagaagataaacaagaaatttcggagttgggtttagacttgttacattccaagtttcttttcatagtcatccttctgttttttttcttcaattctgaggccctggtctttcttaagtctctcactgaccctcctttcaggaattggggaaggaattttcttctgttggacatcattttggcccatgtcatcagccttgatccactattctttggaatagattcatcctcttgagaagtattcagaatcacacttccctgagtattatcaaatatcatctcatcagaatttccttcttttttatcatttgggtctagttcttcaataatgatagaacattgcgcgttcttgctacgttgcccaacatttgtattcattgtgttcatacacttcagttgggtattccaagcagaatgactactagagccaacaccagtcttcacagtcagaagatcatctccaagaagatcactgacatcatcttcttcactatcagtaatgtgaactttatctttttcatcatcagcgcaattgaaataatttttgccagctttaagagtactcccctcattctcttttcctttacccttgcctttatcaactttcatattcccttcatcgaacaaacccatatcctgtcttttacccttcggcattttaccttcatatttaaatctcttagcatctttctggtatgattcatccactttaacctctatttcagcatttccttcttcatcctccgtaagaatttctctttcaataaagaaatcatacaagaacattccaagggcactttccacaacccctagaactgcagtgacatctctataggctattctagctctgacatattcatttctgagcctagttttctcatcaacttcgaccaccttgcccactagaccaccaactttcgcaatagtaactagagatctctgctccataggtatgccactaatcctgaaccaccctttttgtaagctacctttagcattaaccgcatgggtccaaggatcaatagtgatttgggcttttgcggttctcatccccaaaggtctgaagtaccctaagtcaccaatcatcttagggtctggaaatctcatcacaaacttgttatcaccaatggatctagcagatcatctccacatattcttgccaagcatat

SEQ ID NO: 406 - DNA, 2471 bp, Zea mays
  misc_feature (1)..(100): optimal_loci_177364_G1, chr5:27775046..27777516, Cluster 3
ggtgggcgcacacttatgtatacgcgcctcgtcatctacagagacgaaaagcgaacgctagctacagctgtgtttcacagtcaatcatccgtccttgacacgtgcacagtacgtagggttgggcaagggaacggacggagcacgcgcacagggcagcacagcacagagtgaccaccactgaccgatgcctttccaccaccacaccttgtgatcgatcgtgtcgtgccgttcccctcttgtgttgttcagcagctatagagctagctagcaagcaagcaagccgaaaaaaatgccgcttctcgccatttgccatgccaacccacggcgcggtggcgtatatttggagatcgacgaggcatcggggagcgaaaaagaggcgactgggtaggccaatggcgtcgggattccttgggcccgaggggtgtgccgtgccgacatatggcgtcggcgtgtgcgtgtgagcccgcgccccgcggcatatcggtttcaggaccgaaccaaccgcacgcacgtaaacggcgaccggacgtcgcggcagacacagcttttaagaagattttgagaatatgccgcttttttccttttttttaatatatatgcccgtcaggaatttcgtgtttcccttcgttgccttgccatattgctcttcccctttattgccacactccgttacttccactactgtgttactgttagagcgggtccttggagacctggaccggcggacatgtggctggtcggtcggtggccagtggccacaccacacggcggaccatcgccggtcagattccagtgtggtggacatgcgcggcggcgcgtggcctggaccgtggacagctagcatctgctgggccacggtggcagccttttcagctactagtactatatcgtaggactggactgcgtcgtgggtgatgaccatgcatgtgcacgctcgcgacaaataggcccacttccaacagcaaagcgattgctaggcccttttccttgttccttcagtacgcgccgacttggcccatgcgacgacaaaggaaatgggctccgatggccttgcctgcatcactcgtccgcagggagacgaacgctgtgcgctcgcgttactgttcgccctctgcgccgccacgttgcgatgcttcggttccgtgggtgggcccggagagatcgaccggccgatcgcgacgcttcccgccggactatatactaataataataatcagctgctgtggcctctgggtgctcaggttaaccggacggggtttatggccttctcatctgcactttctgttagactgcctttgacaggaggggaggggaggggagagagagatagtacctagaccatatagtatgtagagtagaattctgtatgttttttcagtaatatagttgcatttcacatatatatatgtcgacaacttggaatctggattctacgttacttaatttgtttgagtctggtatatgttgtgtgtgcaatcttgatcaatgctattgttttagtccaagaaaaagcgcaccgggtcttgttttcctgatgatgcagtgaacattagggacggtggtaatgtatcacagcccaaataccccttcaaagtttgtttgagctattaactaattttaactcaaaaataaatagaaacagaggtcgatcataattcgatccgatctttaaattttaatgtacaatttatagtctattaccactctagtgaagggacatattcttcgctcacttgtaggacgccaaaaaaaaaacaaagtccgttggtgagatggccagtctaatctaatatctacaggttttaggacgatacagccaaaattgtgtacctttttagctcgagacagactaattttaggacatacagccaaatgtacagaccgccgaattccaagaaagaaaagtctccagcaagcacattgtgcagttaaccatcacggcattgatatcaggagcgaacatgatcaactaatatctcataaagtttgtcatgtctggacaattcatcgtctgattcaacactttcttgttcaattagaatactacgaagagatgtgttgaatttaggctacaagtccgaaacaatattgagtaatgatcaagcagcacaatgacatttgtgactattcacctccatgggaaaggcatacagagaacatgggctaaaatacaggagacaaaaaaaaaaaaacaagcacacaacaaagaaatgtttctgcaggcctgaatggtttcacaagctttcggcaaaggtagaacatgtaacattgccacctacaaagtgcatacatggctgtgcaaaggtgcctaccctgtcatacacagaaaatgcagaaagtgacaaggcggtatgaacagagatgtggggcttttagaccagggttgatcatcctgtggcacatgcgggattttgagtttttcaggtgtggtgtggcagtgattaaggcccgactaaggccccgtttgatta

SEQ ID NO: 407 - DNA, 1882 bp, Zea mays
  misc_feature (1)..(100): optimal_loci_178170_G1, chr5:31832841..31834722, Cluster 3
taacgccgaaggcaaacattatacagatcaacatcataagtgacataatgatatcttgtgttatgtaatttacatatttaaaactatgtagccagtgtaagtagacaattcactgtataattcgtctatttatgttgtctatatgtgttttctaatatacaaatatacaacaactatctatgtctatggatatggactgtacatgtccttatatacacttgcatgtggtaatatagccattaaaactgacactaagggtatatacagccatatacaacagttgtctatatgtatattgaaaaacacgtacaaataatataaataataagtcatacaacgaattgtctatttatactgtctataattttttaaatttatgtatggaacaaggaccaaagcaatcagagtgattgacgtaccgtctcatgcattggagcacggggccaaaaccgtctcttcacgaaaggacgatatatgtctctctcctccttaattagcgtctacgttggatttttttgatttaattgctgtttacgtggctgcttagagatgacgtatttgataccgctgtacctgtacgtgccctaattctatcgccgcctgcggcccgacgcgaacgactgctcggtcgtcgatggagaggcgcgggcggcgggcgcctttccgcctcctgcaagtttgggccaataccgatggcgctgccggcgaccgtgtggagcctatcagtaattccgcatgactgtccgcatccatcgtgcgaacacatactccagttgaggaaaatcccatccgttcgcatcgccattgtgatggcatggctacgtacctatgtactcactccttcaaatcaaagagtacaattatggagtaattctttagcctaagtcaaaaccactttcgttttgacttccttgcaagcagtgtctggagttggcttaaggcgacctagagagttagagacgatgatggattggtgattgtgtttatttgcaattagagtgagaattacacacatcagtaatgagaggaaggtctagtttaggtactcttacgtacagattacctccattggatttcaatcatttagctagcctccgtgagccaaccttaccagcttccgttccatgataagatggaagtctgacattgccctgatacatgatagagaggcggaggcgggtaccacaaaagttacaccacgtacgtaccataccaacgacatgcgtgatttggcatgtgtggatcgattcaatctgaactcaacaaagaacaaaagatccctgtacgaatgaaccggcagcccttggctgtctccagtagtccagctccaacgatacctacccgtgccactgccatcagaagcagcgggaagtcagtctgaactcagagcctgcttggtaactactgacttttggcagctggacacctgtgtggtgactggtgaggcctgcaaattgcctgctttcatttccatgcagcgccacaagatatatagcacacaaccagaggaccagcaggagccgtttgtttcagtttcacatccgacagcgatctacgtactggtgacggaggaaaactttcagcgaaaaccctttggtcgctgtttgcctcgtccctgtttgttctagtggaatcagacgaccacgcatgtgttgtggctggacttccgctgaatctatcttcgtcatggagcagcagcgtcatgtctcaccacggaaagttcatcaacgtccagatcatgcctcaacccactcaccaccgagaatccggttttttatggagtactcgacgttttaccaaagggttttttaaattggtgccctcaatttcggtagtgtgctcacttatacccttagtcgtgtttttatcagacatatcatac

SEQ ID NO: 408 - DNA, 1870 bp, Zea mays
  misc_feature (1)..(100): optimal_loci_181036_G1, chr5:48352610..48354479, Cluster 3
aaatggagcgtaccttcatcgccattaggcctgacggtgttcaaagaggcctggttagtattagcaactgtcacagcaccatagtttctttcgatgcaattctggatcctaataaccagttttagtttgcatgtactctgttctttcatgtcatgttcttgaccatgtagcaattattaatttgtaatttctctggacatggtgatataggaattcaacacttcttccatatagctaatagatgaaattgttgtggcttgcgacatagtttcaaagcaccatagtttcgtccatatgtctatttggtatatcaaatagccatctactgcttctatgcaattgcatgttacaagtttctaatgcttctactgcttctattgctgccttgtgaaaaaatcagatcatatacgattttttgctcacactcaaattgattagacaaaattaaactcatatagttcgctggtttcagagtttttatatctgtgatttgtgctgaaaaaaggttctgccttttctgcggattttctagacgtaaattttagtatcatttgcagttgtaactgaatttgcaaactgagaatcgttttgtttcatcaggaaagccagcacgtggacaacatcacaacattgtttcatcaggtaagttatccttatgttacttagatggtaatgaatcattttacaaagacgatctgaaatcttctaggcaacaacagccatggctttgacatattgtcttgtacctttttagattttcttgtttttaattggtatggtggtgttgccgccccatttgcactaagctgatcactgagtcaaaggagtaaaaagcctaataaaatgacaagcatgtaacactgatggaataatatattttcattattttgtggtgtaaaatatgttcaatgcaaaaaatatgtagtgttaaatgagaaactgtttataatacaagtaactagctggataatgcttagtgcaaatggggcaagttccatgggttagatttctctccttttcttgtttcaactgaggctttgttaacatatgtgtgtgtgcgtagggggaagtaggtgggtattttgtggtgtaaaatatgttcaatgattaacatatgtagtgtttgagaaactgtttataatacaatgaacttgctggatattgcttatatgtaatttttagtatgggaaatgtttacagttctctatccggatgactgcacgcacacaatcatttttagtattcctagttctctatccggatgactgtaaaatcatcgttgtgaactaattatttgctttccagtttagtttaccgctattatgaacattgttgatatttacctgaacttatcccaaagcactctatgttttgaaaaagtctatgtttagaaaaaatctatgttcagaaaagtatctgtatatggtgtcacggatatgctcttacttaacttcagctggggctttgttaatactttcagtgtgtttgtgtgtgcgtgcgcgaggggaagtaggtgtagggtattttgtggtgtaaaatcagaagagtagctggctaatgcttagtgcaaatggggcaagttccatgggttagatttctctcattttcatgtttcaactgtgtgccttgatttgcttagatttacttttccaaattaaacaataaaaaaatcatgtggatggactttaaagaagtataatagatctaaatatgtgatagtataacagatatgattagcaattgttgaggttctcacgagggagttcaacagcggggaacattgtcttttatttgttggggctgcagttgtcgatgccacgatcacactattgagctctagcctgttgttgatgatgattgttcgttgttt

SEQ ID NO: 409 - DNA, 1813 bp, Zea mays
  misc_feature (1)..(100): optimal_loci_183137_G1, chr5:62258247..62260059, Cluster 3
tgcactccaccacacgttatttttttgagcgcccactttctaatgtagattattggtgtcctatgatctcagaccaattttcatgttttcaccatttttcatgagctatagttcactgtttttttgtgttttaggagttccaaaactatggagtcccaaatagttttaggacactattaaggccactatgatatacctagactgagacaacatttctttagcaagtttctacccacaaaaacacgagttcttggatttactacaccccttaggagctcaaatacctagtttcatgagtttttttgctattttaagtttgtgattcctaggttttcgttttttcggcatgtcaaacatgacagtctaggcgctcaattgcatgttgtttcttaggcccactttctagtgtagattttttatgacatgtgatgtcagactaattttcatgttttcactatttttcatgagatataactcactagttttcggatgttttcaggatcctagaactattgagtgctaaacattcttaggccacaattaagaccattaggatgtgtacccatgctgatacaacatttttctagctagtttctgctcacaaacaatgtgttcttttgatttactacatctaagacaaacccaaatacctaggtcatgagttttttctctactttgggtctgtgattcctatgtctttttgcttgttttggcttatcaaacatgacaatctagacacccaaccacctgtcattttttggtcccactttcttgtgtgtatttttggcatgcggtgtttttggaccaattttcacattttcaacatttgcatgagctatagctcactagttttgggtgttttcaaggtcacaatactattgagtctcgaacattcttaggctagtattaaggccactaggatgtacctatgttgagacaacatttttgatagtttctactcacaaataacgagtttttctacacccttgaggagctcaaatactcgaggtcacgagttttttttaatctattttgggtttgtgatttctaggcttttgttcgttccaacatatctaacatggtaatctaggcacttagacacatgtcattttttcttggttcactttctattgtagatttttacatcttgctctcacaacgattttcacatttcatcatttttgtgagatatagcccactgattttagttttttgggggccccgacactattttgtgctacacattcataatccactattaagaccaacatgatgaacctagggtgagataatagtttttatagattatttctacttaaaaacaatgagctctttagatgttactacacctatgaggagcttaaatgcctcgggtcataggttttttcgctgttttgggtttctgattcctaggatttttcccaatatgtcaaacatgtcaatctatgcactcaaccacatgctattcttcttgagcccacattctagtgtagagtcttgatgttccatgctctcggaccgaatttcatgttttcaccattttcattttctatagctcacggtttcatgtgtttcaagggccctagaactattaaatcttggacattcttagtacactattacgactattaggatgtacctaggttaggactacaattttctagctagttttttctcacaaataatgagttctttagatttactacactcgtaaggctatctccggcagactacaaatcacactgcatatttcaagcttcactctgtaaacattgtcgtctacagttcaaaacagtgttttgcacacccgttt

SEQ ID NO: 410 - DNA, 1687 bp, Zea mays
  misc_feature (1)..(100): optimal_loci_183636_G1, chr5:66004953..66006639, Cluster 3
agaccaatgtggtatttgcaatgtcagacacctagggtatatcctgtatttgggtttcgtctagtcgtttcctcagcgcggcccaaacataccctaaaccaatgtaactagaaaagccgaaacaaatcagtaatttgggatggatggagtacatgtacaagctcatatatatcataggctaattaagtcatgcatatggctctttatcttatatgcttcattttgttggttaattaaatatgtgattcttgcatcatgcagagatggcctccgttggggcagacatctgcaactgcaggcacctgagcagcacatataaggacgagtgcgacaccggcatcctctcctgcgacgagacatgcagaaacgaaagcggtggcaacactggcggctcttgcttcgacgacccccctagttgctactgctttaccaactgctagcttgacctagctgagatcgacaatcccatcatccctgctaggccacgcatccgtgtaatagaaatataaataatgtttaattatgcgatggtaactggttaattaatactatgttgtgacaaataaaatttgttggaacctgtggatccaacaatttattaggggccggcatggtgcagccaccagctgtatatgtttatcctttaaggcaagatcatatataataataaaagcttgggagacattacaatcgagtcatttttttgccccatgtttttcctagtagtgtctttatcttgtaaaatatgatgcctacagttataactatacatggatatggtagtaagagtttaatttatatggacttttgtgatactcagacatggagttctattaaacatggactattttaagatcagtgttagtaagagtttcacgtgagttccatttatatcagatagcaggttgcattgctacttagtttgatatggtagtatattcaagaaaagagagaagaaaacatcccattctcatgtcatcttccctgagaggatgaaggacttcctcatgaatccaatcaagtttcgctttgggtccatggatgctagactccaactctgcgcacgacaacttggtgacttctggaagctcggtgtccgcatcgacgtcatagagtcttcccccgaggatcgtggcgctgctcatccacaagattggcaatccctccatctcttagagaaggtgctgcacaaccctaagatcttgttcggttacatgggatgaaatcacatcatgaatttaattcggctatggattaggtgaatccatatctcacacctaatccatggtaggattaaatccatcaactaatgcatgtgtctcttaaagttagttattcttttgatccatgaattctaatataaacttgtgcaatatcttcatagatttgttccatagctaatgagctatgaatagaatcatgtttttcatagtttataaaataccaaaacccttggattatattctataatgagtttaaccgaataaaaaaatttaagtagtcttggattattttaggacatagattgtgacattgatttaattcctatccatgctaatccagagctagattagtgtaaacgaacaaagcataaagtgaattgaactggtaaccatcagatagggagaaggtgagggcatttgcgcgggaaaaaaattcgcgtctcgtgtcgctttgtacccgatgc

SEQ ID NO: 411 - DNA, 1619 bp, Zea mays
  misc_feature (1)..(100): optimal_loci_184485_G1, chr5:72675148..72676766, Cluster 3
gcctcgagattgacccaaggggacccgccactcactacggcgcaaggcattagctgcagaactctatctctcatgtaaagatcgcccttgaagtataaaagggagtctctcttgtccctctcctagatcgggcaatggtctgggagttagggagaaagtggcttgcaagtgctgcggtcggtgtagggtttaaacatgtcattaggcaaaataaatagtcgacccactaacgaagttttttttttcaattttctaaaacttctttgaattttagtttgaattcagacgtgtattttgaaatttggtttcaatggtaattcttagaataatccatactatttgcaagaaaattaccataaaaaattgttaaaatttacaaaatctctcaaattcgaatttcaaaactggtacaatatccgagccgaccaataagctggatttatcgaacggtttcacgacccttgcctgtatgtattgccttgatttatgtcgtttcagagttgggtttgctcacaactcaggagtcgcgttccacgttacatttgtttggttatatttgtattcaaattaattacagtagaatgtgtcaaaaaatagttatttttgtactctaactcattctaatactatatttgaattaagataaatatgagtatatgactgagttttctaatagtctcgttattttttgcccatggccgattttctttcggtcaagcttttgggtgcgtcgtcaactagaagacccatctggtcaacgtcaacgataaggcccattggggctatggactcgaatgtatgggcctcgatccagtttgtacccgccgtaatcatcatcagtaaacgtacaggcgcatcgcgaaaaagctcgcaaaatcgcagcacactagcacagaaccttggacgcgaaggcgtcataccccgatgccggcgtcgtcgtcgccggcgatggcgtcgcagcatgcgccgccgaggcgggagctcgacctcgacgctttcctcccgtcctctccgacatcctccggggcctcggacgccgacccggccgacgatgaccaccgccgcgccgtcgacgacctgctccgcctcctctcctcctcagactcggactccgattccgaggagtctagccgcatcccaagcaccagcatccagacgctatcccgagtccaagccccggcgcctgtcgctgagccctcgccgtcgccttccccatccgcgtccccgtccccgaggagatccgcatcggccttgccgtcggagaccctctcctccctcgtcgcgagaaccttctcgagcaacggcgcttcctcgtcgtcgaagcccctcccctcgctcttccggggcgtccgccccagccccaaacccggcgccgcgcttgccgctgctgccgcagcgtcccgcgcggtcctcaccccacacgccgctgccatcaagtcgcgccgatcagtatcggcgcccgtggagaaagttctggaggaagaggggagtggctccgaaggctccaaggagttccttcccactgggagcttggaagcagaggtagaagagaagggtgattcggaagcggttgctgatgcgaccaagcaaactgcaggtgggaatgtgggtgcggaact

SEQ ID NO: 412 - DNA, 1488 bp, Zea mays
  misc_feature (1)..(100): optimal_loci_185506_G1, chr5:80456356..80457843, Cluster 3
  modified_base (239)..(239): a, c, g, or t
  misc_feature (239)..(338): n is a, c, g, or t
  modified_base (240)..(240): a, c, g, or t
  modified_base (241)..(241): a, c, g, or t
  modified_base (242)..(242): a, c, g, or t
  modified_base (243)..(243): a, c, g, or t
  modified_base (244)..(244): a, c, g, or t
  modified_base (245)..(245): a, c, g, or t
  modified_base (246)..(246): a, c, g, or t
  modified_base (247)..(247): a, c, g, or t
  modified_base (248)..(248): a, c, g, or t
  modified_base (249)..(249): a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
ggctgacgtggcggacacataagtcccgtcggctacctacgcccgacgggaaataattgcatggctcgtctgccctggcgccgagaagcgacaaactatcgtcgtgtactagggccgacagtagctaccttctcaccgctgagtcgactgaatgctcatgcattcttgtccgaattcttcggcgtcctacattagagtgtcatcaatagagtgttctccacaagagtgtcatactgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgggaatatcctggattgctgttgtgcactcaacctaattcacagtcacgtaaaatccatcatcacccatctaaattaaactcatatctaaaattcacccaaaataaccatttacatccgctccatttacaggcctaccgatatgtatagaattttttcataggaaactgacggcctcgcgtcctaccgttctgtatccgtcgtcccccctatgatctccatgcatcagttacttggtccgttgcctagcgcttgtccggttgcgatgaactccggagggtgagggtgacggtgacgggtcggtcagtacagtgtggccaagaggcaaagcctgggggatactgtctccaaagtactgctgctgctactgcacatcatactgctgcgtgctgtttgagatatagatggcatgatgtattatctatctgcataggatcactagcccacacacgcttgaatcttttgatcgaacgcttccccagcgtaccgtgccatcatggtcctctgtgcgaagtgcgaaccgagcactgttcatcagcatgccgagtgacgatgtgacatgcacgcatcagggcagaattccaaggtgcagggcagggccaatgcgaaccgcccagccccatgttgattgttgcctcgctcatcagcgatctagtagtttctttgacaccgcagggcagggattacgccatgcctccatcatggattcatggtcatatatggaccctgtctgtctccaggcctccagtgtccggtagtccatacagtacgctgcatgtatacatgtactatgatacatgtactatggtacacagtgctagcagcatgcatcacacacttcgtcagcatgactgcacagtacccaccaggcgaaggagcacatcaggtcatcacgccatgccggtcctgctggcgggcggcaccagcgtgtctccgccgtagggtgtttgtttagactgctttcaacggttcgcgctgacctcgacctctcactgccctacccatgtagccgtttaggaggttcaaatccctataattgtgtcccctttgaactcctctacacactacagtttaagtggaggctacaggaaacacattacacactacagtttaagtggagactacaggaaacacacagatgtggggg

SEQ ID NO: 413 - DNA, 2197 bp, Zea mays
  misc_feature (1)..(100): optimal_loci_195211_G1, chr5:146893947..146896143, Cluster 3
ccccccccccctgcttcgcttaacggcattgcacaatcttacaaaatggagagggatttcatggccgcacaccggagaagatccatgcgaatgtccaacggcagggcacgctactgtccgtctgtcacacacttgtagaaaggcacaccactcaaccatgttcctttttttttcctttgacgatcgagatgcgattattcaccgcgatgcatggtcccacatgattggattaaattccatgtgcgtgcatagcctccatccctgcaggtacaacctgtactgctctgctcgctgcgtccgccgctcatatggtaatggtatcgcatcgaatcccaagcctagctgggcgatcaaaccaccattgtactacaccttgttgaactgcagtcgcaaatgctattaattatttaattatatcttctaatctgagcagacaaagacctattaaacaaggaaattaataacgagcaagaagggtaagctgaaagagaagagagaagcttccctagtagaatataatggttccgaatttccgattctgcagcacatgccgagcatatccagatctcgtcttcacgtcgtctttcctctgctctttgcagcgtgtatatatataggtagctggcgggcaccagaggtaaggcccgagggcatggcggggagggagaagaagagaagcaagcatagcaaagaacaatagcaaacagagcggaggatggtgccatgagcatgagcatgtccatgagtgaagagctagggtgagaatcacagtgcagttctcctctggcacgaaccaaggctgagcagcttgccccatggctagcccacgacggcccttccttgccaaaggagaattgccctgccattcacaaccctacagaaagagagagagagagagaacgcccaataagcggatcgtggacttcgctcgagttttgaactttttcacataaaggttattagttttccagcaattttcaaaaaaaagaatgctgtaatttgcttcgatgatggccgaacctgaatttcattaccatgattacaaaatcatgaaatcttaatgtttcagcctacctaattgttagtaattacctaggtgtcaccatctattataatcatggaacacaagggagtgtagttgttcagaaagcccgaggcgcataacactaagccgctagcataacactaagccgctattttggctagacacaaccgcaacatgagtcaatggcctggtgtttcacaggttcgggctagtccgacctgagggacggagagagggcaaggtagggccgaagaccataccctgtccgcacccaattccccgaaagccttaacggggataactacatctccatccccatccccatggatccatattctccatttcggaccacagaaaacactacgacacaaaaactcctatcaaatacaaggataataagaaaatgttatatttagggtgatagttgtgttgaactttgatttcatgggctatttgggtccccaatggagccccgtgggggatacttaatccttagacccagttcatttatttttgcccccctcccctccagcactaaggggcgggggagaaaatgtcatcgttcctgccccaaacagagctgatccttgcagggccccgcctccatgaggaatttcgccctagatccactgcacaaatccataccgctctcgagacacgccaggcgacatggctcgacctaccatttaatggtcgagacggtgtcgacccattgactctcacaccctcctaaagggatcaccccctactccctatttgctatgctaacactaacttcctcttacataggctcctccttgtgccagactctcaaagtcgtagacttgctaacctcattccatccctcccttctcttggctttgactctcaatgtggggtgtgctgccgctgctgggcgctcctcactatccgtgcaatcatgccctagatgtggtcacctgcctcagaatcctcaacttcatgtagtctagaagcgatgcctcctcgaccatcatggcttctttgagaggagcatgtcagccttagggatgccaacctcgagctcccttgtttgcttaccttgatgatccagcatcaagcaccctaacagctcctcacctttgcaacttgctgcccccttccctctttctttaccttttcatggcattcatc

SEQ ID NO: 414 - DNA, 1676 bp, Zea mays
  misc_feature (1)..(100): optimal_loci_1993_G1, chr1:10533050..10534725, Cluster 3
agaatactaaaaccggccgtatatactcactcactcccgagtcccgattcccgaacgaactaattaagcacacgcagctaacggtcaaattgatcgggcaacatctatcaggagactttgggatgacgaccatcgatgtgtgagagaataatactactaatgttcgttcgtcaaggttcaagagagccggaagtcccgaatgatgcaactaactgtactaccgccgtacccactgcggaacgaacgaactaaacaccggccgcgcgcacgtgtttgtcaatgcgtgctgttacatgttgactcgatcgatccaccggccagtgagcacacgcagcagcctactctatgcgagaacgctagctagtagtagtacggcgacgatcgaacgacaagtcgacaaggccagtcaacatgcgaggccataggcccatatgcatcattacctgcggcaaagtacactactgaacgccatcattcgtcgataccctgcgtacgtacgtacgtatacacgccagcgatcgaagacaaggatgtctgtactatacctatacctgtacgtgtgtctgcatcctgaagacgtacgtacgcacgcgcatgatggccctgctggtcccacctaattaatcaaagtcgatccaaaccgcgcgcgtacgtcgccttcggacggaggaacttgcgagtgacgccaagagcattagagcaagcagcagccaccggtacggttcggtggccaccagtcaccacgcacggcggcagcacagcagagcattgcatgcatgcgttattaacgctggtgtgaaatgtgaacgaagggggggagactttgtgcccggagaggagctgagagagctagagctagctgccagccgtggagatcagcatcagctagaggccgacccattgcgcgcgtttggatttgatcattcgatgcgtgtgaacaaacattaattttcctctatatagcctcctagctagtagcttggtcgttcacttgtgaacgcattcaatgcgcgggcaacgtcggtctgctcccagtagcttagcgacctctgtggctatggttgtggtagtagtagtagagtaggagtgtaggacgtcgatccgcagcagaaattgaacacacagagtcacagagaggtcaccgtaccgaccaggatagtacagggggcatgctgctgctagatcgagcgctactacaagaacagtcaacgtactggaacagaaggaaacggcgataaaactaccgtacgtacaacggccaccagagcacctacctgttcaccgccgccgcggagctcgttaagttctcgcggtgtttggaagagctcgtggggacgggaaaagatgctttgttgaaaacctcaccaggcgcgtacgtgatgagtactacgttacagcaaagtcatcagtcgggaagttaactgatcattgggttgtctaaaattaccgccgagagcccctaaaccctaaacccctgatgtggcttcctttttttcaattcaggtgtgtactgtattatgtatatatcatcaaaccgatatctgagcggcggcggcgctagtcttggaatgtttcggagttgctgtgtacaccaggctggcatgagcagacgtacgggagagcagtacacgtgcgcttagctgtccaattcagaagtagcatacacgtacgtacgt

SEQ ID NO: 415 - DNA, 1653 bp, Zea mays
  misc_feature (1)..(100): optimal_loci_200379_G1, chr5:176225422..176227074, Cluster 3
gtttgactgttcggctgactggatgttttggcggtatatgtgaatgattgctcgtgtcctgaattgtggtccttttccttcctataataggttaaggtgagagaagggggtcgctacaagagtctaagggtcgggcgaagcggatgaaggtcggacattgtcatgtagttttttatcctctggagttctcaccagtcgagggacgtcatagatgaagcctcctccctctgtcaggatactgtagtcacacctaggccatcccagagcatgtcgttgcactttgtcatgtccagtagcagtttattcggtgtccttgtttgacttcctatctacggagtggttaagctagtgtccgcctccatgctgtgatggatgacgtacgtgctctgacatatctgctcatgtgccatcattcaaagccttatgttgtatcataatctaacttgcatgcagtaagaacccaagaatgtcacgcctgtgtggtcgagcgaagtatccaacccttcaggtcaggggtcgggcgaggcgaaacactaaggtgggacacatccgagcttcgcccccctccatagctggggttggggggtcgggtaacgcggaacttcgaatcggagacatctgagtttgggtctctccatggtctgataaggtggaactctgcaatggtgatatttgaggccctgacccatcgtggccaggatcagctgagtcgaaatctccttgacaacggtaggtagaaatggcagtgggtcaagtttagatcgagtgtagcaaaaccctgcctaaccccgctaaagctttgtttggatactctaatattaaccctagtccgtgtgcgttaaagtggatcgggtgtaaattagtttacgttacactcaatccacctaaaacatgtggattaagctcaatactaaagtaaccaaattagatctaaatatgtgattgtctcatgtcaggcagggtccggctgcagccgtgagagagtttgcgagccattcggtccaggcgaagacgttttttttacgcgtaagggacgggctccgaggtccatggatcgattgttggggttagttgggcctaattgggccattgtatcggtgtgttgggtggtcggagacctagcgaccagattgtaggccagaataatggaggctgtatcgatcttgcaggctgcaacccatcgcccagtctccattggcttgccatttgaatcttgtgtgccgttgctccaccttttttttcttctagtacaaggtagaagcatcacaaaggaccaattcagtacatggactgaaagtacgtaccgcgataccaacaaactaaacaagagcacaaatgaccacaaatgatttgaggagcatcgtcactgttaaggataactcttaattattagtgaacaaaaagtgcacgccagttcttgctgtgctttctgtggttggctcctaaactgctgcctttaattttaaaactcctttttctctcttaaccatcaaaagatagaggatagagctgccatttacttaaaaaaaactgtggtcgatcgagtttgtttaaccggctcacttgctccggtgtggccatgtacctccagttattcagagaatgctagagaaaaccagatggtactgttcttcatagaagattcatctctaa

SEQ ID NO: 416 - DNA, 3448 bp, Zea mays
  misc_feature (1)..(100): optimal_loci_202140_G1, chr5:186253338..186256785, Cluster 3
atggagacaagacccacctccacttctacaaggcggaggaaacgacggcggccagttctctaaccctggccttaatctaggccaagatagtatgcctaatccctctgcatattcataggtttatggtgtgcacaagtctagatcgatttactgctgttaaattaaagcaaattagtatctcgaattgactaagattgaacaatgaacacggtaaagatcctagaaacctatcaacgcaatgccatgtctacatgtgaggcttaggatttgatggtttttttgcgtgtacaaagaccgagacaatcgctgataggaaacgtgtgaaagaatgtggatattattaagcatgtcagggccgatatacttatttcgattgtgtatagtaccaaggctaaggttactagaccggctatatagatggataaaatactgactgttttgtggtgtagtacattgttggagtttgaaatggtacggggagatagaaagacctatgacgttagtatataggtgcttaccatctgtcggcgatcttgcttcttggaactgatattaaaaagcctgataataatatggtgatgcacggacattgaccagtcctttatcgaggagtgcagcatacatgcaggctgcatgcagcagatgatctttgctcctcctactgtggagtagctgtagctctgagctgtgatccgacaatagtctcgagctcccacgatttcaatcctgacgacctgagactacgaggccgggtgaaaaaggtcgaataatgtcgtctgccactggtagtctacttatcacgagactctctgtgagtctgtgtgcacatgcacgaatggcaggcactgctatctgctcgccgtcttcatggttgctccgtcttcatggctgctgctgctgcacgcagctgctgggacccgggtgcctgggacgatgatgtatgcctagcccacgcacagagattcgtacagattttaaaaagatcgaaggtgtgtttgtttattgtgctcgtttctggtctcatgtgcgtctagctccgtggcaaatgctgtggagatgatgttgcagcttttgtagctgtttttttttaaaaaaatattgatgcagctgtgagatttagggtcattttatatatggagctatggcggagtatttcttagaaaccgcagatattttgagaggagcgagaagtcctcacaaacgggtccaaattagtttgtgaggcttcacctctgctagttcgttctcgagtttgacgagagagagagagagaattccatgctacaccaacagtacactgatcttacaggagaagctgaagaaagttgggagtcacacgaaacatgacccttgcatttcatgcgcagaaatgttgtgtgcgccgagattgcaacccaaacccgtttatttaaccttgcaataataatcatgtctcacagctgcctgttatcttcagtctaaagaaaagcctctcagttgtcttgtctacttatctgcatactgctagtagcaggacgccaggacctgtgctgtttccggcgcgcacctgcactgctggtggacctcattcggacgaacacttcgtgtggggttgcttttgtttgagctaagtatgcctgaatcaatcccgatgaagcgaatggagatgcctcaggagaccggccggtagtagatcgatctgccaatcgaggcaggcaaagagatacgaaagcgacagtagacagggggacgcctgaagaatgtactccgtatgcattatttggcatcgcgcgcgcgtattccgttcaggacgctgcagtggacagtggtgccataagtgataaaactttgcagataattaagtttgggccaaacaaaaacaaaatttgcttgtagatatgtttatttcacccttattgaagaaaaaaacatcacgccgaaaaccctactgctactattcattggtctagcttgtgtattggtttttattcagcctattcttcgcgagcgcgtgatctgggtcatcttaaaatatgttttgtttctaggactttgctgatttgcttcaaaaaaaacgagatccatcatcatgccttcttttgtattgccatcttcatgtattatatatatatattgcattgcatcatagggacgacctacttaacttaagcatattctttgcaaacatgcatgcatgttattagtcaccaaaatcgtagattattgtggcctacgaaagccatatttgccatactcttcagcatcctaattcatgttttcctctttgcatcacacctctacatttgttttcccaattcattattttataagcatccaagctagggctagcttcattcgcaattttccccagatggtcccatggagcgcgcgctgcactgcacctggtggtcatgctacgtttacagtctggtggaatttgatccagaagatagcttcttgctagtccacgaactgttgtaaagaaaacgacactccgggcaagcttgttatagtccaggcaagcatatggaccaccagcaccaggtaaggtaacgatgctccactcccctgaaattactcactcgcggtcaaatgaatccttcaagagtcaaatcagatgactctaataatttcctaacgacaggacaggacaggccaggcttatccaaagtaagacgggaccggacggaggcccacgccacacattgcattaatccgtgggccgtaactctggctgctgcactgacttggcggggctccgcgctaccaccagatgagatccgcccacatcaacaagacgggacggcgagcgagacgcagcccccggccctttgggatcgggaccaggtgcgcttgcccttctcccccgggccccggcccatgcgctttcaggttcgctcgcaggagcatgcaggcccccagcctaactgtcgcgacggcgccggtaccgtctggggcctggtcgcggtgcgggtactgtcggcaacgcctgttgcggcctgattggacgacctgggcacagacggcaaccgccagccatgcagatgcagtgcagctagctagcgacatggaatgaaactagacggtgcttcgcggtttgcttcatccgctacgaattcaagtccggaatcatcagatcggcgaggggagagcatttccaatcgacatgttcttgcttcaatccaagcgcgagaaggagctgaccggggggtgggatgttgatgcaaagcttcaaattgaagttttcttgctgtgagtacggtgtatcgatcgccttggaaagctggaaaacgagcatggccatttaagaggaagatagagatattattgatgagacatctgggagcgttgcaatcaaggtgactgtatagcggattgcaccggattgacgtcgatgcagcggattacaacagatagcgggcgatattacggataagtttcaattagcggcacctcgtaatcttatact

SEQ ID NO: 417 - DNA, 1483 bp, Zea mays
  misc_feature (1)..(100): optimal_loci_202158_G1, chr5:186399718..186401200, Cluster 3
gatattttgaatgaaatagtactgctgcctatatggtatacataaaaagtagtctataggtacatgtagcatatataatgtttatagtgatttttttgttattccataaacaattatatgagatggcattcagcctatttatcctagtgcctaatcaactgcaaagatggtataaggcaccagcggatctatagggtgtccagggtatgcaatggcataccctatagtccagtaccagcacaacatagtagctttgtctatttcatgacttcaaacattttgtaacctacaatatgcgttcaatttatctctatacaagaggaagaataatttctatatattaaaccacggcgcaaagacgcaaaagcagccagtccacgtagcctatattattttacgccgttcgatctgatatgtagagccaggttcgcttgagcaatacaccatacaggcggaggccactgaaggcttcgagatggggcacgatttgaacgggcacctagactaaaaaaggaaaagatgaaagagatgagatggggcgggattagcgtcttagcgaggggctacctctccttcgacggcggcgatggcgattttactggtcgttcgcctcccgttatccttcctcaaaagccatgggaagcttctgttacgttggtgcgccgtcgtcaaggctaatcgcggtacattgcgccatcctcgccagcgagttcctcggcaagttatccgtctactcttctcatcggcttgcgccatcctccgccgcgagttccacggcaagttgtctgactgctcatcttatcggcgtacccaaccttcatcgtgtggcagattcgtcaaggtacgcaaacccttctaccagtgtgtcgctcagagttgtagtttcccgtctaaactcttgcttcacacatcccgaatccactcctgcttatcgataagcaaagttagccggatgattcttcaaaatttatgtcctccgtattagagcttgcctctcaagcttcttggtattgcactcctactcgatttgtgctaatcgtggggggggcaagaatggcaaacaaaaatattttctttcgttatcccctccttcagacgcaagtttacgatggactaatgaatctctacgtccggcatgggatttaccttcagctacagaccaaacttcgtatgtattcctggaaatattacttcctctcattggttgctgcaaatggtattcttcatctgcatttttggaaatattgcttcttctcatttgcttactgcagatgtccttcttaatggatacccactatattatctgccaacgtaatacctgggtattgaactgtcaaactaattaacttctagaacagcaaatggttagtagaaatgtgcaaatgcataaatggccatataattgtttcaaccaatgaataccagcctgtcttttaattgatcctgcaactcgcgttagcagctaacttggacaaactgttac

SEQ ID NO: 418 - DNA, 1420 bp, Zea mays
  misc_feature (1)..(100): optimal_loci_202159_G1, chr5:186401566..186402985, Cluster 3
acccatatcttttattaaaatcatgtagatgtccacacatgtttgttaactttactttatttacgtcacttcctcgcctagatgtgaagatataatgtattcattactgccttttttgcatgatcactcctatttgctatcgtcgcacaaccattgccaaaagctgcaaattctatcgaaaataggtatgttttcctcctattcatattatgtactggcttacatatatattaatacctacatattgcttacatagatttacaatatcacattgcttactgtctatatacatcgttgttttaacgtattgttaaaaggctcgctcttccgctcgcgcaagcgcgagcaagttactagtttatacaagtggcaatcaaatttgtaaatataagaattattatgaataatttatacaagtgacaaatcaaatttgtaaatataagaattattatgctggtttacatataataccaaattataacacatattttatcattccttattgaatttctaaatgtattttactaaattatacatgattttttaaaatttggtatactcagtaaaattccagatccggccagaacgagtcaccatccgtctgattggttactcgcaccatctcatcttggatcaccccatgcgttgactttatttaagattatgtttggttgcttgtatgtgtgaatcacagccgcatagatggatgtaaaataagtcattttgatgctattaaagtgcatccactcatacgctcaaaattttcgtatgtgtctgatcagagcggcgccagccacagcgcatagacgctcagccatccaatcaggctgcatgcaaacatgctttcccaatcaggctgcatgcaaacatgctttcctggttgctgctatgacccattcaagttttcaattagaaattcatcgagtcatgtaaaaactagcagtgaatttgactgtaaaatacaggcgcccgagaagttgtgcagcccggagtcctactagactacttttaccggcatgtcagacctacccgtgtcattgtcgccatatggagccaaacagaacagaaattatcctcacactatggccatcataaactaaaccaagtgaagcctgttttaccgtcgattgaccatttgccttccgtgagcacaaaaaaggaacacaaaaccaccgagtttgaaagcatcaaaatgatagtggatcggcgacggtttcttgaggcgtacgtgggcgctcggcgctcaaacgccgtcacgtccacgccgtctgacgtgtttctgtcttgagctagctgctcagcaactttgacatggaaaccaaacctccacgtccagttcgctgtaaaaaaagaaggcaattgttaagaaaccgccaaaggggtcacatatacccaggaggctccatctttctatataata

SEQ ID NO: 419 - DNA, 2229 bp, Zea mays
  misc_feature (1)..(100): optimal_loci_202180_G1, chr5:186494378..186496606, Cluster 3
gctatgtaactagtgccagagtccctttagtaaattcgagtcatgaaccagaactaaatatcactctttactatcggaccgtgcaactgagactaaaaattgacatctttaatcttgattgtccaatattggttaggaatccggtagtcagattagtctttctagagtagtggcatgtcttgagagcttggagaaaacataatattaattggtagatgtgcggagactatctccctttagtgtcttttttctagctctgactccatcatgttagacagattttaggtttagatggtagctagcgacttcgatagcatgccgtctttttattcagctaatgaaaaaaaatgatcgaatggacttaatgagactacaacgttgctgaagaacataaggtcgccttcagatacagaaccagaaggagaagaagatccatcgacagggctgcctcttccaagtatcttcaagagttcctttttgtcagaaacgggtctttgatttattgtttagtgtcgctttctattgttttccatctttcaatagtccttttttattatttttttagacagcgggaatttcaaaggaaagaatgattatatttaaagatctatttagagaactgctgaagggttttctttactaaagtttatatttctataggttagagaaaaaaaagtataacaagatttttggagccgctctctccaacactcctgtcttgtcggtttcacctggggtctcgttttctgctaaaaaaatagcgctggtatcgctctcgaagaaaactcaacatgctgtgaggtgatgacgttgtggtgttctcggatcgagcgcagacactgcccacggccacacatctgaaccgaacgcgatggttgaggccccgccgcccgccggtggatagcgtggctgtggttatgctgccctgtggcctatgggctgtggccggcggcggccggcgcgcgggagtttcctggaagggcgcagcgcaggtcgcgggtgcggtcagcgtccgggcccggtggcagcacaagtgcacaacgacggagcggcgtcaacacgcgccgaaaatcctggccggtcggggcccctgctcgtgtaattttcatgcacttgcagcggcccaagcgagatgccgcatccgggccgtcaagatttggggcagtgcgtggtctttgtgctcgcttgatggctgatgcccgcgacgcgacgcgtgcggctcaagcgtggatcccaaaaatgttgcttagcgacgccgccaaggttgacattacaacaacaacaaaaaaggttacatggattaaagattctctgaatccatttttatttaacaaaaatgaagagtagaccaattcaaagttaaactaatattaagacgaagatctgcttatgtgatacgaagacactccagcaagcctgataaaaaggaaaatgggtttaattatccagttctgtggccatcgcgttccagacagcctcctggactatgtacgccagatcctcacggctaattgtttgtcggtggctatcaattagctggtagtacataattagctagcaacaattagccagagtatatttggagttaatgggcaaattagcaacaatctgtacacgatctattagcaccatttagcaagattaaatagttaatgggcaaataatttatcaaatatctgattaataattagtcaatttattagccagtttgtttggagatcaagatgctaaaattagcatgcaaactatttgccaaatgaatccaaacagggcggccatagtacatagattcaaccgaagaaaaccccccatcattttcatcacctaaatttcaacggactgaatttggcacaggttttcttgcactccgtcagcctcattgctggctcgacgtagagtcacgagacgccatctcgcgacctagctagcaacttacttaggcatcttgcattcttgcttatcagatgagtctcccatgctactaatcagtaaccaatactggaatgtggccgtcaaagccatacatacacacgaagatgctttgatatacgaatgctgcagtcagccatactgcccccgccaaagtctgaaagcgtaggagccatgtgcgtgcgcgtgattgaattcagggatcagctgtccctctcatcaaagaaaaaggaaagacatcgtatggcatgcatcttggctgttcagctcctagaaaccggcccatatggttccggactt

SEQ ID NO: 420 - DNA, 1618 bp, Zea mays
  misc_feature (1)..(100): optimal_loci_202457_G1, chr5:188092742..188094359, Cluster 3
aatagaaaagttgatgggagtgaaaatatggagaaaaaatgtttctatgtagatccgtctaagttcgccgcacggtgttccagccgaatcagaaacctcttttgtatttgtatggacatgcacaaagtgcgacgctttctgtgagtgcaaggagctaccagcctaccagtgccatacgccgtgtgatcactgttcagtctctgtatggtaaggaacttagccagctgactccccaacagggatcgacggccgggacgtgtccaactaagccggggctactgttttgttcggtgcggatgagctcctcgtggcgcaggaggctgctatgtggcactctacggacggagagaagcggctggaggctggatgcgtgcaagaagccgcttctgacttactttctgcgaccggtgcagttgccgcgctgggccgccggcgacggtagatgtcgcagtcctgctggtggtggcgggtggcctggtgtgatctttctggcttcttgccgttgccgatggcattcctagctactgcaatatcagctcaccagtcgtcagatattttgccgttgtccctctcaggtccagcagccacagctacgcagtagtgagatgtgataaaatttatccggcatgagttgccgccgccgctgtttacttctttatctagtcaaagctaacaaagacccattcattacggcagacatgcgttatatctgaatatattttgagatcaaagataacaccatcggagaacaggacttccgttcgttaattttaatacctttttttaaaaaccggcactgaaattaaagaaggaaccatgttaataattccagtaccgattttagctatccagagctttagtattggtatcaatgtgaagccttgggaggggcggatccaggatttttaatttcggtcttctaaatctaagtagaatgaaattttttttggacggcctaaaatctactattttgcatctataataatatatcacaatgctgatcacataatatacaccaatagcaaatatttcacataattgaacatagttcatacaattattcataatttataaaacgatcaacatacagaagtacttaatattcaaatgtaatgtgccaacatataaaatatatagaggcgaaagaggagataaacaaaattataagaaaaacttacaagctatacgataactttgtgatccttgatctgctgaaaataaattcatagccatttactcacataacaattaacaaaacaaaacgaaattcatttactgtttggatgtagatatcggagcacagaatagggaattggaatcagttttcctaaattctattgatgtagatattggagcacaaaattggggattgaaaccagctttcctaaattatgttgtttggttgcacgtggaattgagattttgaattagaggtccaattccttggaattggactataactaccccccacccacccaatacaaagtctcactcctcggtattacgtggaattagactggacaattccaaactccaattcagtgacatccaaacaatataattggaattacatctcatttcaataccatgtctggtttggtattcaacacaattcaat

SEQ ID NO: 421 - DNA, 1917 bp, Zea mays
  misc_feature (1)..(100): optimal_loci_202558_G1, chr5:188672925..188674841, Cluster 3
accgtttaaacatgtttcccgaagacgcgacacaaacaggaggccactgctcggtcacgccttttttggcgcaataagccaacaaatatgcatgcgcgcggcacggttggtggtgacaaatatccggagccctccctcgtggctcgtcccgtggtccgtctcggcgcgccctgcagcgcctcactttcggcacgcatgatccggaaacggcaccgcgcgccatgctgcatttatttaaaccaaaggtccacgccagcaggcccgccaccgccgcccggcgaccaccacatgacgatgggccggccgcccagccccacccaccaccgcacccgccaaactccccccgatcgcgacgacgcggacggactggtcgggtgatccggatggctctcccaccctcacagtcacagcccgcgggacggcgacggcgaggatcgagagggtggggccgtacttgggctgccttccgcgcgcgcgtcggacgacggacggacggacgtgatggcgcggcgcggcggagagcggggacttttccttttctccgacgtcaagctgcccacggacgcgtggacacgtgcacccgcacctgtatgtacgcgctaatcgtgtgggtccaattccaattggcatcatcaactgctagaatagcgtaggcgtagtagcagtccgtcaagtgtttgatggatcgttagttcactactactcacaagctgaagctgctgctagctagtgtagtgcgcgaaccatccggattccagaaagttccaatgcatgccgatggccgaaagaggtccttaggtaatcatctcatcacagaacacatccatccattctatcggccccggctggctatcgtggccagaaggtacagagttcaaatcgtggaacgtccgggtgcgctgcaattaatactgcataaagcaaacataacaacgaccctctacaaagtcattatacaaaatctattacctttatatgtacgtaatcggaaacacaaccctctagaaagtagtgtaataataactatattgtactcagacgatatagctaacatccctaaatgtaaaaatgtttcgaatatgtcgacgacccagcagctagcatgcatccctgaattataagaaacacgcaaagacgatagagactcgcacacgaacaaaacaacggcaactaacaagtaatgatgcttcgcttgccgccaaaacctaactccggcagacctattattacagcattccagagcaccagtaaacacaccaataatcatatcacagacgacagggaagttgttattactctactctctccatcatagtctaatctatcgtgtggcgtcctgatccagcactccggctgcgtaatcaagtacgtaccagccagtgctagctagctagtcataagccaggctcgcaggccacaattcatatactatgggtgcaaaaccactacaagctagcacgcaacgcaacgattgtacgtacgtgctaagcgtgccgctttgcgttgtttattagaacctaatagattatacatgcatcacggcaaaacataacaacgagcttatctgcatgcaagctagcaggcgcgcacagggcagcctcccctcctcctgctcgttaatttatctcggctgatgatctcactgacagggagatgagcccgaacgaacaataggatatttttggcatccgatcgggtggcgcgatccggcgcggggccgaacggattagcatgggcatggaaatgaggcgtatcatttgtttattatgattgtctggaggtgctctcatctgatgggttttttttagtgcgcttcgattattcaagtcaaccctagtgcttggggtggcagagatggcgtcaccgaacgcttaattgcaagcaaaaccaacaaaaggtttcgcaaagtcgccagac

SEQ ID NO: 422 - DNA, 3968 bp, Zea mays
  misc_feature (1)..(100): optimal_loci_203686_G1, chr5:194689571..194693538, Cluster 3
gaaaatatttatggacaaaatatataaccacggcccacggcctcaagcggtgctcgaattgacccaaccagacaatgctcgcgacatatacttatacttattacttggcgaaattagagttggtggggggggggggggggatctcgagctggttttagattttttgaaaaaaaaatggttgctttgaaatatcctgattctcctgtgaactcttttttttagcacgttatatattccaagtgcctaagaaaagaggtgggctagcacttttgaggcagaagcagaaccgtggcggtctggttgaacaggtcatgattccttttcggcctagtgggcttctaggaatctttttagcctagtgggcttctaaggccgcgtttattttgtatccaatttaggcctattgttgacgggcctcagtatatttaccttttttttgtttttcgttcgagaaatactaacgtggggaactccagtgcgcttgacatttgacgaaaaattgaacaggcctgcatttgtcaaattgggttcacgagtgttcctgggcctctagctagcagtggatcaggctttattaggaacaaagtggtatgtatgagcaccggggccggagcgatctcgtctcgttcgtcgggcctgccttcgaagatcgctgaataccacgatcttttagatatctaaacgaaagcgacagagcatgggcatgggcgtgcgtggctctaaaacctaaaccataccaccacattgatattttggacatgcatgcatgtgttctcctaagctgtacctggacgaccacatgcagtgcattacgcatcgtttctcctttggccatgttatggagctcggaaaagattggccgaaacacagtccgtagagacacccgtttcgtctgtaacgttgaacggaggagcacagagccgccgataccgacgtaacggagcaaagccgccgaaccacgccggaacggagctaccgagaaggcgtggagagcgagcgcactgcaatgatggcagctcgttcacgcaccagcgagcccgccaaacgaacacgtacttgtactggaaaaaggaaggaggcggggacggaggggggagtggacgagagtcgagggaagtgaacagtcgcccggcccagcgtgccggaacgcaacgcactacgcaccagcaacaaccggtaaaagacgcgagcgggccggcagtaggcgagctccggccagcaccgcacgccgtgcacgcggatcgtccgtgtctcgttcttcggctgcggcggctgtagtgttggggccgcccgggctgggaaatgcggaaggggtgattgggcgcgggtacgtgttgggcggccatgcatgccaccgcgcggagtggggccggggtgcgtcctgagtgggcggccggtggccgacaggagcccggcgcggggaacgaggcgaggcggggcagcggaggcaaacaggtgcggcgacgacggacggccggatgatgggctgccctgctagccatgtgatagggtggcgccgcaatcgagatgccggtgggtcgcggatatatagggtgtgacgccgacgggctgggggaaggacgaatgaggaccgcgctacccaggtcacgctcaatggagcagagcagtgcgctctccgtccgtcctcaaatagatcggatcggatccaaaatcaagatagataaagactaaaatgacgatgttgctcctgtgatacgcttcgacccatacttccgagtttcgactttcgacacacactgcggcagcaaaaacacaagacattgagctcggatgaaaacgcttggaagcgataacgatgcagcaacgcagtactaccaaacattgccccgaggaatattcagggcacccattccatccatccatccatcctccgatcgatttcggtgcggatggtccagtaggtcagtgccgcctgggcagccagcccggccaaaagaaaaaaaggcctcgccacgtccctgttgcctgctgcctttttttctctctcttttggcgcaggcagcgttcgttggtgtggtgaccagtggtccgtggaggcgtggagccactgttgtgagcaggtcgtcgcactgcgctcgaagaccgtgaggcgtgagcagtccagtgcccccactgcccacggccaaacaaaactctgaaaattccctagtatgcccacttttacgtccgaggctgccccgtgctgacaggtggtatcttcttgccgtggcatgtctctgctatcgtattcctatgcccctgtatacctggtggcagctgatctttatggtacctatcattatactattatcttatatgaggtaatatgatattttatctacttatattcttttatttttttaaaaaaaaatataggaagaatgtcctccagatcctaacaaagtaaaatcctagcgtccgaagtcactggtggcaggtgcaaggagacatggcctccactggcagaaccattcagctgggcactcttgacctcgaaaggttcagctgggcccttcgtcttcttcgacggtcgtggttaccatagcatggacaactccatgcccatcttcacttggaacaaagcttccacaattgatgttttcagctacgtcgttttcagcttccacaattgatctctttgtttaaaaaaaaaaacaccactggcttctggctacgtcgttttcagctaatctctactcatcgtttaccatgacgccgtgtatgaagcggcagcccaatcctaacgtccacgacgagcgagagatgtgcccgcccgagctgacttcgccagccagaggtccgcgtcgtgcactggaagtagccatcgatcgaacctccgctctctctctctcccggactctaggtctaggctgtagactagtgcaatccatacgctatcgtccagcgccagcggcggtccgccgtccggatcagcgagcgcggtcgtctcgtccgccccatccttctcgcggccgcagctggtctcggatgcaatcgacagccgacatgtttgagcccagccccaacttggtgcactgcacgtatacaccccctcccaacgctgattacctcatctctagggcgctgtcagtgtgactcccgcacatgtcgctcaatttgccgtgtgcggtacggcgggttgctcgtgatggacggcgatgtgccggttacggttggagggaactgcggcgcgttacgtcagcttgcggtactgtgattacgctattgctctacaaactgactaaagtgtattcctcgctataagctaaaagcgactaagagcctgtttagaagctaaaataaaaatgactaaaatttagtcacttcaaaacgaaaaaatctaaatagtaagaactaaaaacgcttaaaacgatataaaaaagtatcttttagtcacttttaaccagcttctaaggaagatctaaaatttagttgacacttggatttaaaaataaggcctaaaattgtaccttttggctgttttaattagtcgctttcagctctttttgttccgatctaagctttgctccctttgatttagttattcttgagatgcaaacaggtcctttagccaatccgagccgtactggatcgaagcgttaattaggttaaaggagtacagcggtcaatgcttgctggaaaaagaagatttgcatcgtcatgtactgtacccccgatcctttccctctttgcctttaccaaccaactagcaggacgatgatggtactggaatggttagggtatgcggaggacaatcatgaagtggcaggacgtcaaaattaagatgcgcggggagggaagggaaacctagaaatattctcttggtagcctctgatagcctcgtaggtggccaaacatatcattgtgtcactcaggagcaacagtacgtggagtactgtaaaactttggtggtccacctctctctcatatgtagacaagggaacagagagacgatatatgatgatcat

SEQ ID NO: 423 - DNA, 1949 bp, Zea mays
  misc_feature (1)..(100): optimal_loci_203850_G1, chr5:195660552..195662500, Cluster 3
tttgaaaaaagtcgttcagtctatcaagatgactatttaacctcccgagctgtgttttgcgggctcaattaccgaagtaccaaaatggtttggatcataaaaactcgtggacattactacttaaattgtttacagagacggtcataaagaatttatagcgtgtttagttggagaaataggttagtttattatcttcttactcatcatttttttatttgatttgtggaattaaatgagttagtccatcaacaccttatttcttatagttagttaatactaacatgaggaataagtttatcctaccaaaattaagaaataactcatgatgcaccatgtcatcttggataaagtgatttctcgaaccaaatatccaattacatagccaaacgatgactcaacctcaaccaccatgtagccgttaatccaaccctaggctaactccaacaataccatccatttttgaaggctcattttatcttttgtctacccaccaaaaaatatatcttctaattgtctatcattatctccgacaataatactcattcggacacccatatcaaaaaatatcattcttttgtttatatcccataaatctaggtttgctttctctctcttctcttactcacaaaatactgttttttatatgtatgtatttgctatactcttaaatatttttacatatattttatttttgattaacctgttgttaaagtatcaaaatgatataaaaagagtaaaacagtggcagacccatgatttgaatctagggtagtcgaagacaaaaaaaaattgacatataataccctgtataatttggtaccacacgtctattttccatcttctcgatacatgattagaaattaacaaaaaagtgtcatttaattcaacaaattcggttgctagttacatcgatttatttcttttagcctgtaaatgctaagaagtaatttgtttgtagaccaagttctagggtagtcggaggcctatccaaaacactgcctaggtccgctcgtggagtaaagagaacatctatatttagagaaccgagagacatcctatagtcctatatatccagagaacgttgtggaacagttatagaaaagaatcatgtctacatttttagttccacatcagacaagttaagaagtacctatcgaccaccacagtccgaaactcgggaccaaacagagtgtaaagggcatacgtggtggaactgaacgagtggaatcgtgccataggcccaagtgcgtgtaacgatgcaactagcctgcaactttatggcaggcaatcctgaccggaatccgtccgtcggccctcctgtgacgtagtaccagcggacagtggttccggtgggcgactgacgtgccaacccgaacacgtcctgctcgcgcaccaactgttcaccgaaagaaggctcgccgatggccgccccccgtacgtcctgaatcctggtcgtccgaccgccgcgttcgcgagcagccggtgagccgtggaggcgacagggcacagcaccgccgatcgcgacgggggggatttctttaattacgctggcctattccgggtccgggaaggcgagttgggcctgggcgcgtgtctagtggtgggggagcagcgccaccggtggggcggcgggggggttcaaaggcaggcaggctccacctgcgctggcgctgcggttgcgggccggtggaatggaatggatgcatgcgcgatgcgtcgcatcagcacggccggcgcacgcgcggacccggccgtgcgcggggacgtctcaggcacgcccgcggggggcgcaggttggtttggcttggctgtcttgtgtaggggcggtggaggtgggaggtgggcggtggcggcatcgtgctggcggtcgtcgatgggggcggccagccgtgacgggcggctcagtgcggcgttcatggaccacttgggacttgggaggtcgtcgcagc

SEQ ID NO: 424 - DNA, 4938 bp, Zea mays
  misc_feature (1)..(100): optimal_loci_204726_G1, chr5:200665730..200670667, Cluster 3
ctcaatcgccaaagtagagaatgatgtttttcagcctacaggccccaggtagcagctgtgtgttgcaaagcaacttgtataatacaattggacaagttcgagcttcaaataactcatataccatgcaaagcaaattggatggttttcagcccacgtaattaaatggaaatcaagttttccaacctgtcaagcactacatgattaattgaaaccttcagttctgcatgggtgccaatctggccaatagaagtgttattgcttatgcagtttgcacatgatttaaatagatgaaaacaaataacaaagtagagttagtgcttgcagtcagcttgtcccactcccatacttcctttgcacttttcctcccagcaaattagtaccagcttttacgtgtcctcatcataacaagtattgaccatgaatcaaaatacagacatcactcacagctcacagttccaggccatggttacaacctagcactaagttgaccaaggcttctaaatttagaacttttaatagcagaagtgccttgaagatgtaaagcctgcaaatatacaggagggacaatgatcagattctccaccaacataactcactagtgctttgggttaacaataatcatataaaggaaccaagttatgctgacagaaaattatttggaataataccagcaatcaaataaaagaaccaagttgtgctgacaaaagcaacataaagaccaagaaactatatgacaaaaattttgtgaatacatcattcttttgtgggcgaagagtatacgtagatattagtttatttaaaaaattaaaaaattggtttaaaatttagttaaagctcattttttgcctgagtcaaggtaatacaacacatcagtatcatatatccaaatctgtggattcaccagctcaaaggaagatagcaaagataacaacaggttagcgttgctgaattgtaaagtacagaactagctagtgttgctgaattgtaaagtccacaagcaaattgttgcagctcgccttcatgctaagaaattgacatgctgaattgttgagcatgcagctgaaacacacttagataaactaaggtatatatacatgcagcctaattaaagtactagaactactaattacttggtaatgcactacatatgtgtagaatgttcagaggaacagctagcgttgttccaacatgtgcatgaacttttaactgaaagggcatgttttatcaatctctttagacctcagtagagtttaggcagtggaaagctactaactaggagagatgtcatttattttttaactatcacttaacaggcagaattagccaaacaaaaaaaggaccatgcttttacatagacaacctgtaaagtccatgtgacagaaaatatattggatgcaaactgacttaggaactaaaaaagcttgaatctttttgtatttagatccaaagaacccctgaccatttttcaaaatggctgttaagaaaaccttgaaaattcttgtccattatatcctattgttacttgatttctgaaaccgatgtataaataatcagagcaaactttactgaaaagtggtggcacatcgaggaggagaggaagcaaccagggaaggcacggcataggaacgtgcgctgtgcacatgcgggcttattgtcttagctagaaaagtggtgtgagtcaggtcaggtcaggtcagagggggatcgatggaccgatccgattcggcaggcggaacaagtgaaggttcagtgcacggcgaggcgagtccaccggagcgactgagggaaacaaagcaaagcaaaagggacagagggatcccagaacggggcgggggtgcggacgacggaaagcgaaagcgacggcacggaggggtgggcaccattagattactggtatctggacggccgaccaggtacaggcgtacagcaacaccagccacacacaccgacccagccagcaaaaccgctcctccgcctttcggcttccagccaggttttcgtttcgcgtggttttcccctccctccgcgcggcctactaaatcaatcactcacccgccgtcgtcggggtggctggcacgcgtgcgctccaggggtgggctgggtgcatgcacccgcgcggttaagctagctctggcgcatagccgtccgcgtcaccgggagctaggcaacaaatcggaggcctctcgggcgcgcgcgtcgctgtctgccgcagccgcagcctgctgtactgtacttggcttcggcggcgacccccgcgtccaagtggttgcctgggaggccccggctccgggcatcgcgacgcgacgcgacgagacgcgtaaaagtcacccgtcgcggtctcgcatgcgcgagggaggcaggcaggcagcgaacaaaatcgcacgcgcgtcgtcgactgcctggcctggcctggtccagctgaaaaccgccccggtttgcctccgtttgcgggatctggatgggctgttttcgcgctggcgggggtcaatgcaaaacgggcgatgtgccgtgtggtgtgcgcggcgcggcgtcactttcccttaacttctcgcgctggaagaggcagctgcctgcttttgccgcagctgaaaaggaggaggaagaaaatgatcggccggattggatggcgacggcgggcggaagcggaaccttcttgcttggccgctgaccatgacacctggccccgctttgcagcccgtggaggactcttggcagcttttacgcgtgccgccggtgtgcgtgcgttgtctaggcaaggcacggcaagcagagcacgcgagggcggatgaggaattttgacactgcaaaaatcccaaatccgcaagtatgcacactcacccgcacgaccagtagcgtgactgcgtgagtactgtttagttggtcacccataggagtagcgttctatatatgaacaggagaaacaaaaatatatgcccttgttagtcgttccgaatttcaaaaaaattggaaatcagtcgcacggcctactatgctatatgcccttggtagtcggcacgacgggtatatacgggatggaaccgagccggtgcgtgatttccgtggacgtgacattgattggagtggtcatacagactgctgggactggagtcttgcatacaaacatccaagacagcatccacccgtttagtcagagtcagactcgagtacgacgaatatcgatcagacaagagccaaatccatttgggatccaacaccatagggtcattattgttttgggaccatgggaccggatcatgcgtatatactatgtgtctattattagcatgccgacgcgcgcattcggccgctagataggccctctgacagtaattaatatatgaggaggagaggaaatactttccacctatttttttctcgctatagaggatcgttgtcaaaaaaacaacctttttggttagggtttgacctctgtttatccaattcaatttgagtgaattaatttttagtgacaaatgatacatcaataagacatttatgataacttcaattttcaagatttatgaacctagccagttggatacctagataaaggtagagtgtactttcattaaggatggacatgtgttaggtgtggacccacataataatatgtatttgaaaagtacttaaagtaggaacttgtatcctaatatgtatttgacatgcacgcgtgacttggtggcctcggcgaccgagcgcggaggcaaggcatgtggcaccgatcgaagcaggcacatataactgtcgccgcgccgtatagagtcggcactgacccacccacccctgcgtcctagctagctagttgctactagctccgatcgcgatcggtagggtagggacgacgatacgatgcatggattgaccaccgtgcaaggtctgcagatgatgccatcggtctctgacgatcatctcgacacggacatccggaattgtattgggtctggtagcttctggctgccggccggctgctacttgtacggccaataatgcgtggtgagtggtctgctgcactggatctgcaggcgaggcgtctgatcatgcagcatatgcgtggtgccccggccgccacccgcgtacgttgttgcgaagccgggaggacagcacattgtacgtgcaccggccccatactacttatggacgacagaatatgcgtggcagcagaaccccatgacgcgggtgtccgctggcgagcacggggccggagagacggccgcgacgtgacgagggaacaaccaccccaacccaaccaacgcgcgtaggctcagcccggcggcggcccctgcccaggagccgggcgggctccacgtacatcgatcagttggattcgatcactgtgcagatccacgatccatgccccatctccatgcgtgtcttgtcctcttgcttgctatcaacctgacatccaagtggtgcacagcgtgaggagatcggagcggagatccgggctgtgtctgtgcgcggcatgtccgtacgcgcagtgtacgccgcagtcctgctcctgcacgcggtcacgggacgggactgagccaactcgatctgaggatgattgtttttctgggcccgcgctgcgcgccttgtgtttgttcgacgtgtttttgtgcatctacggcgccgatcgtatagtagcatgtctgaaatctgaatgcctggtgatagctcagctgcctgcctgcgccctgcggcattgcagttgcagccctgttgattctcgatttgggaacaccaagacaggcgcagatgaattgcatgtgtccgtaatatgcctgcactgcaccctgcataggttgcagtaacaaactaacaatccctggacaacgtacgcgtgacaacgtcttgaccaggagaagagcaacgcgcgccacaggcatccggccagagatgccgcaaggcctgactagcccagcggccagcgccactgcatgcattgcatccaggacc

SEQ ID NO: 425 - DNA, 1565 bp, Zea mays
  misc_feature (1)..(100): optimal_loci_205239_G1, chr5:203782603..203784167, Cluster 3
atttctttgtaagggtaccctagacttcagaagagtcgtaacctgctgagaagaacctagtatagagtagaaactgtattatgatgatcagtattcattagaaagttgtgttatcacactgataagccttttctgattttcgttgataatgtagtagtatcttgggaaagaccgaagtttttctttatctatatccttatttaatctatcagtttaaactttacaaaatccacccaaccaatcatccacacataacctcccctaattccaccaaacaaattgcactcacacataacacaccctcaaaaccaatgtttcagatcgctcgataaccatcttctctcttactcaaatctaatggtcaatgttatttagattatcctttctcccttatccctcacacttacagtaataccctacctccctctctccttgtgaccccgtcgccccctcccctcactcgtgctgccgccgccactagcctctcctcttttcatcctctttaggatcgtagtgttagcacgaccctgtagcctagtatgtttaactttatacataatgtttctaacatgtacaaaggatcatgtttttgttttccattaacatcttgctaaatactttatctgatttggtgctggagtgcgaaatatgctaacctaagctcctggaagtttgtcatcccacgtaaacactccatagtttggacttccaaaccaatatgttatagcatgctttgccattcctggggctgtagcgactgtgagtatgaattgttccctgtggcaaagtacatccacgcaccacaccacaaaaactcatcccatttcaaatgctagatgtgggcaagggtgacactcggtgactggccttttataaccgatatcctccggtcccatccaacagtaatggccattaggatgactgctacctttcaaatgaaatatgtggccaagcaacaatgtctacgcaaaacaggatttgacagcataattcatgacagaaggaagggaccaattcagaacttggacacgagagctgagcagcggaaagaagacaaacaggactcacatcgctggtcgttgcacgttgaagaatctaagcgccttgtgcagcgcctgcttgtattggtcgggcatcgacagccgcttgtgcgggacgagattgatgtggtaaggaactggcaaagtacgcaaggctggaatggggaatacccttgctcgtgcatatatgtgtggacagacgattttcggttttctaccttaaaaggccttttcagaattgttttagcgttcttttggagatgctttaaatctatatactactttttaagaatctaaggaggtgtccaccaggtgaagcctgctcccgctcgctacgcagcagcgaaggataaggaagagctttctatgctagctgtccgagttggatggagtgcatgtatgtacgtatctcaactggagaaaaggcacagtcacttggctctgccgcacacgtacacgtatgcttttgtgacatggaaattaattttttttaaatttcaatatatcttatcataacatgttcac

SEQ ID NO: 426 - DNA, 1975 bp, Zea mays
  misc_feature (1)..(100): optimal_loci_205693_G1, chr5:206160831..206162805, Cluster 3
gtcgtgtggaataagtacttggcggatcggcggtgctgtgctagcttggtgacaggtgcgtccccccgaaacgacgccatgacccatgagtaatcgatcattattttctcatcgtgatgccagtactcaatgtttctcataatgactccgctgccgatcattccgttagagctgagtatagtaacggtctctgcttacatgacatttttcttcttacgtgagacattaaaaagtagtaagagtgagctctcatacaagaacgagcaactatacgggctccaaaacaaaataatgaaatagaatagactagagaacaatataagagccaaccttatacccaactttattatatgaatatttttattattgtctatagatgacatcacagagatttagagcccactgtggacactattattaaacttgctcttatttgccaacattcattgcacgcataatgcattatcgcaacgtcacaagcacagcaagattcaactatgaacaaggttgtaagactgcctccaacggagcagctaaaagggtatgcaaagctattatagctactcatattcactgtagcggcatgcatcttccatccaacagagtagccaaacagaggagccaaattccatggcaggtgagagaaaagctattatggctgggcaggaaccgagtaggcatctctgatgtaaattggtgggcaattcctgtcagtgagcatgaggcaagctatttttactatatcattggaaagtgttgtattatagatggacagctaatgcatctacacaagccaacatactgaatgtctgcttcttttagctgccgcctgttggaggcagcctaaggagctgtttggatggagccctgccaggaacctagctggccaggcaatacacctgagaatcgtccctggccagccagacagacttgggtggggtgacaaccaaccaagccctaagagcatgctgcgtatacatgtttgcttttacaaaggagcaatataatgccttgcttgttggaaaataatagatgtcgcttctgggtgccgaaagctgaataatgcaagatttgccgcacttacgggcggctagtatcccagagtcttttagcgactagcatcattggaacagctcatcacgcgtgtatgataatcgctcttcacaatttggacccagcagtgggttgcatttgcatactactgtacaggtgccacagtgcagtcgtgagctcacatctcagtgatcgagttgggacgaaggcttgctttgcatttgcaaggcaagcgtaaaaagtcacgtgactagagtccaagatcgcctgcgtctcgccagcttgcccgtgtgcctggcgcgtttgaggaattgctgcggccgcccacgcagcggagcaggggcgccatgcgttgcgtgccgaattaaacgagagtatccggcggaggagccgcgacgcgaaatacatgcctggttactttggactgtattaacggactcacgagagagccccgctcccacgatctctatgagcgacaaactgcaattaacagttcctaatcactaaataattggtacaggctaggacttcattatatcatctcaaaaaaatattaatcgctcgataatattctctatagaatattcttaatactttcttgatcaactatcttccgctgggatctacagttccccactactattcatcataactattattattatcagaatttctgatcagttaccatctacaaatcaccaatgttcatcataattatcgctattataattcctccgaaaacaccgtggagaaaactagagaacacttcaatatatcaggataaaaccttgattaaaaaaacccaatggaaaaataaaggagaaaacgccatggtaataacctgatatcgttttatttagacccatgcataaaacttaccatcttcgtttatatagtaacaataaaataagatattagacac

SEQ ID NO: 427 - DNA, 3729 bp, Zea mays
  misc_feature (1)..(100): optimal_loci_205775_G1, chr5:206601378..206605106, Cluster 3
agctactgcgcctctctagcgttgcaataacaattccaatagattcatatgtcatgcctcgtctcatctcttgcagtaaggcatgacttgcaaccccggcgagccaaattggattgtccaaggtagcaatgaaaaaacttatcacactattcccaaattgccttgcatggagttcttgcttctaggtccccttgtcccttaattgatgaacagaacaaaccaggcttggtaccaaattggatccattaggccttttcagttaatgagattaaatctcaccatggatttaatccggatctgaattgattgaatccatacttcacatctaatctcaaggtgtaattaaatctatcatttaatccatgtatctatcaaaacttgttattttttatttatggattctaatataaacttgtacaatatttttatagatttgttccatatctaatgagctatgaatataattcaagccttctatagtttaaaatttttctaaactattgggttataatctatgataggtttaactgaataaaaaattaagtagacttagattattttgaagcatgattgtgacatggatttaaatccaatacatactaatttagagctggattagtgacctagcagacacgttcgatggggcgttccaaaggccaaaggtactggatccatttggacgaacttttgctttatagagacagtagagcagtcaacaacaaggacgatcccgctccaatcccagcgtcgtcgggtgcaatgtgcatgtactcctgcaagcatgtccttgcaccaggacgccagccagacgggtacgccagcgattccgttccggcgacgagagtgagcgacgtgatcggacaaaagggaacgcgacggagattcggagtcggagcctcggaggggacttttacagagagggggaaccagcgaggaggagatgccgctgtcagaggctcgtgatggtgtgcctggaaggaggaacaagaggagaccgggagatgggtagcccgtgagagcactcatcatggccggaacctcgacggcgaaaaagggaggaaagcgacgcagcgagaaagacgatcgacgatgcgtcggcccgtgctagcaagctctttctcttccctttcaccgttcagtaccgctagctgctgtaactcgcccgaaacgacgtacgacgcggcttttcgagcctgggtctggggtgtaggttggcacgaggcttttgcccgcccggcgccgggcatggctgtacctgcactgcacatgcccgccttcctccggccggcgacccccggcccgtttcccttcccgcaaaaggcatcggggcaccaaaggctccgtccggcaccaggggccgcgttccgcgctggctcacgctagtcctcctcgttagcgagggccggccgggggaccgaggtcgcgcgccaacctggccggccggtgccacgctatgtcacgcacagcaggcagcgcgcggaggctgctcggcgcggtccctgacccatccgatccatctgtgtctatcacaggacgcggagggaggggctacccctgtctgtccggtacggcatctgatccgacgacgggatgtggtgtgcgctgaacgatggcggccccccccccccccccccccctgacacggacccgggagcgcacagtgacatgtcacggtcgtgccatgccgcggtgcccgtttgctcgtgtcagtttccacggggccggcaggcgtaactgtgggcgagcagtgggtgaactggcactccacgcatggcggcttctgaaatgcccgatcgctggggccggccggccggccggacgatcgtcgaggtacgtgagtgaacgagagacgacgaaaaagacgtgagccggcctgctgcctccttatcttctctcattgaaacaaggcaagagctagtgtccgcgaaaacgtcgccccctaacctactgtgttcctgtagatgtcaaggaaaataagcattgtgagatcgttcgtccggacgtgcttgacgtctattccaggcaattatgcgacgcgcgatcacacacccggatccggtacgtgtttccacggcacgatcaccgtcgtcctcccgctcccgcccatggtctcgcggccgcggcgggcaggcatcagtcagccagggcccgaccgtcccagaacgagaaggtacgctaggcgacagcggccgctagcatctgccgcggccatggacgagaacgcgagcgctcgtggatgaccgaggcccccatatgcctccccctatcggtggcgcccaccgtcactgcagcacagcgagagccgcacggcgaggcgccacaggcttgcaggccttgcgaacgccactgctgctccgtttcggctttcagcagagagcgtgacggacgggagccggtcggggcgaggacgccactgcactgctctgctactcgtcctcgggctcacacgacgcgacgcggcgagagcaacggtgaaagcgagcatgtgcagcaagcattgaccacagaacgtacagctccgcgccgtacgccacagccacacgagtgtgaatacctggagtaaccccgcgtcagtttcacctcccgtctccatccccaggtacaggacccgtcgcatccccatgccagcctttgtcgccgctacttgcgctgcgcccctgcatcagcgcccgccatggtcctcggccaggcctccccggggtcccgcgcgtgatggctcaacgaacgacgacgcgagagcgctggctgcttccgcctggcccatggccatggcgttctaacccgaccacccgcccgcaatcaataagcactttgagctagctagacggggagaggtccttgagcatgcaaaccggctaacacacgtttcgttccagcagcaggctaagcgaacgaatgcgaacccatgtacagtacagtaccatccaggagcgcccccgacagcgtattgtacgccgccgcacggagcgtgcgtgcagaggccggcgccttgaaggctttccgccttccggaagtgggcgcgcctgtcccgctgtacgtgtgcgccgcgtcgccgtcgtcgggcgccgcacgcgtccacgcagattttaatgccccgaaagcgagcggcgagccccttgacccttccccccgtcccaggcgtaccgccacgcgaggtgctccgtcgcgcggtcagtgccagccaccgcaccgcacggtcgacagcaacagcgagcgggccgccccggcatgcacgaggggacccctgccgatgccgagtgaggtgaaccgagcatgcagtgtgcggccgtgctggggaccgcgagcacagcctgagcctgagccatgcacgtacggcgccacggcgggggagtaatggctgggctctgcctctcggatcggatcacttttattactactgatgatcaggtgaaccgcggccactgcctgccgagaataactaggcaatcaatcaagaatcaacgcgcgcgagcaccttcgccctctgatctgtgtcccccgtggtggccgtgcgtgcgcgtccttgggtgtgctacaagacaaaggcgatacaggcatacagcagcagcagctgggtgggtggagcctctggcgagacaggatgagggcatggcgctgcgcgcggtgggcttcggtgttcgccacgacggaggcacgcccacgacgaaaacccgtataatataattcgtctacggcacctgaataggacgggtgtatgcaggtgacact

SEQ ID NO: 428 - DNA, 1480 bp, Zea mays
  misc_feature (1)..(100): optimal_loci_206243_G1, chr5:208998833..209000312, Cluster 3
ttccggcgagtcgcctggtgctggtggggatccgatggataggggaaatcgatgcggacgacgagctagggtttgattctaatgataggtttttttacctatgtcattactattttaaaattttgttacaattcgcctatatgaaaaactgacatataattgtatccactgtcacgcacgctgcagtccgcggcgcgccgcgcagcgacgcctgccgtgatggcgcagtccggcgtcatgaccattccttgcgcggcgttgccgtccgggaataaatctcaccatcgatttaatccggatctgaattaggtgaatccatatgtcacactcaatctcatgattaaatccatcatttaattcatgtatctctcaaaactagttattcttttgatccatggattctaatataaacttgtgcaacatcttcatagatttgttccatacataatgagctatggatagaatccatgctttccatagtttaaaaaattctcaaacccttgggttataattcatgatgggtttaaccgaatacaaaaatttgagtaggcttggattgttttggggtatggattgtgtcatggatttaattccaatccatgctaattcagaactagattggtgtaaacgaacaagatgaggtgttcctgggacctcttcttcctgtcgattcattctttcaatcccgccctccaaatgacactgtttaccacaagtaaacacgcggtgacacagaaagcaggagccgatccgccgaaacctgacaagattccgaggccacgggcaggcacgccggcagcggcgccgcttgtgacgcatggcaaggtccaaacacaccattgaattccgctggctccatgtgtaccgtaccgggccggagcctggacctgccaatggtgtgtgctgtggtgtggtcaccagcaggcagcagattcactttagacaggacgtccgcgcgcggcgacccacaattcacgctgcaggggacgggggacagcagagacgccacaccgcaatgtctacactacaccgaactgaactcattggctcatgtagtcatctgatgattcttgctgatcatgctcttgtatacagtaatagcccattttccacggactgcattgccctgacttaattgctctgaaggtgttgttagcgagcagttgccaaggccgagcggtgccggttagcgagcactggccaggcgggggcgaggcgatcgatcgagatccggggcgacaagtcaatgtgcagcgctcgattggctttggtagggtgcgacaagggaatgcatgcagatggtactacgaaccaggcatgggcgaggacgcgaggtgaccagaggtccagcccagccacggaggcactgccactactggctgctcgccttccctgccggtgccggcaatgcgatgcgatgcgaggtccacgaactgaaacagtacactacatttggaacaaacaaaccttcggtaaaaca

SEQ ID NO: 429 - DNA, 1915 bp, Zea mays
  misc_feature (1)..(100): optimal_loci_206245_G1, chr5:209000976..209002890, Cluster 3
atatctaacattttacactttcagggggcataggctggaatggttctgaattagagatcaaataagagtaagcacttcttcttgcacctgctcaagatgttttccacttcatagtgccgttacgaaatgtgtcaaccggagattagacaaaatattccgtcttgcatgcatgtctgcaaccaataaaacaaaggtgccctgttacatctatgttgttttatatcaggtcaaaacagatgattatgcctatttattctaataggattgcatctgtgtgtaccagatcgtttgttagagtacttcacttaactgacactgaaatataaaaagtttcccaaatcagtactttgtttttattgaatgttcgcttctattgattctctttcttttagtcacttcttttactctaaattaaaatttaccaatagctagaacaaatactattttagtacagagtacgatttttttttgttcttttgcttccctttttcttgttatgctctattcttagctgtaggtcctcccttttcctattgacgaatacaaaaggatgggttgcattttatgctcgttgtcgtctcttcataatgtacctatgatttgcttagctctgatgtgctcttttttgggttttatattttggtgcatggtttatgccagtggttatttactgaacatatgttcatgcggcgcttcataaaattccatatttgcagaggatgcagtgcatttctgtctggcctagtcaggtctggtgttcagcggttgccacacctaggtgatcagatggattgcatatccaaaaaaaagcttcagaactcaacttcgttggctgatccatatagaacaatgctacctggtgccacagcgttacgatcttattaattatgttatttggttaaggacttgaggtacaataaaaaaaaaggccttattgtttgtcatgttaatttgcttctttcattcagatatagaattggttgcctaatctagatctaatattttagtctaccactgcttgcttatggcatcctctatttcttttgtttccttgcccatccatgtaaagtctgatgaagcgtttcaatcaatatggaatttatttggctatgtacgtgtcagtctacggtgaaacggagacaccaaatgttgattcagctctgccaactattcttgtatgagcttctataagttttttttttgtttatttccttgcctatccatgtagaggtctaacgatctatgcagctatccgattaactgcgggaattgacaaccagttggaccatgggaatttgcaaggatgtggttgcatctattctgatcggtgtttgaatccaagatgttgtaatcgctgcactttttatgcaatgtttccatgctgtgccattgccaagtgaagtgattttatatcatttatagcaaacacatacaagcctggtgtagctaagtagctaactatggagtcattttattagctgccgttcaggttttgcaaatgccttgcgtttagtcgagagattgatgtaacaggatactttattggcctatagaaagcgggaacttaacacgtgctaatcctaattccaaaccgttctctggctgagacgttgaaatgccacattttattacatgaaagtgatatatgatgtaaagaatgagtgagtggctagatggtttgtacacagaccagaccaccctgtcaacatcacaaaccgttctctggctgagacgttgaaatgccacatctttattccatgaaagtgatatatgatgttaagaatgagtgagtggctagatggtttgttatcccatgagagagagatcacgccggtctgacgacccattgttttttttagcttattgcctttgctgctgcaacagagtgacaacatggaacaagatggctgtctgt

SEQ ID NO: 430 - DNA, 1531 bp, Zea mays
  misc_feature (1)..(100): optimal_loci_206511_G1, chr5:210494928..210496458, Cluster 3
tcatcatctagacgatccaatccaacagcaacagcggccgtgctggttgctgttgcgccagcgcctagaaacaactgtgcgtggggtaggggacgacgataggtggaggtaggtccgggtccggggcggacgaggcggccacagaatctgcggagctgcctgcctcgcttttgcgctgagggcgacggagccacacgcgacgacgacgacgacgacgacccggtgggcccgatgctctggcccaagggccaaggggggagccaccgtccacatctgcggtgggagcaaagcaattattattcccttcaaatcaaaggctacatacatctcctgctcctcgctattgcccatcaggctctcgaaagattgcttgggatttgggaatttccaagcatccatggcttggctcctccgcgcgtggacacgtgatcgcaaacattttacaaataagtcctcagctgtttttttttgtaataaagtcctagtccgacccaaccacgttcaaaagtttttcataaagattattactaggattctcatttcaacgcgaagaagagatatcctagatttttttttgcgcaggaccattgctgacaaatttatctactttagaatttttccatccaccgttgctgacaaaataaatcacacttttcccttatcgcgggtgcatgtgcatccactgatccacgagatcgggtacagcaattactatattgcacttgaatatataaccatgactggaatatttctaagggtagtatatacgtacagtatagtacatggcatggtcccttaaacgcgatctgtgaattgttcatatgtaatgtatcatgcggaacacgagactatgagagaataattaagctttatgctgttatagactagatgtgaacttgccaattcaatatcaccatgtgaggtaatcggtgaatttgttctttcgaaaaagacctagtattgatccatgcgccgccacacttaattgcgaggctttgctaatttactgccaatatatattaccatatatcagctaattggttttaatttgttctcgcgaaaaaaaatgattgtccatgttagtttttactttgattgttctctatctctactatattaaagcatcagttaaaacggtcgtctcgcgttaatatttaaaaaaaaactatattttttagaatcgtcccacgcttctatactatcttctctactgctataacatgataatttatataaaaaaataaggtgaaattatgtataagtgagtgtttgaatattggttgttggtttcacattcacacgcacataaacaataaaaaacatatattttgtgcttcattagaacaaaatttatcatatgtcgtatatataaaaatcggaacaaatacacggacatatgacaaatttatctactttagaattttccatccaccgctgctgacaaaataaatcacactgtttccttttcgcgggtgcattgcatccacgagagcggctacagcaattactatattgcacttgaatataagat

SEQ ID NO: 431 - DNA, 1595 bp, Zea mays
  misc_feature (1)..(100): optimal_loci_206875_G1, chr5:212157522..212159116, Cluster 3
tcccggcctccgtctccggccacgacgacgacgtcatgccgccgagccggacgctgctgcggcgcaatggccgaagcgagccgaatagttaagctgctgcttagttctgctgccgacgcctcctagtcgtcctacgtcgatcacggcgggcatgatgaatctcggtgggctcggatacttatacgccacgccgagcgaggtcgagcgctgcgcgttgacccgaggttcaactcgagaatggcgcgtcggacggcgacgtgctgttgatgccagccacatggcaggcggtcctgcacaccagggccaggccgagttgggagcgcgtccgctagctgggcctgggcgagccccggtggggccactcccgttggtggtgttggggggatggatgacgacgatgggtacggtactacactactacggcggtctcttctgctatctgccaatttccccaactttctagtttgtttgttttatgctcttaataactgcgcatgattgatcgcgtcgatgtcctctccttgtctggttgctgatatttatttacacgcatcaaatcattaccacacagcatatgtaagtaatttttttttctcatttcttcttgacaagccttttttaataagaaaaaaaatgaccatcggcatcaatacctagtgaataaggttatatcgataacatataaggttagtgttagagctcggtttctcacaaatgatttccaatgaccatctctaactaaggtcatttgggatagggcatcagttctattccacgaattctacctatattcatttcatttctacctgaaattctatctgtatctattttatttccgcctgaaattctatgtatatccatttcatttccacccctagggaggatgatagttcaaacgtgaaggaagtaaatcagagaaacaacattttctttactgatccaacatcatgttgtaaaaagaaggtatgtttctctggtttatgatttgaataactaaccaaacatccagtatcagttggaggccgtgcaacgctgggctaaatagtgggtaaacgcctgcttggacttgcgatactctgtgataagctttgagacatgtatggtatcttcgaataatttgcgaggatctaaaaatggcagtttcaccctaggataaattcaaggacgtaaaactttgaaatacagagacgtgaacgacgccccgggagacgtttaaagacctcaggtatattttaatagaaagaccacctgctaggacttcttttgtttctatgaaaaacaaaatctagtctttgccaaacaggtgtacttaataggtcaccgtggaaagcaggtatgtaatccttttttcattcaaataaatacaatgtttcatactaagagcccgatcccgtttagcattgtttcggctctgacttttctatgaatacaagttagagccctaacaaacaccttttttaaaacgtcttgaggcgaaaaacacctaaaagccagagctatttctgtaccacggagaaaaagccacaaatggtagcttcatcagctatggcttgaacactggcattttaataatgggaaacgactctgactcttgg

SEQ ID NO: 432 - DNA, 1628 bp, Zea mays
  misc_feature (1)..(100): optimal_loci_207532_G1, chr5:215225947..215227574, Cluster 3
taagtctggtcatgtgtcttgatatgttacctcttatttcatttcgtgagaagggattgtttttcgttccttgaattgtattgaattgtacttgacggtaatcatgaataaatgttttgacatagttgttcaactttttataatgtttgttcaataccagttcattctatgagtcagtatatttataacaatattacatatttatattgtcaatataatattagtgttacagtgatattttatcacacagattttgtataacatagtgatgtttttttgttctattatatatgttttatagtattttttaacttccgtggcaacgcacgggcacacacttataataatatgattcgatgaagggacatatctgtaactcaacttcaaacaagcctcattttaaaaggacgctgtaatcaggagccgtcgctagtcgctaataatctttgcttcgcatgcatcatcagcttcaggccagggagcggctgttaattaatcattatttttacttcctctgtgtctctgtcttcgatctgtaaaagaaacatagagagagagagagagagaaaaaagttcgttccgctgctgtatacaatacaatacaatacaaacagctcgctcgcagaagcgacggttgacgtggaacagtcaagtgcacccacctttctcgtcgtaagcagctcagccgtggccactcttcttgagtggccgcccgtgacacacagagaccagtgaccacgatgaatgcatggatggacgcatgcacgtgccggctcccgcggtttcaggctccataatggccggtcgacgacggacgatgcatgcctacatgcatgcatactcaccgccaagtcaggtgagtgatctgatctctcagtgtcaaggtccgggacgtggacgtccgtccacatcggctccagatccgcgtggcccggagaatgagacggcccgtcggtttcagctagccccggtagagtacatatgggtcggcgactagccgagatttcggcgggggggaaatgaaacgtactagaaagctgagatggcgccgcaagaaaagtgtgcgtccctctagttgcgtttcgcaagtggcacacatatatatggcgaggtgcgtcgtcaacgtcttcctctagttgcttcgcaagtggcacacatatacatgtagtcacggtacatgtatgataacaatgtttcttaaattcgtaagtcacggtacttatcctacaattgctacaacattgtagctttggattagctaaaaatttggaaaaattcgtaaaacacggtaatatacagtactatagttttcgtcaactctaaaaatactagatattgttagatacaacattgtaaacgacggtattttaacaaaggctaaccataacataaaaactttagattaaactagaattttcaatactctaaaaatatcatggtatctagagacaataaaaatacttttacttctaaatatgcccatctgacctgagaacgaacaaaaagaggattacgtctagagttggccagaccgactccctaatacggcaagattggatagttggccaaaccgccttttttgacatggtcagcatggctttctctgtcaggctagctacatgacagct

SEQ ID NO: 433 - DNA, 1580 bp, Zea mays
  misc_feature (1)..(100): optimal_loci_20910_G1, chr1:119668174..119669753, Cluster 3
tcactctaaacaatatttgtttaaaaacaaaatatctcaaaccataatatttagtacacatgtgcaggacgctagtaataaacaaaaactttagattagagtgaaaattcaaatacttaaaaccctaaaaaaatactttgctaactccgccaaattcacctggaccttttttttttgcggatgacttccaactcatcagtttcacggcgtgcagtctggatgctaacctagaggggacaggtacccacacctcctaataataatgatgggaaggaagggcggcagcagagctaaagaatctaggcccctcagctccacgttatcgaatgaaaaccctattccaggcatgctcgctagcacacatctatcgcaagggaagtcggaacgtgctcatgtcctccactcgatcctgttgttacgcaacgactagctagagactggccggctctgtttgattgagctagcttctttcaattcgtacggttcgtacaccaagtatggttttgttcatgcatcataacctcaggtcattgcaaacctgaagaattataaacctgaagaatgaagatggtagacgatgtagtatgtacgtactactagtgagtgagagtgactatgggacaggctgcttggtcgttggtcagtagtactagtgaaggtggcattggaatgctgcatcaatgtggtacctactctgagggtgccagactatccaaacaagaagaaagagagggagcattggagcgagggccggaggtcacggagagcagagaaccgcatcattgcgttctgtggcgagcgtgttattatcagcttttgagaagcgcaatgccattttctttgttttttttaactttctttcttgggcttgtatcgagcgcggcctgcctccgcatccatccaatgaatgatccatggccatttgccatccaaactccaaaggcacttttggctgccacgcacgcacgcacagctagctcgtcactggcaccgggcccggaggcaagtctgcgtgggccctcttgctgaccacagaggggatggggcccaggcgtcagcgttggagggtccacagtacgtagtccaagggaacggcgaacgagcgacgacgaccccggcgcggcggcatcctgcacagcactagccagccagccgcctagggcgggggacattccttcgctgcgctcgccacagtgtctccgctttccccgctctcttttggccctttcgatgcaaatgcttggagcaagtagaatttgttgttcctcgagcctacacagcagaatatttagcggccgcaaccacagcacgctgcaacttgcccatttttataggactgccacgaacagattattactaccagttgcttcttgcaaacgatttcagcttttctatggcgaagtgatttaccgttttgttgttgttgttgcgatatactagttactatgtaattaacactactgcatgcacagacgattttttacgatcacatgccacctttcagatcaattgcacgctcacatgccaattaaacacattatacaaataaggatactttaaaataggtatgtatatgagat

SEQ ID NO: 434 - DNA, 1945 bp, Zea mays
  misc_feature (1)..(100): optimal_loci_214065_G1, chr6:38389159..38391103, Cluster 3
tgcaaccaatcagtttaccaactaaaacaattcaagggcattgtcagcatgctgcacaagctcgtacatatcaaccatagagcaattgtctagtcaagtctcctccatgaagaacatctctaccttcatctcatcaaacaccctcatgtctgtagtggacaagtgaatcacatcataatcccaacaggcgaatctaggatttaaagttagggtggtccaatcttataaaaatcaataaataaatgagtttgaatttaagtcctacaatatatgagaatcaaaataagcacataaatcaaaataatctatatacttttagcaggatcaaaaatcagagggtgggcccatcctgtccaccctctagatctgccaatgcagccaaagcattaaagataatgaattgatgtaagtttttgtttgtgggttcatttttctaaacaaaaacatgaacaaaaaagtgtgggaaataagatcaagtaaacaaagattggagcagactgttcttgcatataatgcatgaagcaaataatcagttctgaagattgcacagcctgaaagggaactgaatgaaacaaaaactggatcactgacccataacactttccatttcggtgcctccaaaacctcttccaatataatgcacacatcagtattagccctctaagtgttgtcctgacctatagtggagtcttcattttctgcagaaaaaggtacttgttacactaaaattcttcaaaaaacatataccggcaaatgaaggggccaagagccgctatcggtttttttctttcttggtagcattatgtgccactttcctcttctttgtcagtgtgcccttattatccacctcaatcacacggacaactatgataccaccaacctctggcttgtatttgagaaagggtcaaagagaacaaattgtgggaagttttttgtttgtgagttcatttttctaaacaaaaacatgaaaaaataagtgtgggaaataagataaagtaaaccaatattggagcagactattcttgccaaatagattggagcatacatttcttcaatataatgcatgaagcaaataattagttctgaagattgcaaagcctgaaagggaactaaatgaaacaaaaacgagaacactgacacataacactttccattttagtgcctccttcaaaacctcttttaatataatgcccacatcagtattagccttccaagtgttgtctggacctacaatgaagtcttcattttctgtaggaaaaaaaggtacctgttacactaaaattctttcaaaaaacatataccacctgcaaatgaaggggccaagagccactaccgatttcttttcctttcttcgtagcattatgtgccactttcctcttctttgtcagtgtgcccttaatatttgtgttaacattaacaccatttgttctcactgcctggtaaacacacctctttgcaagctcaaatatctatggcttggatcagcaagtatccaaattgatcagacaccttctgatactctcaatgtgtcaaggtacttcaagtatgtaacaacgtcgtacctacaggcctgtaaagaaacatataaccaaacctaagttttgtaggccgtaataccaacctaccactaaattcagtataacaatttctcaacttaattcactagatttgtccgattggtaaaaatctagggaccgaaatccatcactattttgagaggaatagataagcaagtggggaggaatacaacaactctgaagacgggtggggcggttgcagatccgaagataggtgggggaagaaggggcaacaccgtactaatctgagccaccaccgccgctgctagctagaatggagcacttcttccccaagagctcgtcgaggttcatctgctgctgcctacactccaagctacagaaggccatctcacccatgtagatggtgt

SEQ ID NO: 435 - DNA, 2238 bp, Zea mays
  misc_feature (1)..(100): optimal_loci_224816_G1, chr6:107864963..107867200, Cluster 3
tgtggaattattttgtagggggtacctatcccgtcttatatagacaacgagattaggttttacaagctgagacttatcactacatctaaacatacaaagttttatgccaatctaaggacgtcgctacatgcatggtgattctattctgactcataggcgacataaatctccaagtcgacttcatcgaaaatggttgttacgatgtcttcacgcttcaagaaaactccctgccatctttgggtatgagttagccggctatcctatggacttaatccttcggcccactcaaagcctctaatggcccatgaactcaacccatgcagtgaggccctaggggatatctatctcccacaccacatggtgcttagggcatctagtatgggtggtgtaggcacctgcaatgccactgaaactcccaagacattagtttgagcgtcaacagggcttccataaatgtgggatggggtgcccataaatggaggagaaggcaggcattcagtctggccccacctaccatatggaaccctctctccctcggtctataaaagggagggggaggactccctatagagacagataacttgagttaatcccactcatacaaccccaatcaatcttaggcaggcaacctgagggacaacagtcgccaactcaggcaactagacgcattcatactcttaggctctagatagccaactataataggacttagccattctcttgaatccaattcacaaaaggagaatgtaaggtgttatgtatgcaacagtggcccaaacctttgagaaacccctagttccctagcagtgttgggagggttgttgttgccatcttccaacaatcgggccatgcctttatcgtgaaaggtattagagtactccaagaaccccttgtcaatcctctatggaggtatcatccttttttcctcgactatcaaacactgacatcgtcgatcgtggtagatcttatggcaactatgggttatgcacaaggagaagagatctttttggggacctctattgccgatgaggttgagagtctcaagcttgccttagaaaccctagcaattttggtgtccttcacctaagattctatagattcaatttgcacttcggcttagactctgcctagacactgaccaagattcatgtgaagctccaacttgaattacaacacctagtcaggcctagactcccattactcgggagatcggttcgtgttcatggtgtactctgagtattaggatggtcaatcctctaaccatgataatgacaacaatgaccattcggtgagaagacgacgacaccaagaagagttgcattgttgtggtcaagatactcatgaccagatctagatagtcgacttccaaggcgaacatgtttacgccatgccaatgcaaaacatcatgatgacgaagctcctgatggatagaatcacaccaccacccccgcagggcaacacatagggtcatgatgacctgccaaagatacataacatgatggcatatgcgacagtgtgctcatatatgctaccaagttattagatgatccaacctaggatgaactggtgcacactcacaaaaactagagtcatcgataggacagatcatgccctcatcgagaggggactcgaccaccatcttagtacaataggactcaaactcctcctcgtggaacagatcatcatgctgagttagatcgatgccatctaccccaagctaaagacatcagcaaatgtacaattcatgacaatgatggatacgaggtgaagcatgacgactcctactatgaggtccttgtatgaggccggctaggtcaggttccaagttatctctcagcctctattatcaaatctttcataggtccactaagctaagtcagctggcctaagaatttcaagccttctttgatcaagtaatacaatggtcgctctaacccattgaattgtatcgaggtttatcaaatctagaggagatatcttagccatggaaaattacttgccaatgtgtcttggtcccaacatcaggaagtggctattgggcctcctagccaactacattgattcatgggatgatctgaagcatatgttcattactaacttcaacatgaccgttgagctagggaatacataatcaatatgacctcgagcaagtcatatagaaggaagatgaaatcttgtgcaactacatcaagtgttggcgcaaagtcaaggtcgatgcttagagcatgtcggaggaaa

SEQ ID NO: 436 - DNA, 1465 bp, Zea mays
  misc_feature (1)..(100): optimal_loci_225348_G1, chr6:110273673..110275137, Cluster 3
cagtaaaaactaaatataattattttgtggcagtggtatagaaaattctggagtaggcctcattcggtttgaaatgctttagtgtagttcgcagatggaagcatagccccgaattccagttatattagaacatcactgattgattatttagagtgtccaaattgataagctaagagaaacacaaagaatattaaaactagtgctgcatggacatctaatatggcccaaagatgagctggctgataagtttggcacacttgcatgtatgactgtcatctgtgtggtggactgagcttcaatgtggacatgtacatggaattagaattttatactaaatgattgtgagtttatttccttttaatgattatgacattttccatcctaaggcctaagggcatactcgtgcctttgtctcttgtatgctttattttctttgtttgtggtttctcctaatatggcttctggtaggaaccaccgaactacatcgtgttcttgagtatttagcatgcttgtagccttgtacttgatgtctctgtttagttatttattcacaaaacgtggagaaatcttgcatgtattagcaacagcaaagaagtggtaaagaaagtgtatatcaggtggttgttgcaacttctttaagtatgtaaccggtaggtgtgaaaaatcgtatagatcctacaaaacttgcaatatgcactttattattgtttatttgtttatgcatttgtttttttactttcatgtttttaacgaactagaagggcattggtttcttttcacaccatgcaatttagtaagggtcccctcacctcatcatatcatttggaaacatagtttgttcatcttttctgatttgtcatgcattcttattacacagcaggatgtagataatgttaagttgtgaacctcttattttgaaagtgtgcggtgatgctttttgttgaatacgactaagatttgtgtctttttagggctggtttggctccttggaattgaatcagtttctatgaatcagattctaggaattgattcgtctaaaattgtaccagctggaaacggattcatttcattattcttgtttgggtgcaaacataactgaatttctggaattaaaatcaaaatcttgtctggctaacttggatcaagaattgagcccagattatctaaccagcacaatatatgagacacacgcagcacatacagacccatatagaacacaaagatcacaatatatgtatataatcacttaatcagcacaatatatgaggcccaatcaacacaatatatgtttagacatctaataatcaaattaaaacaagtacatcagtgagaggtaggcacaagcacgaacacgatatatgaaccaaacaacacgtgctgattacacatcaaaattaaaaccattaaccatttggtaagaaacacatattactctaatcacttcttaactgcttcagtagccacc

SEQ ID NO: 437 - DNA, 2022 bp, Zea mays
  misc_feature (1)..(100): optimal_loci_225529_G1, chr6:111199112..111201133, Cluster 3
gtctgactaggtagtgtttggttttagagtacgatgggatactgggattgagctattttgctcctaacttgttgtttggattggttctatgtatgatagagtgtgtttaaaaaaacaaaattatgcttaaatgttaagccatctagcttctaaaaaatcttccggatgaaacccctctattccaacttatttcggaaccaaacactacctaaagatatgttcagttgtccagaaatagacctggaattatttcggcctaacggatcacagtgttaacggatatggcccggtacaatgcccataccgttcgccttccggcgctatcagaagaaaaaatctccaccatagctgtccgaagacgctcgccgtcgctgtcctagttgcttcgccgtccaccctgtcgcggggagtatttgttctgcatgacgacgtcctcgtcgatccagattgcaaaacgtgtgcgcaccgccgttccctgacggctcgtcgtcacggtttcattgagcctctttctcatgctcatcttctgagcgacctgactagtgactacctgagttcatgagcgctagtttatagccctggaactagcacgatgtcttggtcattctgctcaggatcgcagcatcggcttcgtgtttcattactatgcattgttcgtttacattaattcagctcttattaattcagatggattaaatccatgctcttaaatcctgcggctacagtacagtaccacctccatgccagcaacgaagaggttagaagttaagatcaaaaaaatatgcatgctctaaatcaatttaggcaccacagctaccattttagacaataacaattgacaagataatatcaatatactaggaatcagattttctttgattattttagtttctcactgtcaggaatcgaacaggaagctgatttttctaagttatttttaaatagtgtttggttcgtgagtatggtgggacggagtagtttccatataggatagagtagtttgatttggttcattatgccctatgcctacacccgtgtagagctcaagaacaaaggcacattctaagttcttgtttctgcttctcacttccatgaatgacatacgaatctcgtagttttctcatggtttgaggcacatgtttagccgcacttgcagttcatcaattgtccagtttgtacttaacgggcatccagcaagttcccgtaccaaggcaggcatcatggataggattaaaaaaaggcatggtggatatatttcttccgattatatacttaagacttgtttgagaagctcaataccgggataaatccagccttttcccgtggagaaatcccatgtggatgtcagctcatgaaagtttcttggccggtttggaagacactcttccgggctagctctcccccaacccgaccaataacccaagtaatctatgtctcgacaccggagaccagacaactttcccctcggacgagggagagacgacgcgagcacaccgtgccctccacatcgtgtgcgcgtcaccttctgttgtgccgccatctgctccgtcgtcgaccactccacaattgtccgctcggccgtcactggctttccccgacgtggcctcgagtaggacgtgagtcggccacgccctctattgtagtccatgtccactggtttgccgtcctccaccgccatgtcatcccctagttcattgtcctgcgtcgtcgttcacgacttcacggcacgaggtaaggccttcaccctgtcgttcatttttatattatattgtatatctgtacgtgtgaatggagatgatgatattatgtgatgtgatgatggatggattagcttcattggatattagatggtatttaaattgaactttacgtgaatcatatgtgcttcatattttttcgatttttattgatgttttattgtttatgagttttgtaaagaaatatttttctttgattttttctgaattttaatgtatttttgttcagaggggcatttagcccattgcttcccaaacaatgtca

SEQ ID NO: 438 - DNA, 2205 bp, Zea mays
  misc_feature (1)..(100): optimal_loci_229013_G1, chr6:129907017..129909221, Cluster 3
agtgtgtctacagcacaaaaaagtaatttacacgtccatatagcctcattggtaagaatagccttagaaccaagacacacgccctgtctttctctcggagaaaaaatgcagacctgcacctggatgtgtaaatctgaatcctggagtgaaactgtgcagccactgcgctgcacttcattgtttgagtaccatgaaatttgattttgatgcagaagctagctaagccagcagggagcatgcatcagactcgacaagggctgagcctatgcatggcagtgatttccttgttgggaactgcgaagggcgacgaagagaactgggcattcagatttcagaggctgacgaacgtttgcaggccccccggaggcacactatttcggccaggatttcctttttcaccaactggtctcgtcttggttgttgcaaagtctatatactgtactgcttcgtactatgccttctgctgtgcataagcagggaattctctttgggttggggtccctagctcgtccgggacaatcggcagctgtgtatgcgcatcagcagcaaagctattcagcaggagatgctgtcgtggaagtggaactgtgtgtgaatgttttcatccaagtttggatatatagtgatttaacgtatttcgtagaggtatagtattttaatgtcctggcagtggcactcctggagcttcactggttgggcatctcctacagttgattctctaatcagtgatttaacactgtagtactgaatactgattaaaccacctccggcactcaagagcgagcgagccacactgtgagtgtgaggacagcttcatttgtttcaaatttccgaacgcagacgtagagtgttgctgcatttgagcatttgctgagcactcaattttcatagtactgtataccgtactgtggcgatggcacagtgtgattccatctgagagactgtcggccgggtgaatatgaacgagtaccgtagtagcttgcacagtacgagagagttgtttgcgctgcgctgatccttttctctatgttacacaagtggtcctgacttcctgagctgaggcccttattaactcttgtctgatgagcaaataaatgtctgtagagtagagggcacagacagagaacattggcagccagagcacacgtacagaagactagcagcgaatatacatgtattatctatattcttgtttcaataattttgcgttttaattaggaagctcacacttattacactcacagtggttgttgctctatctccatgtgatgaaaactggccttgttgcctgcagctgtagatgatgatgaatgcgcatggccgaataatgggctcagtcagatgtctctatagctcgtcttttgtttggatgattcctcttggttcggatgcgattatttgcgattcgcacggctcattcgcgtcgtgctgcaagacataactagggcggttatgatgctgttgctgacgagcgaccatccacggatagataatgcatgtgcggacgacgattccaccgcactgcactgcaactggatgcagcacaaccggcaccagtaccatagcatgtggccgttaatggggtgtcctgcgcttttgttgctctactgctctgagaaacaagagacagaccgcacgttctaggactacgagtagtacacacaagcacaacacacaggaaaagtagggcagtggatcgggttcattccgtagatctttgaaacctgtcctgttcatttgccgtacgtccatgacactctacttttgattcaaatttgaactgagttacatccgtaataagattactagaacagctatagactctcttagttttaagtgttgggcggaggccgaacgtgaccccaatcatggagcgaaagggcctttgattcgtcgcgttgcttcgactaaacagtatgcaccacagtgggtgaataggccttcgactcttcaatcgacagtaacgaaagacgaaatcaagcagtaccggccaagggcttcgccaagacgcctacacagcaacctacgccatacatccgccaagggagagcaaagggcgcagagtcgcgaaggcttcgaaggtggcggtgaagggtacgaggcgaccagccccttgtaggcccaccaaaggacgcttccggaggcccacctgttagtgtaagtatgggtgtgttatttagtgtgccgcctgcagggagcacgacg

SEQ ID NO: 439 - DNA, 1501 bp, Zea mays
  misc_feature (1)..(100): optimal_loci_230850_G1, chr6:138423860..138425360, Cluster 3
acaaattgccatggatccttgccgattccagctggcggtggtttgccataatcatcttcagttaggaagagggtcctgggaaccaaggctcgcctggcagcaacaatagagaagcgcgcgcgtggccagttgggtgagcctggcctctcggccccatctcttagcgctagtggtgcttcgttgcgctggcgcagctgtttagtttaattattcaaattccaaattcaattctgagcttaaccatttaaatataaatacaacaatcaaagaatatcaacatgaatgcacatttgctttggttattttatttgttaattgcttttaaatcaagccttatatttgttgagatgctaaagaaaataaacaaaatcacttaaacactttgtcccaagggttattgtatttctccaaaaaattgggtattacaatgacagtatcatattgcatatgaacctatctatatagaaccacccctctcagcttgctctatgatggctgcaacaacgattgcctcttcataaccgtaatcgagcctcttacgcatcctgcattgttgctcaacggtaactaccttgactttatcatgcctaggagatcatgatgactcattttcatcatccctaactcaagggggcagactatgtctcttggtcctaatcacactgctctagcacactaacaaaactactggcaactacaatcattgatcaagaattacaacacaaacacactaagctaaccctttaagatgcccactaactcactaaactcctcctaacatgtaaaacctctcgaggcttggcctcagtccatactcactagcttggccccaagtttacaaaccttgacatgctgcaagatagaggcaaaagagtatacataggaaatataatttagtgataagaaattcttattgatagcaaagtagtttgagataagaaaagagaaatgggcggcttggctacctttaaagcggttaatgaacaacagaagcaacatatatgtgtcatgcaaattgaatcaccaactagatgaagtgataaacaagagttatcattaaaatggaacttgagattaaataataatgaaaagcagactatcaccttggcaagaggatatgacattcaaatattgagggatagtatcaaaggggctcacaaatgaagtggaataacactaaaggctctaatggattggaagctcattttcgaaaccctaataatgttaggagacatgatttagggttgggtgggtttgggatttggctagagcagtgaaaacaaaatgggaaaaaatagcaccagaatcacctagggtatgcaatggaggaaatggcactaagacaacatgaagaagctaggatgtgtatatgcaatgtgggtaggatatggtggctaggcataggagcatcgagcgtggaggcgatgcagagatggtgtgtggtagtgcagtagaggaacaatgcaatggcatggcaaaatgcggtggagtgggtgcacaa

SEQ ID NO: 440 - DNA, 1533 bp, Zea mays
  misc_feature (1)..(100): optimal_loci_232309_G1, chr6:145294220..145295752, Cluster 3
tttgtaacccttgaaaccaaacgggcctaatacagaccacactaaggtgccgtttggtttccaaaatgtaacgtaaatggtaacggtaatggtttgcattcgattaccagcggtaacaaatttaaataagctgatatcagttcctagtgtggtatccgattacgattgaatttaaacaaacatgatctaacgttatttgttaatattacattacaaatatgtgaaccaagcatcatctaacttcgattagacatgactacacgagcttgtgtcgccacatcccctcttgtcgatgcccaatcgtcaaacagcccagccgtacggtacggacctcgaaaccccaaatgttgccaagtttacttctacttgcccctgaggacgcccgatcgtggatgtcaccagacagccagccactcgcgcggtagaagggccaccgggtagaatagggaaaatggtggaggtccttgtcgatctttgcgcagagctgggctttcggtctgggtgcccggcggccggcatctgtaccagcgcgtgaacgcgacccgagagggatttccgcaagtgcccggacgagatgactgttgtactggcgagggccgcgagcaggccggcaggggcatcttggggcatccgtggcacccgcgtggaggttccgaaggaaggcggacccggggacgggaagaggagggagatgccgctggggcgccgcgttcacacgtggcgccgtgcgtgctcgctcgtcgttttgcctgctgcggccactgcgtgcgtccacgtgcgcggcgtcctgcgtctcgcttcgcgcgctcgccacaggtctgagtccgcagccacctgagaattgatcgacccaccgaccgtacgcaccggcccgcgccgtggttgattgcgttgttttgtggacgggggaacgcggcggggtgatcgtgatccgggacccggacccggcccagacgacggtgaccaggggagcaagggcggccgctcgagtctccctccacctgggggctggggcccaaacccagcgtcgcgtaactacgtggcgccggtgtcaaaatgattgatggtgatgaaattaatgtgagcgcacataaagtgaagtttatattaacgtgaggagagctgctcaagacagcggttatggggcgccgcgccataggccgaccgcgccgcctgcctggtgggcgcggtgctcggaccgtttggcgggtcgaggaaaagaatctcgccgcttggtgccgtcccggcgcgggaatatcccattcccgctgccgccgccgcgcgggtggaccagccaaagcagccagtcgcgatttgctttgcctgggcaaaacgcgatgcgtcaaactcacgagaccgccgggggtgacggtctggcggggcggcacggtagccggcaggtactacccggcccgcgaggacgtaggcaggggcaccgaccgactgaccgaccctgtggaggatcggcaggtcgcccctcccgcgcaggcgtggccgtgcggctgacgagtgcggcgtgactgctggggatcc

SEQ ID NO: 441 - DNA, 1937 bp, Zea mays
  misc_feature (1)..(100): optimal_loci_233102_G1, chr6:148609622..148611558, Cluster 3
caccggaattgcgatcgcaagatcactagacgcaagatgagaacgaacatgagatttttggttccgtcaaaacagcccgcttttctagtctcttctattgactgaaaaacaaacttgatagttacagacttgttacaacacgctataaaaacatcgtccgagtccgtccacaaccgcgccatcacgcagttcaagctcggttctaagtccactagtttgcgatctccctgaaaacgtgcctagctgctaggcctgctacggtattgttcggttacgtctagatcgaagtgaattgagggggactacgcgggctcaactaattcggctgcatgtccaagaacacagcggcaagagaaaagactaaagcctgacgaaaataagaaaacagaccgaccaaactgaaagaagcaaagctctgaaagtctgaatcgaagttgctgaactcctgaatggtgacggacacttgttgacactctcgcatcggtgccgctcctccctccacgcgtcctgcttgtcgcggcaccaccaacaaatcctcgctgccccatgcccagtgccgtcgtgtgcacacaggctccgcatgccatggagcatggttctagccaaggttgtggcctacaagaacaaggcttcgatgtccctgcttcccccgatctacggtctcctgtcctgcaacttgattccccacatcttcgatcaccatcagcccttcatgcagctgcggtccttcagcggctaggcttcacacactggtagtctggttactaatctactccctcccctctccttactccctagattttgctagatatggctgaatttgtgttgtgtgttcatgactggaattgtttttccctattggacagatactgctagggtgctaccaatcttatttaggaattaccaaattaggatgtaatgcgcctggtctatagaatacctgtggattttccaattttgatgattgattagttattaattaatctactgtgaatcctaatatggcctttattctcttgaaattggtatttgacatgtactagtacaacataaattcgctaaatcctaggctgaagttcttgcttatataacacagctaattttgagccaagtttcatctatgctagtgtgaaggcaaatgaacagttaccgggtaacagggtactaacttggtaagcatggggattcttctgaaagagcttacaattcaacacatttcctccatgcaggcgacttaattttgattaggagaaaacattcaggtatgtgctttcttttccatcactaatagtaataagtagacagtgagagaaaccattcatgtttgtgcattgctcgaaagtctatagaaatggtgcatttcttttcacttgatttctttgctgaatagttaaaagtatttctttacaatgaaatacttgctaaagattatataatgtagaaaggcaatgtgctgaatactccccctgtttttatataaacgttttaacttttgtatattcatagcttttgttgtgcacttagatcataccctaatctagacatgtaataaaaataatatatctagaaaagtcaaaacgtcttataatttagaacaaaagaattatgttttgtctaaagattaaacactacctaaaatgtatacttacatggctcatttataaatgacatatctgtacgttaattgcacttaggttctgtaaattaatttaacatgcgtaaacttcggatctgaaagtttcatatttgtatctgtagttttgtggatatgacaagtttgtatttggtaccttgaatttaacacaactgcactgtattgctgtggggaattagaaacaactgagtcttgcaatgaaatcataaggcttttagacctctagtgaagagctaatggagttgagctgcaggcaaccataattgggttgttatccttcaat

SEQ ID NO: 442 - DNA, 1930 bp, Zea mays
  misc_feature (1)..(100): optimal_loci_233178_G1, chr6:148953336..148955265, Cluster 3
  modified_base (29)..(29): a, c, g, or t
  modified_base (30)..(30): a, c, g, or t
  modified_base (31)..(31): a, c, g, or t
  modified_base (32)..(32): a, c, g, or t
  modified_base (33)..(33): a, c, g, or t
  modified_base (34)..(34): a, c, g, or t
  modified_base (35)..(35): a, c, g, or t
  modified_base (36)..(36): a, c, g, or t
  modified_base (37)..(37): a, c, g, or t
  modified_base (38)..(38): a, c, g, or t
  modified_base (39)..(39): a, c, g, or t
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(128): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
aaagaatacatgttgattaccttacggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttattgccaccatcttgtgagagcttggatagtaatacatgtaccagctctaagaagtggtcatattatcttaatccaataactaaaagtctagccatatgttggagtctatgaacaacccgctttgaactggctactacagtaagcatagcatttttcttctccctctatttctcttaatttttcatgtcactggaaatctaacgtgacatgtcttgcgttgggctcaaatcacgttattatactttgctctggcgcaatcctttccgccaaacagcacgcgacgtcagcgaacttcagcaatcgacttcctccaaaattcctgcgaaagccatcaggccgggctcatccgaaaaccatcagcctggattgcgtaaacagaatcgagggccttaaagttcgccagctacaggatttgtacgttaatcagtgttagcccgtatcctgtacgtactagctccgtctcctacatgttagatacacacattgacgccagagatatacggccggccgaatatctatctatctatctatacgtatgaggtccgtagctagagtgctagaccacgcggcggcggcgcaccgcacacctgacacctagcagccgaccgtttgtttcatcacggaagtcggaatcgatgcacgtagcaccgctgaccaggagaaccgctcgatcgacgacggcagccggcgggccgcgcgacagcgagagcgagggagaatcgccgccgggccggaccggacgtgacgtgacgtgagcagcacaagaggatagcggcgagatgttacgggtatggtgactattagcccgcgcaggcatgtgttccgtgcgtgccaaaggataatgctcgcagtgtgggggttgggttgcggcccggccaggcgagacagcaacgacgatggatgaggggagtcaatgccgatcacaatgatcgaaagggactgtagagggagaaaatacttcgtccgctcgaccggcagcaccagatagtcggccgcacgcagcccaaacctggtcctgctccaaaagcctggcacgtcaatgtggctctagaccggactcccttggagaccaggaggctggttttgttgatactgctattaatatactatctctgttctaaaatattgaaaaaaattaaaaaaatgacacgatttatttgtgatttgttcaaatcacgttgtacaataaataataatagattcacatattatccaatacccaaaatcacatttaacatacttgtgcaaataaaaatgcaatccaagtgcaacaccaagtaatagaacctcacaatagtgacatacgtacatgtacatataaagtttttttctagcacaatttgtcatacaagtcgaatgataaagctttcgtgtatggatcacatgtttagctcgagtcataatattcagacatgttggaagaattcgagtatgcgctcattccatatacatgaccctatacaaagatacgagaaaacatgaataacaaataaatagttaacgacgaaacaaaaaaaagtaacacatctggttgccggtagaatcatatggatctaacactataacaccaaaaatgaaacatgtatggggtcggggtactcgtgaatgcgaatatgcatacgggggtggttgcacgtacccatatatgactgatgattatacttcacatgaagatccttgccatgtgtaagggtttaggttttggtctcgtcgagccggatagttgtaactgtagctgtgcttccatcatcaacggaaagggaaactgatcgacatcgaccactccttgtttccc

SEQ ID NO: 443 - DNA, 1444 bp, Zea mays
  misc_feature (1)..(100): optimal_loci_234555_G1, chr6:155141774..155143217, Cluster 3
ttacaactcaattattacatcatccctgcagcaatttgtagttcaaatggacttcaactaaatcatgatatggaggaaaataaaacacgtgcactaagctgcttcttcatatcacgtggactttcaatggtatatgcaattatgttactctctactatatttatagccagcgtggtaagttcgcacatgcttcttcatatcaccatgcactaacattaattacctatcggttttggttttgtggattaaaatgcaaccgaaaatgctgtctgatcttctatcaatgatatggtaggttacgcccattcttgaaagaaaaaaaaagaagtttctcctcaaaagtcaaaaggtacgcttgtactttcaataaagttttttttcctgagataacggctttgaaagatttggatgctgtgtcgaccgaccgatagactatgctgctggtacgttcgtcccctggatctcctcaaaaggtacgacgataatgcatgggacaaccagcgtggattccgattcgtacgctgttccacgcagcatgcacatggcgtcggcgggccgtatccggcgacgagccgacgacccaaatccaacgtgcgccaagcaggccagacgacagggaaagcaacagcacagccctatccagtaaccagtatccaccgccacctcacgcgtcctcgtcggcggcggccgggatctctctcaccaccgtaccgccgcagtggctccaccagcagtagtagcacatgcatgctgcgccggcgctgctgatttggaaaagcacggccaccactcatgactcacccaccgccgggccggatgccgctgcacacctgccgacttgttgagaagccacgtacgtagcagtagtacgagtggaagatgacacgtacatgttcaagcttatcatgcaaacgcatcttgtcatatggatagacctacctatcatcgtaggagtatatctttagcaccagttttatgtcaggtgcaaaacgtgtaactatattcttattccgcttcttgtttaataataagtttaatgggctgttacactatagacagggcatgagaaactagctaagtccaacgcaacagaaagtcacacgttctcgcatagtataacatcgctagctgaaggaggacgaatatccgagcaagatataaacaaaggagtttaaactcatttttaacttatatctttcttagctttttatgtaacaaaaagtgtaatatttgttttgactagtttaatatttggtacgtggactataagtttactttgatattaatttttttatatatattagatacgatcgtgtgtcggtgtaacatacgaggattaattatacaatatctatgtaagcggacggatatattagcatctataagctagaagaccaccacttggcgttggaacgatgcatgtaatctatgcctttattctacg

SEQ ID NO: 444 - DNA, 1522 bp, Zea mays
  misc_feature (1)..(100): optimal_loci_234568_G1, chr6:155199387..155200908, Cluster 3
acgatggagattgtttggattttcatgcccttgcttattatggtttccattttggtttcaaagaatggatgacaagttcaaggctataaatactccatctctttcctaatttaatagttcaagcaactcatttaaagtacgagaaagagagttcgggctggggtgagaggggtagtcaattaatctagcaccggctatgttagaggtgcttcttttgttacgccttgctattagatgtgtgcgtgtgtccgttctaaaatgaaaacatttcctgttttaatttaatcggattatccagggcgcacggcgtcgagagtgcccgtcacggtcggtggcagagcgcatctttgatcttttctcgctttgacaggcagatgaagaaaagcccaaagctcgcgcacggggggggtcctgtaccgcgtgcccattcgcggcgggcacatcgcgctccgttgattgggcaaaagcacccggcggaagtcagccgcacccggctcgtccgcggcggccgaatctcccgtccggccgtcccgccgcagcagccagcagctcacgtgcaaagtgaagtttgccgaaagctgggcaagatagcgtaaccatttttttacggtttgccttgaatttggaacggcaaatttaaatttctggcttggctgctttaaagggttgttagtgcgttgctgatactagtactagttatcggttttatcactttatatgtaggtcatcctgtaccgtgccaaaaaggtagctgagtgaaatggatccttgtttcgcagaacatgaatgcagtaaatctccatctttatttttatctttactatattaaaacaccagtttccaatggctaccggtttgcaatcatctgtataacagaaccaagaagctgcagcttacaatcagaaaacaaaacgctaccaaacaaaactcacccttatcctattgtacccgttttcgccataccgcgtcctttcctatgaataaagtaagagagcttgcatatcaaatcgtcttaacaagaaaattcttctttccttctttttccttggattccgcaacaggtcttgggaccctgatacagttgagaatctgagatcggttcaccggtttcagatatcgcgtgcatgcacagacacctcgtacattcctgacgaataataacaagatgagtgatgcaaaggttcaagcatagatcctatcccacagccactaaacatacttttaatcacatccacggattgtccaaggccccttaatcagagaaaaagattgctgcctcgttttttttcttcttcttcaaaagtcaaaacgtgcccgtgtggttgcatttagctttagcctgggcactgaaccatttccttcccggaaaaaaaggagaggctagcaatcatctgaaggtcatggctacaggtgaggagacagatggaagtactcatggccattcctcaagcatactcaaagctgcaccaagagaagggcatgcgatgtactacctcggggtactcgaatatttgtaaaaaac

SEQ ID NO: 445 - DNA, 2395 bp, Zea mays
  misc_feature (1)..(100): optimal_loci_234906_G1, chr6:156838703..156841097, Cluster 3
attataatctgcaacgtgtcgagacgagtaattattatacacaaaaattacgaacaaacagacagacaataatactgcaaggtccagatcactggagcggcgtccaaattattaatttgagaagagccgtgtagaatgtttgcacagcgatgtcagtccgggccggcatgattgattgttccggagaagggatattcgtgcccgcagaaggaatattcgctcgctggataaatagggagggggacgcctcggcctcgcgtagttgtcctgcgtgtacgtttctgtaaaataataatctgatctgaatgcaacggcgggggcagccgagcagcggcacactgcattgcgcagtgcagtgcaatgcgaaggcacacagagctagtgccgcaggaagctgggcccggcggctgagcattcacgtgccacctcccatcagtccctctccgctcatcaattcatcgacgacccatctcgtctcgtctcgtctgctcacccacgtttattggatcaatagatgatatggagcggagcgctgttctcggttagatgtctcgcagggccgtggcgagttttttggcgtggagctcgaatttctgtctgcgcccctgcccctgcccttggaggagcgaggagccgtatatttgggccacgactgactagctggccaattattggtcgggagtgatgaaccaacgtggacccgcgaacaactgaaattggttgctgtttattattgcatcgttttattttatttaaaaaaaacaagttcggtcatactgtatgccagtaccatatcaaatcgaattacttgaccgaaccgccgcgggaacaattgaacaaaaagatcgctctgatgattgcttgtatatgtaaatgcataaatctcgtaggacaatgacatcaggggattattgccgattcgatcgaccaccagtagaaaaaaaaaatcgtccccggtgccagaaaaagatcgcagagcaatcggttgccaccagaaaatgaacatttttaaatcacacagacgacacgagccagcgaccacagccacaaccacgggaaacaggaccatctagtgtttagatggagggacgaggaaggatgaagatggatgagatgagatcattctagcttaactcgcgtttggtttgaaggtccagagtcaggattaagaaatattctttaaaaagggtggataaaaacatccctttaaaaaataaggaacgaggttagctcaaggttaatttcgtcccattcttgttgacaccgaaccaaacactacctaactgatcaggtgagggtgaggcgtgtcgtgttgcagctagcgtgccggccccggaaaacgacgagccgctgcacggcgcgcggtcgacgtgtgtcgcggtcgcttgctgccttgctgtgatcctgatctgctcccgctaggaaatgaagatgggcacttggatttcacttgtttgtgccatgagatgaagcccaggacggaccctcatccgtcgccaaaaagagacaagacgacgagacgtacggcgtgcatgcacgtttacctggacgaatgcatgcatgtggccgcgtacatatatacgatcgatcgatcgatcgatcgagaaccattttctcagtcactgaaccgtcagccgggacaagacaagcttcgtggcagcttcgcgtgcccgttactgtgtggattcgaccgcggagtaacaagaatctgtcgcgcgcgtacgtgcgtccacgtttgcatcattgcacgcgtacaaggcctagagtacatgctcccagccgaaataggcgacgacgatgacaagcgccggcaaactgaaagcccaacaacgcagcggcctgctgccgggcgtcgaggcgtcaagccaaaaagcccagtagcaatttcctggttccggcggcccggatacaaaacccgagcccgttaagaaaccagagaccaaaaaggcctttgccggtccggcgtgctcaagcaacccaacccctaacaaaaaatccggctgccactgccagggcgacggctgccacctgccactgctaggttttcgcggggccgcggcacgtcatcgcgctgtcccctgccctagtggcagccacccacccacccactcccgcggatccgcgcgcgagcccccaagaatttaaccgcgccgatgcgggcttcccccttccggcaaagatctcctgcgcgcggatcccctgctgccgccaaggttcgtaactagtgtcgcatccaaaccaaatggcaggcaggcaggcaggccggccggcgtgctcgtaaaaccccaggccaataaaaaacaactgtttccaggttaacaccactgctgcctgctagtgctcgcgggttaaaattaccatctctccctattcggtcgggacaagtgcaggcagc

SEQ ID NO: 446 - DNA, 1494 bp, Zea mays
  misc_feature (1)..(100): optimal_loci_235232_G1, chr6:158394370..158395863, Cluster 3
taaaaaacgactaatattttgaaactgaggggatattttttttaataagagatatacaattcagcctctacatccacctaacaaaaaccagcctctatattctgttgggaatgggatacattgcatgcagccaaaaaaatgcataagcttttgcagtcgcccatatatatacacagtagcatgcatacatcatgcgctttattacatgttagccgctaaaaggatagaccacacagcatgcatgcatgtgagttaaaagctcaatgacacagaaatctgaattcgtaagcagcgcgatgaaaaagagctgctttgcatggactgtagataccgtagctaggccggccccaacccggtcccgggccccagcagaggtcgctggcaaaagagaaataaaaaagactgtacttacaactgcaaagtgatgctagtgagacgaacgatgaccatgcacctcaaagtgagccagctctctctttcgttcaccactatgctagcagtaggctaaactaaactgataataaaccgcttcattaccagtggcagatccagagggggctgggtagctcatgcgccagcagcttacaagtaggagggagtaagagaaaggaagaaagaagaggagaaagagagaggaagggagaaagaagaagggagaggaaggaagaagagggaaggggagatgaaggaataagaaggtgaaaagaaaaagaggaagaatacgagggaaaaaaaagatagttagcttctagctcctttgccctggattctggatccgtcactcttcattactaagcagtttgtttatcatgtcacctcgtgcgcagtcttgttgctcgctctcgtatagtaggcgtagcacgctcagaccatcagcactgcgtgcggttgccacagctttcttttaagaaaaggatttgtcgagttgagaagagagagagagagcactcagagcagcacctgctaacgctagccaggacaaaatagagtagccttccggccggccggtcgatcgaacggttgcttgtctagcacagtgggagtactgtactacgaggacagacaggcgtgtgtcgagtggcgtgtcgccttcctgcgttgcgggcctcgtcgtgcgtgcgcatgcaaatgcaggcggggacggaaagacattgacattgcacgcgtcagtgtcaccaccggtccacggccaccggtcgattgatggatggctggctgatgcatgacaagtgacaaagccacacggcggccggccggccgggatgccctgttgccagatgctgatcggcgggcttgctcactcactcacgcactgacctccagttactagcgacctactaccttaccttcgtcgcccctttggccccggcctgagaatttatgggcgtgtttggttgtcctgaccgccccacccaagcttatgccgtgcgttgaccacatgcaaaccggtgattggttacctgaacatttagatgctggcctgcgcgtgtggat

SEQ ID NO: 447 - DNA, 1691 bp, Zea mays
  misc_feature (1)..(100): optimal_loci_236049_G1, chr6:162634900..162636590, Cluster 3
tgaacacctatctgatggcatttaggatatgtttggaaacacctaatttttaataaaccggtttatagaaattgaggtggttcaaaacataacagtttatggctcggtttatagaaattagattcccagtttcttaaaaaacaagaaactagtatctcgtagctaaaagataaaaacatggttttttcaaactgggttgcttctaaacagggccttagctcaaagaaaatatgggggtgcagttcttggccctcgcatatggttgtttcctcaggtctggtgcgaccaaaaaagtcagcacaaaaaaacacacacaagtaaatgacagccagaacttatgtcaaaacaaacggcataaacaaccggtgagttgaaacgcactgcggctgtgcgacaagctgtggaactattatatcatcacgatcgctgcatgagctttaagactaacaacgttcactcttgatagcacttttggcatttgaattaacaacacttcaaaatttcagaaaaaaaagttaaacttcttttgttgggagctctcttaaaataagagagcaccctcaaaaaaaaatagcgtatactgctaattgtgacgagcacacggtactctttagtaaaaggcgaaagaatagctcgctttgtgctcgccacgcagcgcgtgcttcgtataggatgcattggcctctcactaataacggagcacataaccccacctctagcagctgcaagatatggcactaaatcatctgttcaaccctgctttcccttacccgtccagcgatccagcggtgggctgtgggccttggtccgtccagcaagccagccagcaatgtatccggtggacgggaggagtccggcccaccaacggttttacaagtgaagaaaccttttttgcatggctgggcactgccgcattgggctttgagcttgctggccgcgcatccgacgggtttacaacttggtagctttaaaataaacatgttgttaaaatataatagatggaagccatcattagttttttttctagttcaaattgttacatccgcgtcattgagatgactaacacaatgataaatctttcagcagttataaacagacttgttcgtatttccagccatataaaaacagtatgatgtaggaagatggaaagtctacgagtggatagtgatgttgccaaccgataactcacagttactaggtctttgtcgaacatgtacttctaggccttcctgtactggttaagggtttatgggctcttcgacgatgctttgaaaatatttgaattcatggtgtatgttcaccgaatatgcatgccgaggtttaatttcatgttcacgtttacatgtatgtttttggagaagtgactgaacaaacggtccctgccgtattcagcgtcagcaaatcaatctgaataatacctgttatacgagtttttttaaacttaaatgaacaatgtaaatgtgtgtgtggtggggttgggggggacacagtacaactaatgatgtgtttttagcattcgaattaataataatttaacgaccaataaaaatttgaatttattttgttaggagccctccttaataattaggaaagcattctccaaaaattagcgtatactgctaattatggtgagcacacggtattctttagtaaaaggcaaaagaatagttggctttgtgctcaccacgcag

SEQ ID NO: 448 - DNA, 1894 bp, Zea mays
  misc_feature (1)..(100): optimal_loci_236098_G1, chr6:162998090..162999983, Cluster 3
ccatctaaacgaaattccaatgctatatatacgtccctatgagactactatggtcacctaaaacactgtttaccactatatactacattatttatagaatgtagtttgagtatgattataaggatgggtaagatgatagagatagcctaatcgatctagtgaccatttacatttatgcagcttacatagtacgtaacttccaaagttacttagagctaggccattgcgcggttgctccatctttaagccatcgcggtttgtcactgttttacaattcgagtttcaggagcgctgcctcgttgttctgtaccttttggctctttatcagaatttagaaggggaaaaacatgattcaatacagcttctaaagttgtaaactactacgagtctttttcactttgtgaagctacagctctcgctctcgctccgttgatagataggctacgcccactccaaattgcatatttttttttcgaaaaacagctctcgctttaactttttctaaaaaaaacagtcttcttagagctgaaactgttgcataaattgtttggcagaaatggcttatactagttttgcaaaacaccttctataatagaagtgtttttactcactgattttagtgatcgttgcaatgacaaaatgggcgcatagtcctcacctgaactgagaatctactcgctactacttggctgcactcttaccacagctgtgacggctaatactgcttggtttctacaggtttactgcaaaacagcacttccgatcacggccaaaaccgaactgtaggcaatgtcttcccgtggcattgtaacgtgaggggccccggtgggggcagatattgccagagacattcttcagctccttccattccacagcgtgccaccgccttgcaacttgcaagctacaagttctcctactctgcaccttagccggttctggagcttgctgacgacgctgttttttttttttttgccccctgctgtgacactcgttgacgttttttatttttagaaggttcgctgggctaaggacgtgatcgatggggtacgtagctactggtgcattaatcaagtaacacacaaaagtatccgcgcatttcggcatcggaaggaagtagtagtagtagtaggtggtggcctcgcccactggcgcaacaagtcaagacaggtatgcatggatgggatgttccggccggccggggagtggacttcccttcttctttgaggctgagggggggatcggttctctctgtactgctggcaggacaaaacgatgacaggaaacgacggctgtgccagccaaaggcgctgctcccctttctgctttggttgctctaacgacctagctaaccaccacgcacgtagtcgtactcagcaaatgcgctggaccgcctggtgggtttcatttggatcaatcagtcgaaaattcgaagcggactcacgcatgcaggctgcacggaacggccacacactgcgcatgcacagagagagatgcttgacgacgatcacatggaatggaagcaatcactgtggtgtggacagcgtcgaagtaaaaccgtgtgtcagtaacactcgtgcggaagagtggtcatccagaactaccacgtacgtacgctgccgtacgtgcagtccgccggacgcctgcactgcaccgcagcttccgcaacaccgatccatgcacgcatggacacggagaagggtcagtggcttgcaggtcccgcgaagcaaagctggtggagagcgaccagcaagctagaccggctttgctgctgtctctttctgtaggggttaggagccgaatggtacctcactaggtcacatgatgtacctgtccgtaaaggatgcgtctttttttttacttgagagctgattcggtgatcaagaatccagaacaa

SEQ ID NO: 449 - DNA, 1439 bp, Zea mays
  misc_feature (1)..(100): optimal_loci_237729_G1, chr7:3172071..3173509, Cluster 3
gcatgcatgctagtacgacaccatgcacggcggccggcctcctctgaatctctggtgaggttgcatctgatgggtgcagtgcagatgatgcacacgcagtgatagccctgagagagcctagttaacatacagggcagcaggcggctcgatctgaggaggcgtgcacgcacccatccacacgacgttggacacaccagcagatcagagcgagacgacgacgacgacacaccggcctcctcctagctcgacgacgccggagaccgatcgatgacgacgatgatggcgaccactcatcagcttgcacaccacgtactgcccttgcttcttgcgcgcgagcagttcatctgagctcttctagctagctggtctgatactctgatctgatccatcccatacgagtggccggccggccggcctggcctggtaccgtacgagacgtacgtacgtcgtatacgcaaacgaatgaagacgacgacaacgacggcagcagcagcagcagctcatgcatttagtcttctgttgccgtccagtctgttctcttgattctctttctctctggtgatccgccccgatcacacacacattcagaggccagagagcgacgacggacgacgacagccgggcacagtactgtctgtacacgtatggcacggctttgttattgtatattggtgacgagatcgagctggtaccttagcttcatccatgagctagccttcagtacaataatacaccatagaactactactgcatggcttcagttgttctgtacgtgttgggatcctgggcaagttttcaatgtgtgtgtgtgtgtgtgtgtggtcgcctgacatgagacataaagagagatcgccaagagagggacagacgagagagcgagggggagcaacattttccaacagctgttgtgcagtcacgtattgtagctatcggagggcctctttgggtacgtacactttctctttggtgggtacgaccccacacacacactgcagtgtgtgctagcttgttggttgctgccctgccctgccctgccctacgtacgtacgcaaccctacgtagcagctagcgcatggcctacaacacagtcgaaagagcagagagagatgaatctatcttagattttgtttggatcttgtgcatccatccgtccactcgtgaagcgacaatgaaaggcacagggtttctgcaggctgggtgccacccatctttaatgcgggcacagcatgcactgctactgcgattacagaaccatgcatgcagctgtttgtaacctattgctaggagctcatcccaaaagccgaccgcccatacatactataaataaataaagtataccctcctatcgtaaggtatatataatatataatatatattatatatataaatatacataaacctatgctgcatgatcattcttcaccactataaacacgcat

SEQ ID NO: 450 - DNA, 1674 bp, Zea mays
  misc_feature (1)..(100): optimal_loci_238821_G1, chr7:9269129..9270802, Cluster 3
gacaaagcagtttgtagttggtcgccacgagggcaattccggcacggaataaaaagaagaagaagaaaggaaaaaatgtagctggctgtttagtaggttgctatatttgttagtgacggtacatttctttagcgggcgtgttacctcctctgttccgattaatacatatttaaaaaaaactttagaaattactcgataaaatcggtgagccaacgtgtgtagacagcatgctaaatagatgccagtaattttttgtagtagtgttcaacaagcctccttaagtggtagatgtataactgatgtacacttgattcggttttttatttatttatttatttataggtagccgttggacgtggaccacaaaaagaagaaaaactcgtgtgcttgcatgaacgcacgagagctgcaacgttgagagggacgaggagcaagggtgtataggaagagccaaacccatcgtctgactattagcactggcctacgtggcgtgtagaacaccaaaaccagcaaaaggaggcatggcagcctactacctctacctagcaccgttagctgatcgcaaatcgcagcgaagagaaaatgatacgcgcacacccatgccatgccgtgcgtgagcgtgactgccctggcccacactatctggcgccggtcagccgggcggtggtgtctggtgtgtgctgtgtacgaggtccggtcactgacatatggaggggaatttgggtggacccacctgtcggtttcagtgtggttggggaccttgggtcggagaaacggggtgcttgttggctatgcagggctgggctgcccctgcttgcagtgcagggatcgcggtagttaaagcgaatttaaagcgtgtaaaggtcgtgatggagagacgagagagggggagggagggagtgtctgtgtgtaagaaaaaaaaaagagaggagaaaacgaaagggaaatgttgaatggatcttggtcgtgatcgatgacgagtccagccttttcgatgagcagagcacagcagtgggcccaacgttttagtccttgtgtagttgtgtgtgtgtggggtatatacatctacacacacgtttcgtttattgttttcagctctgcttgttttatagcgatatatgattgggactccgactacttaataattcgcccggctagtcttaagtcaaaatatctcctgttttttagatagtagtttcgagcgacgatcttggattcttggacaggcgatgaattagtgcaactaagagaagagctcacgaaagatagcttagacaaacaaacaaaaacaaaatctgtagctaaataacaaggacattacatttgtcgtggttgcaacgagtcgggtccaaatcgatgtgggccgtttgtgggtgggcctgggccgtgggtgggtgtgctcgtaggtcaaattctcaggagatcggaagaggcatgcctgcaataaaaaagagagagagagacccaacaaaccatatggttgtggtggctggaaggttgaacagagcggtctgtacgatacgttagaatcgtggctggaatccctgcatctggccgtcaatctcacttggacttgttcggttacatcaatctaaatggagtttccttcaatcccctctgaattggtgtaaccgaacataccagttagtagaggtttgccaaaaagggatagta

SEQ ID NO: 451 - DNA, 3646 bp, Zea mays
  misc_feature (1)..(100): optimal_loci_2425_G1, chr1:12810845..12814490, Cluster 3
ggcaccacgccaccacccatgcaaatccgcccctaccattacatcttctcccaagctatacaacttcctcaatctgattctcttttttcttattcataggcgagggcggagcgcttccctggccaatgggcagcgactgtctgctgccatgtgcccgtgattctcccctattgtgagtaattattcctgaatgtctggtcccctttccctacctgtcatagttccactgaattgttttaaatgttactaccccgttattaaatttgtagagtgacccggtgcgttaattttatggagctccgccactgcaattaagtgcgtagattttaaaccttgaacctacctaacataggttcccatctcacttatcaagaatcaaactttaaaattttgattggatatttttgtattatcaacatttgtatctctaaatacatctgttacaaaaaaaaaatataataaatgtagtgctagttattacacatcataaaatatcaaagaaattttataagtttagttaaattttaaaaaaaataaaaacaaaatgtgcacttatttgagaactcagttggtttggacctagggcagcgttcgcagatacgactgcacgaatcagtgtagcggccatggccatggcaccagagaggaatactagacctgaagatactccagatgttgagtcgttcacgtgaacggtaggagctagctgcagcgaatcggagggtgcagtgcaggtcgcaggcggcagatgggatcggagactgtgacgcgtgatgacctcaggacggaatgtgagctgagcatgtgtctacatcgatctttggactacatgcatgaacaatgccttttgcttgcatggcccgttgaaagtgaaactgaaagttggagagcttacgatattattactccccttatcctcgcataattgacgcaataatatttatatcagttaatttttttagttttattgaaaaaaaattattaacaatatttacatcctaaaaagtttaaaataaatttaaagatttacaacatgcatgtagtacacgtcgcgagcagtaatttccctctttctctttcgatatgataccaccgttattcgtggactggggaaaagataaatccagcagagctagcgagaagacgagttgttgcgtctgcgtcatggatcgtctcggtcctgctcctgcactaggcaacaggtgtctttatttcgcggccagtcgaagaaatggatatccggccatgcatggattggacttggaccaccactagaagctttatgtgcatggcgccaaagaagggcaccgatatacaagtgacggatcgtcggcgcgcgctgcccggccatttgcatgcctgcgtcatgcgtcgtatgcatgcataggtagatcagatggccccagatttggccaaactgtggatggctacatatgtccaagccacgagaagctgtcccgtcgtcgatggcgtacgtagctacagtatagcaggagcagccaagccgatcgagcagacgaggcctctctgtctgtctctctctctctctctgcctcctcgcaccgcacgccaccgtccctccctcctccgctccgtcgtctcgctcccgctctctctgccgtcgtttgccgtgccgtgccgcgtgtgcgcgccaactgccaagtatatgcatgcgcgcgcacgtaacctaacgctcgatcgaccggccgtgtccgcgcctgatgcctgcctgcctgctctgcgtcgtcgtcgtcgtgcgtggccatccatgtgcgcggcggcaggcacgtacacggcaccggcgcgcggtgcatgcacgcgtgctgcatcaaataaggccggccgcgaccggggtacgtgtagatagtacgtgcgcttgtagaaagcttgctggatgcatatgcataggagataggaaaagctagctagataccagccaggcactcctatctccaaagtccaaactcaatacttcctgaaaaattcttcttaccacagagaaattaaagtaatcatttttacctccttgttggaactacaaaattccattcgaaaaactcgtagcctgcctgatggacttgtaggacttctggaggccggaggcgaaagagatatgcaggcagatagcatatactgggtacgcagcgctggggattgcaaggtgcagttgcatcactcacaccgtcacacgcacagtcacatgagcgggccgcatcatgacctcgtcatcgtgtgctcaccaccactgctgcctgcctaccagtaccagcaggctccacagctcagctcgatcgtatcactcacacgcacagtcacatgcatgcgtgcactcacctgtcagtcacagctgctgcggcctgcgtacggatcgatgcgcgcgccggcccgtgtattgcaactgcagttgcagcttgcgcggcagcgtatagtaggactactcggtgcgtaccagtagtacctgcagtgcagtgctggctttggcctgtgtgtgcatgtgcatgtgcatgtgtggtcgtgtaataagcctggtactactacacgtacgttacgtacccactgtcagctgacatatatgcatggcctacttatggcgctactccgatgatatatcgatacatgaaacacgcgcgcagcctgcctgccatgcgcacacgcagtcgtcgcgacgcacggaacgagacttcgcttagcacgctgcgtcacgtattagacgtgccgatcgatgtgtgctagatcgtcggacagacacgcatgcatgcagggtggtgcagctagcaaggtgtagtagctagcactgctagtagggcaccgtggtcgtgccgggccgtctggtcatgcacgtaggtttacacgccctgctggcgctgctgcggcatcgcatgccttctctgattcctcctagtctccttgcaatttgtacgtacggtgccttaattctggtgcatatcgtcccattttggatacatcattagtaatcagtaacaagctatattactttcccgttccaaaataatcccacatctcgcttagctttttggcaactcaactttttaaaagttgactgaatttattcaaaaacaaaactaagggcacatgtacaaccctgatgcggcggtggcagttaaaagactgcgtgatataaccctaagacactagaccaatatgtatgtacgaataatcatgtagagacacgctcttcgcgaatagactatctcttatatatttttcaattaacctctagaaacacctcaagggacttcatgttaaatggggttgtacataccctaacatgcacctatgatgatatgatgtataactatcactaaatcgatcagatagtataatttcatataaatgtatcagcatatatggatgttgatactgtttttgatctctagttaaactcaaatacgtttgactcgtacagaagcgagacagtatgtttgtctttggatgggaggtaccgtgtaaagctagcaaaagctacccccttcatcccaataaatcaacatctatgatataaaatgagcatattgtgaaatatattctatgatatgtctaaatctaattatactaatttaatgttataaactttgatagatttttattttgaaaaaagagttaaagttaaaacagattgatttaa

SEQ ID NO: 452 - DNA, 1945 bp, Zea mays
  misc_feature (1)..(100): optimal_loci_244110_G1, chr7:39163495..39165439, Cluster 3
taagctgattcattcacacgtgcacccagtgcacctagccatggttcggcgagcatgtgccgttcgaatgcaagtacaaggatgcacttgtccattgcatgcttattttttcataaaaatgaaataacatatcatgatttggtacggtcacaacgtaccggtttactgcaaagatataaaatgcaccacataactgctagataagattcatatttatggaccacctcgatttccatgcattatattaggcaagttcagcattgactttctacagcctccagaatacatggtatctttttggaagactgtactgcaggattaaaagtggaatgaataagctttttttacaatttttttgtcaagaaaaaaaaatactttcctccgttctacgtatgattggaattctgctgtcagaggcaaataactgatgtatgcaacatttctaattaatctacgaacttcctaatagatgtctggtagccagatcttgtaggatcttccaagcagcaaagatgtgctgctcctctgtaagcggcgctcctactgcaaatcgcaagacaaaattgccagaaagaacctgttcagtgaaggagggagaaaccaaagcactatcagtggataaaacatttggcgagagcagctagtacagaaggatttcctaggcacccaccgtatgtgatatgaagatcttcccacttgagttagcggcatccattagatcatagttcaacttgcgaccgttatctggtcagacgacaggggcacaaggcggaaacaaacaagtgaaaaggtccttgtagtcactacccatgtgtttgattgcagtagaagtcgagccaggccaggataaatctagccagtgttggttgaatcaggctgagtttatacatatgtttctgtttggttattgtacatactcgtgcaggttatatacagactttgtttggttgattgtattgagacatgagttatagaagactacataattaaatatcaaaatattacattgcatgaatggtcttattttattcaaaaaatctgaggaacacaaatataaaatcagtttggcgatcaaatgtttttaatagaagatataatagaaaaaacaaattaaaagtcattctggttttacttgttgcgcaatggccggctgcattcagcctggacgcacgcctacgcgagctgtgggcgtatggcgcgggcctggccgagagctaatatttgtatctaatgagactgtatgtacagagaagtaaaccaaacgaataatgttttatggatctgcaggtgcaactgcacgtgaaaagcagtcaaccaaacatacggtacctgaattggtttcttattcattttacctcgaatcttgaatcagagatcacaagttattcgaaatgtttggctaactctatatgctttctaatgtagctttgaaggttctccacgccataaagcctcaagaccatccataacttaagtgatctgaaatggaagctctaattggtaagaggaattcatacattttaacacagtatatagtatctgaaagaattgcagggagtcagaaacactgcgttaaggataggaaaatgtttgatatttacacatgttgggctaaatagaataaagaacatatgagttggggcacattttggatgttgtgggaggggacaagattatcaagaaacaatttataaactaaataaaatctgaagcaatctctttttgatttactaaaattagtggttgcgaatgctccatgaaggtgcaaattgaatgttagttcctgtttattgtataatgtgcatggctaaatgacttttaagttctaacttaaaaaaactagacctatcagaggtattactctctcaaattataaagtgatgttttgagggcgtcactttgactacaacttttattgcactatgagtataaactatagcaaatg

SEQ ID NO: 453 - DNA, 1459 bp, Zea mays
  misc_feature (1)..(100): optimal_loci_252544_G1, chr7:99393151..99394609, Cluster 3
aaaatgaaaacatccaaacataaaacttcattcgtaactatagtgtaaactaaaatacactggtaatcactctatttgcttatgacatgaaatactattgattttactttactattttcccagaaaagattaaatgacaagttactttggaaacgaacactatataaattcatttaaaaagacatatgcataacattaaactaaacgctatggctagattatctaactaattatttattcctaccggaaagcatgtgagttacaccttcttctatcttttatttgcaaaaccatattaagatgttacaactttatgtataaggcacataactcctagttcgttagcgaaactatattaaactatcatttacttatatcatctcaatattagtaaaaactctattatttcttagtgattaaccaatgtgcatatattgcgcttatgaacatatgtgttgattataaatctaaaccaccttaagagcaaaggtaatcatgtaataattcatctaacattttttatgaaaatatggtctaccctattcttttattattcattctagaaaactatatctaaactaattttcgacgaacatagccaaattaagatacacaatgcgaccgataacaaaaataataatggaaatagcttgtcacatacacatgagatttaatcgctcaatatatacacgattcatacattacacatatcaaaatattgttgcagggactagttcgaaattaaacgtggtcactagagggtagcaagaaagaattaggaactagattaaataatcatcttctttaacctctgttatgtttccttgcatagggaggtcggcaagcaggggaggggctggcgggtggtcggccgagcagaggaggtccgcagggtggcgttctaggccctggtcatcagcggacggcgctccagcggcggcggacgatggggacaacactacggtcgacgataatcttcacgacaagaaggaggcacggggagaggtgtgaggtggctaggaaccagctaatggaggtcgaggctcgtgctttatagcaagaatatagccgaggggagccagggagagggagaggcgcagcagcgacgccattaacgacgttgcctccgagtgggagaagtaggggagagggagagggaaggtccggtgacatctggtccctggaggtgagcagccgacccgggaggcgacgggccgagcgcgggagacgaggggggacaggccgcaaacgcccaaacacgggggccaagcggcatcggcgcaggacgcacgcacgtcacgcgcgtccgagcgggtggagagaggaggggccgcggggtgggccccacgtgccatagagagaggaatgaggaaaagaaggggggcaccgtggctgggcctggtgggcctcggtcgggctttagcctgaccgagcggtagattatgtttttccttttcct

SEQ ID NO: 454 - DNA, 1633 bp, Zea mays
  misc_feature (1)..(100): optimal_loci_253410_G1, chr7:104281692..104283324, Cluster 3
aaaacaatgtttatgagtttttttattaaaaaattagctactagagacttaattgtgaaaactaagggcttctacataattatgcatataaaccgaaggtcccaggtgtaaaactacttagcctagactataggtttaaaatccaaagatctcggggtctaaacaacaaatttcaagatctaactatattcaaacttgaactgcgtatgactgcagagctaaacccgaaaacatcagggtctattttgaaaaccactcgattgttataatatgggtacgccctggaccgatcattccccaatctacgaccaatatcgaatatcctgaaccagttgtccctattctaatctcggtcattcctactgagatcaatagttgaggcaccttcctctatcagtggcaccttggtgatggtgcgcctaccgcagcggggtgcaaggtgtgctggcaatacagtgtgcaaactcagtcatgggggagcacaaaacgatatggagaagatgaaaaagcagtgggggatgctcaccagcgacgacgacgaggacagagccgaccatagcgcggggtggggcggcacagtcgaagatcttgaactcctatgagggaccaccggctatccgaacgatcttgcactcgataaacctcatgcacatgctcctctcgctctggggagcctcctagctacactccgaggatcgctttgttgacgacgaactcgataaacctcatggacacacatttgagttacgatagctttgttgaaggcgagaactcatggccatggccgcacgtgaacttgatggcagatgctacaatgataggatgagtcaagggagatgttttggctgggttatatactcacgaggatcgaatccatggcaagcggagctcggccagggcttcacgactcgaatagagagatggatctgaccactaggtcccacaacacacagcagctgcggcgagcgctcatgtgcggggtgtgtccccgagagggaaacagattgaccaaaaatacgcttttggcgtggcgcatctgcgggcgagcgactggcagcacgagtggggttctgggtatgggcatttcgacccatgcgaccgagaggaggtgcgagctaggtcggctgagagagctggctcgcgagtagaggaaggaattttcatttttactgtatgttttccatgttcaaatttaatttcgaatccaaaataaataattcaaattaaaataaacaaaacaatgctcgagcatacaatgcataatatattttttatccactcatttatttgtttaagaaaataatttaaatgaatagtccacacaaaagcactaattcaagtaaatatttttggagaactttatttaattctcaaaaaaacttgggtgttacacataaacactttacaatttgtttcacaaaatgatttggaaagccgaatgattatgggatcgatcgatgaaagccacgtccatccagaggatcggcctggcagcgccgaggcgtccgcaagctctggtgagtagggattgtccctcgccgctcctcgatgggctaaactatgcccctggaatagagttgcaacatgttgtttggaatagatggaaccttcgcatccatgaccaatcgggtaa

SEQ ID NO: 455 - DNA, 1738 bp, Zea mays
  misc_feature (1)..(100): optimal_loci_254110_G1, chr7:107836751..107838488, Cluster 3
ctctccagaccctatatcccctgacctcaggaaatgaagaacttcaacattgactatggttcatacaatggcgctcctggctaagtctggtagaccacatgacatgacatataaaagtaagtcccatggctccacacgccctaggtcgcttgccagtctaaaccctcaatgctccatgctccccaaaagcctgatggatgaagcctcgcgggccactcgcgtcccaggatacttatcagtataagctctcgaggtccatcatgctccaagacatctattagtagaagaacctaggacccctcatgtccaaggacacctagcggtataagcctttgaggcccctcattccttcacgcacctaagggtacaagcacctcgggatcctcatacactagggcatctaatagtttaagctctcgaggcccctcgtgcctcgaggcacctaattatgtatctggggataatggaccctctaaaggggacaaggatttagtaacttacttggattgttctagggctaaagggtatgaagggtcctatggtggcaacatgtcaccaatacatgtagacatgtaccccacatcaataagacttaaagattgttcgagtgcgataacttaacaaataagtcttaggtacaacatattaaatatgagatgaacaacattattgatctaacatggtgtgcaatgcaggcacataaaagtagcctacatggcacttgaggcccctaagaagtgcatgcaccaaccctttaacccaaaaaatacacgcatgttgtacctaaaagtatgataagacctaaggatcaatattagtaaccaatcacttgtggtcaacatgaatgctatgtaaaggtcgatgtcatagacagtggcggaggatgcgagaaaatcaaggtgtggctcaaacagtgtcacaagaaaaaattatatcgcaattgaaaacaaaagtatcatattaaaatgacataacacagttgaaaatagacaacaaaagcaaagtaccctatataaaggaagggatcagcgtacataattttgatcaattataatatagtactaaaaatctacaaaaaaataaaaaagagttaataattatataactttgttttttacgattaactttctcactattgtcttcttaaacatgtgtatttctggaacatatacaatctcttcttccacctctacttcatgttcatgataagcttcaacttcactagcctgattacttggtccacttcccctacaaccttaacgaaaatagcttttcaaatctaacaattatcaatcatcaaccatgtattagactctaaagtaatcagttgtggaatcagagttaataatataggaagggatcgacgtgcataattttgatcaaatataatatggtactaataaaaatctgcaaaaaaagagttaattatgatacaccttctattttttatattaactttcttaccattatcgtcttaaacatgtgtattttctagaacatatgcaatctcttcttccacctctactttgagttcatgataagcttcaactccacttgttcgagtacttgtccacttccactacaaccttaactaaaataacttttcaaatccaacaattatcaaccatcaaccatatagaatatagagtaatcagttgtggaatcagagtcttaacattaacaagtgcacactataaaaagtaagaataaacatttttgggcatttttttctttgtct

SEQ ID NO: 456 - DNA, 1763 bp, Zea mays
  misc_feature (1)..(100): optimal_loci_255563_G1, chr7:115703232..115704994, Cluster 3
ttgtagaccgacaacccttgtgggacggaggagtattataattagaaaaccgaatcatcgtcttaggctaatcacgaaaggctatttcataacacttttttcaacactgccacatcatcaagagtgtcataaaactaagaatgaaacaatatctcttaatgcaaaaatctcacttcactatttcatataccaatacaccgattaaatactgcaactaaatagccaataaaaatcagtaaaatatgtgaagataaaacaaatcacttttaatggaggtttcacgtgatttctaagaccttggaaatgatttgacatggtttcatctcatgaaacccgtttatcttagataatatgccatgttatctaaaatagtgatgtgatatactattaaatgcacatgaaatcatcataaagtaaaactaccattgtgagtagccttagagacatcattagcaagttagaatttcgagacagccccaaaaggacaaacggttaggcggccccgaatgcgaaggcattttgcctgcatccaacgcgtcgcgtccggcgtcccccccgtatgggcgtcacgttgtcgctcttgcttccccagccagtgaatgcagacaggcagcccatcacgaggcggcaacaacaccagaggttccaagggagcaaaacttcaaagaatgggcgcaggacgctctcatgccgacacaaataattgagcgaggacgctgtacgaccgctcctccgccagctccacggcgccgcgcgccccccggccccggttgtggcatcgccgttagattttttttttggtgcaaaagacgagcattattggcttggcccgaaggtgacacgcacgcattgttcttggtcccagtcacgggacgcagatttcgtcgacagcgacggcggtggttgctaacgccagccttgccttgctgggcggcttggatgacatggctatggctccatcacgcgtgcccacagcaccacatggcggccccacctgctctcctgtcctgtcgatcggagacgtcgtctgatctctgatggtcgttcatcaagatacttgattgattctctggccctttggatctgagttctgtggcccggaggcggaggctccgagctgtgtgtgtatgactgtatgtacgcgagagagaagagagtaacagacgcttgaatcgtcgcaattttctatgattgtcgccctgccacgcccacagaatctaaattattagctgtttcagtatccaggtcactattagaatgtatatctcatagcaattctctgtttttacggtgtttttgtttatatagattacagctgcagcagtatagacggtaagcgaaccaccccgagatcaaaagaagagccttaaacggtggatgcttttcctcatgaactgtctgtcctagtgtcctgccatggttgccaaagtagttggcagggcggcagcgcgcgtgtacactgtatccaatgaaacgtggacaccaagcagcaagggtcgctggaagcaaccaaagggaaaacaaacaagggccactgctcaacaccttgctggtaggtgtagtgtaggttagcccggacgtctaccgtgactgaatcaagcaaaaggccggtaaagaacgatgcaccactgccatgtggctctaaaaccgtgtgagatcgacgtcgttggcagagctgttaaaacaactgctgcagtgctgcgtcgtcgtcgcaggtttaccagtaccgttgtctgaagctgcctttacgcggacaaataggc

SEQ ID NO: 457 - DNA, 2090 bp, Zea mays
  misc_feature (1)..(100): optimal_loci_256564_G1, chr7:120994795..120996884, Cluster 3
caaatgcgtgtatcaccaactagctatatgcatgcgcatcttttctgcaggcaaaagagctagccactagaacaaagctagacttcgacacttcaaggcgaaactggggggataacataaccatacatacagctgcatgctattgagccttgcaagatacgacggttttggcccactcatcatcatctgcccgcctggtctccaacgtacgtgctgctcacggtatttgaccttaaaaaaacgtggtggtagcagcagcatcatcagtacgtgatctctagaatcgctagcttcttcctcctactacgttctttttttctagactctagcagcatgcagtcttctagccagtatatatatatatatatatatactagatttctctagctagctagctagtgaccttaaactgcatctactctataactaagcatggctatcatatatccagcatgattattagctcccaaaaaaagttgtgcgatttgtatacactttctttagaaacggacagattctccttgtatgaggctgagtaagtaaggatgggccaggcgacgcaccaaaaaagaatggaaatctgggttttaacttgcagatgtgtggatgagctcggcgtggaatggacagcatccctctcccatcagaaccttgtcgaaggatctctaagatgatgagatgctttaacaacccgtgacccaactgctaactgattgcattgctcacgatcacgaagcaggatcacaagcgctaataagcgtgatttagtcaatctctgctccccacaacacatgtaggaaatggtcgctttgccctctgttttttttttttcttcttcgtcctctttgcatgatcttttataatggcgaaaaacgagaggcacgatagccgtgttcaggtgttctacacagtgcgtttagtagtggcggaccgatgaacaggccggctccaggagcttttgcttccctttattagagtcaattcttatttcagaacgaaggcgggacgacacggtcttccgtctccttcgctttcgggtagtaaaaaatgaagcttttacctactacctccgtcgccatcgtcgaaacgaacgagcgtctgcgccggtcacttgggcgtggtataggtttggttcacggccaaaagatgattcgtcctcgagtcacggctgctcaccatttctgttttgtttatatataataacaacttactcaccatgttttcgaaggacgaagtcactgccgaggttcttactaacgacaaattaaccaaatttttcaagaaaatcaagtatccaaacaagacctaagtgtgccaattatatctcgctggtccctaacaccagtggcggtcctaatattttaggggcccaagacaaagtttcaaatagagactcttcaaattatttttaatatataaatgttactaattaaacactcaaaatacatctaaaaatatttatatcaaatagtaaataaataaaaggatatatattatagtattacattaaaattttcttctaacatgtttagatattcattactttgttgatggatattggattacatgactaaaattggaccctataaattcgagggcccggcgcgaccacccctctgccccaccctcaaggccaccactgcctaacacaaactcattctactctggagtccagtctctggagtttgacctgaactttataccaacgcttcgttgcccccaatattcctgcatgtagctttgacttattgacgataccacggttcaaaaggactgcaactttgagaggaggatgagtttttgaattagttaagtcgttgtagaaaatttcatgaaccaaatctttttttcttgaatatttatgaaagtttcgacatgatatatttgcttacatattctagatattgatacttatgatattaaacaagtaccgttcgattcgctatgaagtatattttcgtagtatacgcacttggtgtcatgaacgttggtatatttctctttatcagatttaggatgatttaacttatgacaaaataaaatgccctcaaggacatggcagtaataaataaaatggcattactagtgtt

SEQ ID NO: 458 - DNA, 2144 bp, Zea mays
  misc_feature (1)..(100): optimal_loci_260963_G1, chr7:145244250..145246393, Cluster 3
atgtcgcagccagaaatccactttgatataacagaaatagctttgacacaatggcaacatagaagaaacacacagacaatgtgatcccaaaagcaatgaacaccgaccggatcagctaatctatagaaaaaaatccaagttaacaaataccatacttgtaactgattgagtcagatccgagccaaacaacccagtggctcctcctcgaaacaacctagggcgagacatgggataaattgagaggtgtgtccgctcaatggctccattagcatcatccttattcccaacaaaactacatccatttccctgttcgttgcaacctgaaaaccacactcctccacatagacttgaatagcaccctccaaatctcccaacttcagtttgcatccggttcaccataatgcctaattctgcttactcgctctactgattagagaaggtatggtttcatgaacaataaatatagaacacaagcaagtagaataggaaaattcagaaagcgtagtgcagattgcaagatttagagaattcattttaggcttgtgctttcaagcgccatggctcttagcttcaagcaagaaaattaaattcttcatttggcaagtttccaataacaaatttgaagtagcacaaactctaatcagtagtcaggtacagaagaaagcttatttttagttttcatatcaactattttatttttctttttgtcaagatcacctaggcgatgttgctgaaatattttcaatgacatcttaggtgtcatatttagacaaatttctgaatcttgatatttgtcatgcattaaaatccttatagttcaggcatagagcaggaaaaatgaacaaatcaagcatatctttcatctgtcatgctgtagaacatacaatattgtgaaaacgactaactgaactgaactctgaaactactgaaagtattgtgaaaatattggatgagtgcatcacctcaagccaatgttatgtttcaataactgagaaagctggcgagaggcagtatgctcccatgagcgcaataatttttagtgatagttacactattatcactggaaattattgtgctccaaatctcccttgaaacgaactgattatgtctactacaccatgtatttaccgtagtagagattggaaaataaaatggggtgattgaaaagaacattttgaataatcatgatcgactatagcagcatctactgcagaaacaacaaatctgaagctctgaaataagaggtggtaacattaaagaaagatcctcctaggattcagtgaaatggaagaactgattcctcctgaaggtgatcttcttcttcaaaaaaacatggacagatggccactccatattcttcttgacgcttcaaaatttacttgcagggcctagtgctagtaccagcatatcgtcttttcaaactggttcatgtgaggtcagtgttgtgccgaagaggaaaaatattccatcaacctctacagcactactacttggtggggtgcttgacctacttgaaatcctactgcttgttctctctgcaaaacctatcttaggttacatgggtgtaaaaccggtaataatttatttattcttgcttctctattaatgctcttttgtctctttcagctaaaaattaaatcagccttggtagctgattaatggttttccctataattctaaaattatagcaacggatgaaagtccataactttatttttaatcaacaaggctgctattttacttaactaaataaacaagtgtacttgctaaaacaaccaatgccgaaaatttagagagtataattgttcttgcagttctgtttagtagtaagaaactgttgcaatagagtaggttatctaatgcaatagagtaggttatctaattgttcttggagagtataattgttcttgcagtcttgtttagtactctgcctgatgaagcccgcattgcagtactgcaactttttttggtttggtaggcttgtctgtagctggtccagggagaaattcactcgcacgagcatcacaaaaaagtagacatacatcaggcacggaggcagcgattcctaaataccagcacaggaggagagggagcgaggcacgagagatgacatacctttggtggagccgatgaatgctgaattc

SEQ ID NO: 459 - DNA, 2058 bp, Zea mays
  misc_feature (1)..(100): optimal_loci_263801_G1, chr7:160613077..160615134, Cluster 3
tgcatgggcacagaatatgaaaccttttttaaatcgtttttcattatattttttaattaatagatttaatcaacaaaccggtttcatatacttgagattttttgaacaaaatcatattacttgtgctatataaaatttagagatttatttattgtacccttctttattacatatttcagcacaagcaacaaaacactaagcaacaaaacactagatgtatctagtctgaattcactaatgtaaacaaccaaacaaaaagataatgcatgaatctagcctgggcatgagaagcccggctccttacatacgtgccatgctagtaactaatcacaggggaataatgtatgaaaatgccaagttctccggaccgccaccctgtgactgaaaccggaagctgttatgctgccaactgctgtttctttttcgtttccatacccatatgtcaactcagcggcggcaatgctactactactatgctagttggattggtgatttcccgaaaaacggttagccttttgctagctcactcacctcagccaccacccatcaccaaagacgcaacaacaagctgggttgccattttgaagcacaggtccgttcgaaggaaaaaaaaaattgctccgaagagcctacacatgtacgtatgtgtgcgcgcagatcgatcaatccaatccaggtactacatcctacgtcttgctatcctggctgtactttgcaccgtgcatgtcggatggttcgaaatggacgctttccctctttcagcggcacacgctcgaaccgcgaggcgctcaattgctcaacctcaacctatctaaagcgaccaacagatgcgcccccctatacgctgctcccgttacgtgcttgcaaagcgaggagtttttccccctacgcttttgaactcccgtcacgtgtgtgccccccctccccataattgagcattttccaagtcatcatcgctggcgtaccctggaatggataagcatggcccttgaactagatgccgagatgcggcactactcactcacctgatagttttgtcttgtcacttgtgtttagtactgccattaccaggtacaatattaaataaagtggaagatgatggttcgttagaagaaaaaaattcttacgtttaaaagtaaaagggtgtttggttactaaagtttagaccgtgttagattgaatgtttgaatgcctattacgagtattaaataggttcgtacttcgtattatcatttagttctcatctgtataattagtgttttaatttagactttatttaatatttctaactaacatccaaacattcgatgtttaggtcccccccctaaccaaacatgggttgtagaggaaagagaggatcatgaacgaattatatgcgtcattgtacaagctagatctagcttgtttggagtgactgtaacattagttggttcctcttcctcctaaaaaaaatactgtggcaatagtgttgggtaccataccatttcggttttcgagagaggaaccgtgcatggtttttagttttaccggctctgtgctatttttacatattactcaaactgaaagtatttttttattcgaaaaaaacaatatagctacttttacaggatggagaaagtattccctacttattattgatcggaggcaaccacgtggtgcgtgtcagatacacgctttgctcgctcacggacgagaagcccagctgccacgtggacaaagaatggctttgccttgccagttgccactccatctaaagttccaaaccaactggattttgctgggtattcatgttgaacagtgaacgcagatccaaactcactgcatccagcattccggcccgaatcaattactgaaagtagatatcatccttggaccatggaccctttttttttttggcaattgtgtagtatgtgggacgggtgcagcgggggtaaacttgtcgagttcattcatcagcgtcaagcggcctacactccacatggcagcgtagcagggggggtagactcatctgaatctggaattcggtagctaaggatcattattatgttattgatgacg

SEQ ID NO: 460 - DNA, 1675 bp, Zea mays
  misc_feature (1)..(100): optimal_loci_264752_G1, chr7:165734535..165736209, Cluster 3
gcccgaccgtgctttggactaattttttttaggtcaatatgatacaaaataattttggactaggtcgtgtcgtgcttaaatacttaaaggtaagcctgtcatggcccgaagcatagcgtgccgatgatcatgccttaggcccaaacacgtcacgaacaaaaaaaacttacatatatatctaaaaaatacatctttaaaatatttatagttttgctatagactaaaaaatcatatgagaaagtgaaacggatattttctataacttttgtgaagagataaaacgtgtctcacatctctcgtgccgtgccagcctaattgtgttccatctagtcatgtatacactgtcctgtcgtacattgtgcctacatttaagacacggcaggtccgacccattttccttcgtggcgtgacgttgttttcgccgtgccgtgtgggacctaaatggccagggttctattcgcgagcttccgctgggtgttaggtcgtcactgcatccacgacaagctagggcagcagcagggggccggcagcattgctctcgttccgtcgccgccaccggcagcagcgacccgtccactccactatagcctgctggaaccccggccgaactcgcctcagtcgacgacgatgtggcgcggagctttctcgtctcgtacggcggtgctcgccttgccggcgacaaagggtgcggtgtgatgcacgcaagctaggcgtaggagctaccaccacacgctaaggtccgtgcatggagaaactgctacgaaaggactaaagcgcttttctagccggccggtgcttgtggtgttctcgtagtacgtagacgcgccatgattatggtttcttcgcacgtacgtagtacatggtgacaaaactgcatgattatagttagcgtaaatgacaaaagtgtaggctagctagctaccggtctctaagtatgcagtggaaaccccggccagtaactttatcaaaggcgctactaggtagggggtattagacgtacactggcaatagagagtgtgtgttcgtcaggccggagatcgagcaaagtttgcacaggagcgtacataaaaaaagagaatgcgcgtgtttagggttataattgcgctcactcggccggcctcaaaggcttaaccatctctactcatgcatgtgtgcgcatgagcatgtctgcatatgtcgcctgcagatcgaccgacctctagctagctcccgtcccgtgtgcattgcatccctggaggctgcagcggcgcggtaataccagcttccgtgcttcacctctcaaaaggcgcgtgtgtttttgcgttgtcagttgttcgtgttagaggagctgctggaggcctgttcctgacagtgtgatgagtgagcccaggctgcccagctggggatgtattgcattgcagtcgactcgactcgaccagcaggtgttgataaggctgcgtcatcactctgaactaatccgctctttaccggtatccaaggcaaacaaactacaagctcttgttcagcgccgccttgctttgtttggcttttgcgagtacctaggagaggagaaaccggattccgttcctgtctcacgtgtgacgccagctacgcatcgcgtgcgcccatctcggcacaaacatagatcacattttattagcacatgctatgcacctagctacagcctatagggccc

SEQ ID NO: 461 - DNA, 1547 bp, Zea mays
  misc_feature (1)..(100): optimal_loci_265082_G1, chr7:167621545..167623091, Cluster 3
ttgtacttgctcttagatggagagaatacgtccacaaatttcgctcagcattcatatacgctctacaccagaccatacctgagtaactgatgatggtacgccgcaccagaccgtctgatcaatgcgtgatttaattaggtcagcaaatggcgatccagctccggcggtctgtagtaacgatggataggaagtgcggctgcatgtgcggtgcctgagagtatctccaagactgttactgtctcatactacaaataaaggagtactctagagaagaactagttttttcttttctcccgatgagactatgatctcatgtgtgtctatcgccgatcgggattaggataagcgcatcgatcgcaccgtaccacgataacagcacaagagtggtctagcgcgagcagctgttactggtgcctatagcccggtagtaggactccaagtacaggcaggcagcatgcatgcatggatggctgtacctctgtctgccctgccctagctagcagcagtagacgtagacgaagaagaagacgacctggtcagccggccagagaatgaatgcggtgcggtgtagtgtaagccaccagtacgaccatgcggcgattcatcagctgctggctgctgccatggatgccactactgctatgctaccggcagagcacgaggtgcctatccaagtacgcccgcccgcccggcacattccgcgaaactgccatcaaatttaatggtatagtactcgtgctactagacatcactattattgtttttttaggggggataccggtacgagtaggcagttcttttttcaggcatgggcctttagatatgatatatttcgagctctgctcagccagattattttccaggcatgaaaaagaccatagttgaagaccacgcttcaaaactggcagtttcgcggaatttatgatagaggaagacactgggctccgtccataatcatccatcggcgacaaagtttcttgtacattgtacacatgtaaaacaatcacaccaccattttctgatttcttcgtttcagatttcgaagcattgtaaaatcattttgtgttggctttgctgactttgtctaccttgttgctacgttcagttgactttgttttgtaactgcttcaggaagggagggacaacgtttcccttctttataagctgatttgtgcagtactccttatgttctagctttgtcaaacattactatcttttttaaaaaaaaatcacaacatataaattatatattattaaattatttcttacagtaaatctaaatatatataaatattataacattccgcgaaactgccatcaaatttaatggtatagtactcgtgctactagacatcactattattgtttttttaggggggataccggtacgagtaggcagttcttttttcaggcatgggcctttagatatgataatattttcgagctctgctcagccggtctccatgaaaaaaagaccatagttgaagaccacgcctcaaaactgaaaatacagcataattcaggtttcctccctactcgttgtatat

SEQ ID NO: 462 - DNA, 1652 bp, Zea mays
  misc_feature (1)..(100): optimal_loci_265209_G1, chr7:168270370..168272021, Cluster 3
aacctaagtctcattgtgtcaagtccaagctagatggttcatacgccaattggcaccacataccaagcctacaattaggacactgcaagaaccacactagagatgcattctaacaaatcactgtttcactaaagttgccctttgtgaatattccttagggaattagcacaagagcccctcacaaatgatgattggagccgacaacaatctccaatagccgctcaacaatcccacaaactctaggccatctagatgatgacatcaccaaaagtaacatgagtataacaagcccaagttgcttgactagtggcacaagatgcgaaaactatttgtgatgcactaggagctttctaatctcatccaaatgatgatctacaagaacaattaagtgaagtgtatttatatagtaccaagaggtgttcacaagtgtttggagtgcaagcatactagccaaggctaaccaagtggtctatttatacacccacattcaaatccaaccattacctcttggtgacccaaattgggggcaccaaacatgtctagtgcaccactagtgttagcagtagacacatccattgctcttctagtgtttataaactagaagttatcatctatcaggtatacacatacactagacacgacatcaaacatgactgatgcatattagagttgttgtgcacatccttatttggtgtggtatctagtgacctttagagcacatgtatcaaattacatgctctctgagttgtttttctagtgtaccattcgattctacacatgatacatgtgttgaggcacattaagtgtacataaattccactgtgctaggacaaaactatgcaacatatgtgatcttgcctcatgtctgttgctcatatgataggacctagatgactaaagaggggatgaatagtgtataaaatcatcccgcaaaactacacttatcactataacaaagttgaatataaaaatgttaggggcctagatggctagagagagggcaaatagtctataaaaatagttttacaaaacttacaataatgaatagagccaatatgtttgaatatgtggaagtatttgcttgctctagttctaatttactctaggatatctcttaatcaactattaactcacaaaagaattgtatgaagaagacatggtactcactttgcaagagaaaaagcttagttgcaaactacacgggaactagataaacttgtatgatcaatgagtaagtgtaattgcaagaaaagtttggagcacaaactacatggggcaatatatgacataagatttatcctcgaggtttggttgcttgcaacaacctatgtccttgttatggcgagtctaaactaggtggttcacatgataattggtatcgcaggccaagcctccaatgagtcttccataagaatcacactagagtggcactacaacaagccacgatttcacatcatgaactctaaacactaatttatatagcatgctaggtccaaattaggtggtttacacgctaatttatataatataccaagtccataatgagggtgtcgtaggaatcacactaaataagtactccaataaaccatgatttcactatatttgctcttcacaaatctcccacgaggaatgagcaaagatccctaacaatc

SEQ ID NO: 463 - DNA, 3547 bp, Zea mays
  misc_feature (1)..(100): optimal_loci_265551_G1, chr7:170127188..170130734, Cluster 3
tagagaaggaaaagttcagaatcataaactgcaccaaaatgtaataatcctactttcactaataaaaaatttcagaatatcaaatataccaggttcagcatcaagcgggcagatgttgtatgaattataagggtcaaagaagaatcatgcatattccgagagaacaaatagatgatccgtgacaactgcaataagttgaacttacattagttcagcagcaacatgatcaacaccaaggcataaataatactgataagtggaactatgtaagcctttaaagagagatttatctactaaggatcacagtatcattgaagtgactaaatagtcgtgtaataccacatgtattgaagtcatatagtagctcatatcatatccatgaaagttatatagtagctcaacaccaggcagagatctggcaagccacctagctttactaataaatccaatgcctaatgcatgtctcatccataatactgtttggatatggtctggtgtctgcaatgaagaaatcagataacagcttcgcttgccaaggtccgttaagtgatgcatctatcctaaaattcccaaaggatgtgtttgggtataattatggggaggggaagggggcacaaaagtgacagctgtacatgcaattttaacaaatagaatgctaacccaaatctgtaagcaatataaatgatacaagaggcgagttcaacctgtggaagagaaatatcttctcgaacataatgcaccaattcagcaagaagggtgtaagcaagaggtcttaaagtttcgatgcaaactcgacctgtgccaatcagaaccctgacacgccaaaagtaaggtgtcaagcatgactagaaactctaagagttaatacatgtagaacaataaatgctacaagaatagtaaagggaaacaatacaaaactgtcataagaaaacgacaagacatcgtgaagggatgaagtcttttgctaattacaattccatagtaagttcctgaaaagtacaactaaaaccgattgatttcgaatagatacaaatcaggaaaggttgtgtttttaaacaagttcatttactccccttgaattgtcacatgagtggttttaagtatgggcagttatttgaagctattttattgttgatgccttgatggtgaaaattagactcctcatatttcaggcagaaaagtagacctggttcattagcatgtgctgttcatctttgcaatacccgttaggtcaatggagaaaatcttattaacttttacaggcattctttatcgtaggattattcagcctaccaaaagtaactaaaaatagcaaaacaccaacgaaaagaaggggaaaatagattaaatgagttgatcataggtcaaaatgaagcactttggaaagttaatcagtttaccagttacacattacaaagcaagtacatagtatcaggaaatcaagatgtggccatatcaaacttaatctgaatgagatcccagaaatagcacatttgaaaacaaactagaaaagttggatcacggaattgatggaaaaagaaaattggtttacctttcatcaagaagtgtgtcaatcaaggggaacagccctcgcttgtactcggtgttgagaacttgtttcagaccaaccaatagctcctgaaatccagtgtaagagataaggatattagcattttcaaagtaatggtcatatagttaaatgatttcaagaaagcaccaggtcgtatcttgcctttctgatggagacagaatcaggaggacacgtaacaagcaagttcacaatgctcttgcatatgctttcctcatatgactttatgtaatctgcattgctcttcaggaggtacgtcagaaatgacaaggtctgcaagaaaaatcatcaatacatcatgaactaaaagaaaagcaactaaaaacaaaatctgaagaccgaccttgacctgtgcaccctttaaatcgttgaagggtgtcttaaggtgtggcggcaccttgtcgggacccttgatagagatggccgccaccatgagtggcaacaagtgcgggatatttgtctgcacaagctttgcatacaactggaagagaaacatcacaacaagagggctctctgtgactatcttgaaggaacgtgcgcttgggttgagttgaccaccaccaggcacttgcatcatgactgaggcatcggcagtggggtccaaatgctgcatgggcatggaggcagccatactggcacttgtgttgggattatcgaagaagtagctaacggttgtgggaaatttatggtatatgttaaccacaaagtcaagaaatggctgcacctccgcctcgacagtagggcggaagttacggaggaggtcaaacacaattcggatggcaaggagagcattgtcctcgttgtcctgtgtcaacacacggagagaaagcttgagcagatcctgcacaaatggtctgagcacctcgctgtgtggaaggcggttgagtatctcgatcacaacattccgtagcttgtgctcagcattctctgtggcctgtggcttggtgtaagcggtgagaattgctgagaaggctctgaaatagcagcgaagaaagttgaggtagtctggagtgtgcgtcatctccaggctgtcccgaacttccatggcaagctgcagtcggacttgcacagctgcagagtattagaggaaacgatcagatcaggccatttagatagataaagcattatggtttgaagcgaagattgtgcgcgattgttttgcaagacaacatagacaagacttatgtttaagcaaaattcacaaaacaaagtgccggagtgatagtgacaagaggaaacagcaagaggcatctaatgtcctttaaatcaaacgacagaaaattctcaaaagctcaccccccccccccccacccacacacacagcacccatgggaaggaaatcagtagtcgggaatttacctgcgaagctacaccgagaacaaaacaaacgcaatgggaaaggaagtcgggacaggggacaggatcacaggacgtacggaggtcgggctcgaggagccgctgcgagtgctgctccatgttgccgctgttgatgggcgccatggcgggcgccccgcccgtgcgcgtccggctccaaccttaccgcgccagagcttagggttttgaagatcggcgctgggaagactccgcgagctgggcggaggagcggatggctggaggtaggaccgtaagagtgcaggggcaggaggcgcgggctcgtttcccccgacgcgaatggcaaccccgtgttatggactcggaggaaggggtctccctcgcgctcgcgagccgagggtttggggtgggggtagagacggggacggacttggaggaagacgagggcgatgggcctctggttatacaaggaccggtctcgaaccattccctcttccaaattctctgattccaaattcttacttcctattcttatttcaatattttcatcttataaatcattatctttatctttactactctataagggtgtaacatagacgtccacatgcttcaccgtggcttcgc

SEQ ID NO: 464 - DNA, 2454 bp, Zea mays
  misc_feature (1)..(100): optimal_loci_265698_G1, chr7:171012014..171014467, Cluster 3
agcgcgacacatagcgccttttatgtaatgtacatggtagcaatatcgtgatcgagacaatgttactcaagaccaatcatcgacacgacgtatatctccactacaatgccgaagctcggtctcgtatatactgtgagctgtcgcgtgcctgtggcatttagaagctttggtggtgtcacttgagagggtcatgtcagttttttttttttagcatagatggtgaagaaagcttgggattagcattgggaaggtagaatttgtagtgaaaggttccacacgccaaccgagtttgttgggaacaggaataggacatcagttttcgttttggcgtgtttcgatctcccacgctttgaataatgctgtgtgcatgcaagatcaaatcatctggttcaaagttttgggagcagtttatacgagtgtcgtgaaatttgcactcgttggttttagaaattcatcgtaaggtctcagatttccagttttttttatcgtggtggtttagaagaatgctgacatagctttttaaaaaaatgttacaatagagatctttatttttttccccagaaatgcttacaacggccatcatcatcacccccaccacccccgcttctcattagccatgagacgacgatttgggggttggagcgtgagtggttactgacttgttcaccacggtgggttttcaccagctggtgttggcgcctgtcatttcaatgaatcgaggcgtcaaaaaggctagagagttgggggcagtaccggctaccgctgtccctacgcccaattagcagccccagccaactagttaaccatttctcggcttaatttaagaggcctgtctgtctggctgtccgcgaggtggcggactccgcctcttcctctcctcggccggctaggagccccagcccccaggaggaggtgaggtcctcaacagtaaccaagcaagctgcaagggcaatcagctgcatcctgcagaaaaaatggcaaaagccctcctctgtcctctctctccctcaccgtcgcccgtcgacggtcggcaccaccagtaccagcaggcagcagcagcctatccttcctatcttacctggccccaccgccctacggcactaccgcacagtactactactaccttccaactgggtccgtctggtccggtgtcttgtcactgtacctcgacgcacctgccagccagcctgcctgcggtccagcatcctttgttgaggcgacgacctgcatgcattgcagctgccagtggcgagaagctgcagcttgcattgtcggatgctagcttcagcctgctcctcctaatcttctggacccctgtaggtataagcacctactggttagttaaaaaaagtgttacgctaatgacaccgcccctgattgttgctttatatagctaatctgatgaccctagcaaaagctcaatcaaaggaggagaacggagggaaagttgatattctcctcaagtatacaatcctgctcagcttgcattgttcttgccttcttggctgctgttcctctgccatgcagtactccctgtcctccatctgcagcattaataagcggtacttttccccactctgtcttgtctggccagggttgacgtttgaattttttttttaaaaaaaagatctcaacgtacgctcatctggtcggtgaaatggaccggcaaacgcaggaaaaagcgcgccggaaatctaatggcattgacgatttcgatcgctttgtcaatggcgttattcggacacctagcagtacaacaagaacaccctcttttttttcgggtgggggttgttcggaacacgcatgggtctctcacggttaggtaacgtactttctgtaatgatgtgggcaatggaactttataatctacagctcgcgcacgcatggtttgtttccgataaaatcaagatgtatttggttcggtgtcaacgagtgatgagacaggataaactctgggttgacatcgtcccttattttttgagggacgactcatccactatttttgaagaatattcctttaccctgactttagacctccaaaccaaacgtgggtcaacttaaaatgatctcaccttatccctcttcatcattcctcattcatccatccaaacactacccaagtagccgccagcccgccacacacaaaaaaaaattgatttgttcatctaaaaagtgcaacctttattgttttgcttggtttatccttacacctgtagctgtagcgttttccttggccggtgaaggatttgactagttctccattagctgatgctacaaaataaatatatataaatagataggctaaatagctagagaggtcaagaaaggaagaaagaaatgagtaggacacgaggcgaggtcaacagaccagttcttgtctggctagcagtatacgcgactgtagtgtggtgcatccgctcttttttttcattacaaaaaggaaacggttgtgtt

SEQ ID NO: 465 - DNA, 1589 bp, Zea mays
  misc_feature (1)..(100): optimal_loci_265700_G1, chr7:171015340..171016928, Cluster 3
agagccacgcacagcacagagaacgatggcaccaccggtcacagcaagcacagagaacttgcgcacacccacggtcccagtcccggcgttgcagtgcaggagcgacaacagccgagcagccatgccagcgcacgggcaatgacgggcgtgtggtgtggtgggtggtcgcccgtcggcgtcacgagccctggctacacaacactgcacggcagccccatggatggcgagccccgcccgcgcgcggtagggacggccggacaggtcctgccgctgccgcgcccgacacgctgcagtcccctgtcgtccccatcctgccctcctcctcgtccgcttctcccacccccctcgcttcggctcggtcgcatcgcatgtggcatcatcggcaagttgaggtgcccgcgggggcacacttctgcaccgcaccgtagtgttcatacagaaggcccccaatcgcttcaacgggtgacgtgtagtaccagtctaccaccatctcgtatgcctgacagtttcttcagaatgtcgaaaacctacagcggcacagtgtgtactaaatatgctatgcatgtgtgggcatagtacctaggctactatattgtcctcggtgagcagtgcggatcctatgttctcagccaagccaacagtgtggcaatcaagaccgagacaatcggaacgattcgaaccacaaacaactgaacaagccaccccgacatgaagattgctttccttttcttcttcttattttggcaaaataaatgaaggctttcttgtccacccacctgacctcgtcgctctagtttttaccaaaaggtgctacagccgcgcgctgtcacgtacggctacggcacgccggccgcggcgtgtcaacggcgccacgtgacatgtcctgctgcctcccctcccgccatgcgtacaggacaacaatgccgtcgcgtgagtgcctgccgaccatatccataatctcgatcggggtatgcaggttgcagacacgcgtcgtcggagatgcgacgcaacgagaggtcctcgtcgttgcatgcgttccgccggacacgtcgtgcacacagctagcaccggcacaaacaagcaggtttactaccgctatatttatatataaataaaacagatccaatatatattcctctgatcatactattaaaaactgaagaacacaatactatcgcagatccagccagatgaaacgagcagggacgagcagcgacaggtttggccacacaaacaattactgtcacgttaagcgcagcactgatgcggaagtagccgcacccgcagaaatgtcaatgcatagcaggtatacatgtccatactggcagtggcggactcaggatttagagtgtgggtattcgaaaatttttctaagatgattatttttaaaaactgaagtttttctactagtacacataggtaattatttgtatatataacatataattaagtataaacaatataggcataactgattcaataactagttatcataatttaaaaattctagaacataccataatacaaagagtaaagacaaataattgtttcatatgataaaatgagaagaaagcttacaaatcacaatc

SEQ ID NO: 466 - DNA, 2192 bp, Zea mays
  misc_feature (1)..(100): optimal_loci_265861_G1, chr7:171902033..171904224, Cluster 3
ctggacggaactaatcaacctggtttagaatctgatatagcttgttagagctgttcgtttatcttgaaccagaaacaaagtcgtctggttttaactcctctgcctcaattcttagcctaagatgaacccaagtgaccaactatctgaattaattcatatgctgaaagtgggctgccgatcagaaatgagtgacaacccaagattcactcaatcctgggctggtttggttcccgcttggcttcaaccctggcctgagtagtagagtagctacggtcaacttcaatctgatgtactttcaagttcaacctatccgatcacaatcagaggtggacctgaccacacacactaaaaaaaagtttagtgcatctatcaagcacggcaaataccaataactaagtccatgagagtctagtgcacctgaatactagatgcttcagtcttggcagttggagcactgcaaccactccatgatgcagtcctacaactaaccttgcttggcatttgatcggtttgtcttgctgtgctttgtctgcgcgtgcgtacgtgccgagaacagttagcatgacaggtacaccccgttcgttgcagtagttggcctgaaaggaagctcggtaaacgaggaagtggaaattcctgacgaaaatgacataaggatttgttcgttatttctatacatatagattggatgtaattagaaaaattataaaagaatttgacttgattaaaagttaaactcacttaaccccatctaattcacatggaattgagagcaaaacaaacaagccataactagatcgagccgcgtgaaatcaaacccatcggctagtggattctttccgtgtttcaaccaaacattttttttatcttacagttttctgtaggagtattttggacccgtacgattcaagatcacgaggcattcattccttttttttttattcccatcttccgcaatcagagcccttcacctggaaggggggaaaaaaccacaggccattccttggattcaggcacggtgcaccttcttgcagtgccagtggggagggtttccagcagcagtagtgcggacgaatcggcgttgtcccccgctgtggacggtgtctcgatccgtgctccaatggccgatcgagcacccctgggctgcctgtgtgcattgcatgcagtgctgcagacatgtccgtctcttccaaggcatccttcttcacccactccctctcctctcctcctcgggattcaccccatgacaaagtttttccagtcattgaaaagaaaaaaagacagatggaatggaagcatgactgcacatggtgttgtgagttggcgatcgaccttctccgctgttcgtcgttttctcttggatctttctgtttcctctttcgtcgtcgtcgtcgtcgtcaataaacactcgctgcagcttcttctgcggctgcaagaaagcaactactgcatactgttagcttctactgtttcagactgatcgtctcagagagcgactgttgcgtgtcaaattaaaggggaggttagcattgctttcaggctttcagctctccctccatgacgcagcaaagaaatgatgacagcagagtacgtagcgcacacacaacacaacaggaagaatgatcaactcttgtacgttcaaaaggggctttgatcccagttttccgtcgaaaaggggggcatgtcatcgacagcgcgtacatacataacataacacagacaaccctgcttctgtttgttctttttgcagttttgataatcgtatacatgcaatgatcgatcggcagcccctgcatgcatgggaatcgtatacattgcagtgatcggcaccctgtctgcctgtgtctccttccccatgagacaaaaaaccaggtgtgtgaagggcccctcagcttttattcttttcatggctgatgtggtcacatccctagggaaatatacatagaaaacacctctcaagaacccagcatgcatgtataaaaagaaaaagaaaagaaagcgtgcacaaaagctacatgaacaaatcatcaccccctctgataagaaaaaaatatatatcatgggaaaataacgccttttccatggatgtttggttcacgtatttataatatgatgggtaactgataacaattcatatatttataatgtgataggtaactgataacgataaatcatgattatttaaattcaatcgt

SEQ ID NO: 467 - DNA, 1679 bp, Zea mays
  misc_feature (1)..(100): optimal_loci_266088_G1, chr7:172864579..172866257, Cluster 3
ttagaactgctggagtcaacttgcgctgcgaaaagaaaactatcgtagtctaccttgctagttgttaataacttgaccctagttcatgttcatgtaattttactagcatagcatgtgacgtttatcaggtgcctagatcattgattctttcatagcaggttagtaactgatatttctgtttggtagtagttatcaggtgctgtgtgaacttgaaatgtaccacaagtattcactaagtttcagatgttcttctcttctatctgatttcacaagtaaccactggcgtctctctggtttgtgaactctgtcttttgccaccatatggtttcctttgcttctaacctgtcttttccaccatgaaccacgtgggcatggaatggtccaatacaatgaatagacataacactatttgttttatggtcccaggttggacaatcagtttggagctgtgccagctaggcgcttggagttagaggggcgcaataaaaacgcaactgtgaagaaggttcgtcatcagcaagctgactagctagtgcattttgcctacaaaatccctttgcgtatacacaacggtggacgcctgcggcctgctgaaggcttcaggatagtacttccagagttttgcctcgagtaatttcggctacgagcatggctggctattagcatatgtaacaggattagtgaccaattggtttctgtgttggcttctgaaggagaaggagtgaggtagtttttttcttttatctaacaaccagcacgaagatactctgctatataatactaaaagttttcctataaacatggcgtcgatatgtccgagtggttaaggagacagacttgaaatctgttgggctacgcccgcgcaggttcgaaccctgctgtcgacgaaattttttgctcttttcttatttgtttgttgagcgttcggttgagcttttttttgtcttttttgttcttttcttattaattatttatttactataataataatatatactattgttgagcgttgggctgggcctgatttgtcgaactattcttctgtactgcatgtctgcatagcccatgagacgaggttcaggatcgtctcaactcggctgtcgcgggagtattacgagggcacagccgcacaaccaagcgcataggctcgtgtcgtgcggcggcggtgggcgaccggcaacaagtccgactggcactggggtctcgcccgccgtcgccgtcaggtcaggtgaggtcaccagcagcctgtgtcatcagtggattctgatgccgccatgagttgaggttccaagtttggtccaggccgcccatcagtttccactttccagtctccatacatcacacagtgccgagaaattcggtggaaggttcgcgcgtcgtcgtcgtcgccggccgcgctccgctcaactccgctgcgcccctcaactcattgatggtctgcggtacgacgtacgacgacgctggagaaacttccggggcggcccgcggccgcgacgcggactcccagagtgctggccggatggagcaccgcttcgggcttccctttccctactgatgtagtagacgcgtggccccaccaaaatcatcgagatgactacattcgcttgattccaatttggatgaccatattcatatcaaccgaaatctcattggcaaacaaatcaccgggtttaccgggt

SEQ ID NO: 468 - DNA, 1419 bp, Zea mays
  misc_feature (1)..(100): optimal_loci_266215_G1, chr7:173470903..173472321, Cluster 3
gaactaattttttctagtaaagtatcatgtttcatttcaaatatataaaaaaatcgatgtggtgtgacgtgtcggggggtcctcgaactttttctctggctatatttttcctttggtactcttggtagattggtgtctttgctataataatgtggtactatgttgacaaagaaagttgataagttttatggaacataaagagttttgcgaggatgaagcttttatgtacagtttttaagatatgagtgtgtttaaaactaatgtacatgcatcctccaccaagactagccttataaaaaggaaaacatagaaacaaatcatgaagcgggccggggcaacgagacgtgggtgtgtccgagttgccgggggcagctcaaccatcgactcttgatcgtccacaaaatgactcgctgatgaattatgagtggcgagcctggttgtgcacactcccctctgcgtgcgtgctttaattataaaaatcaaaacgttatataaaatggaacagacaaaagaatatacagatgcagttgttcttgtctccctccacaattaaacattgatgaccaattgacgtaatactattcatcatgaactcaaaagattggttcatacaaaccatttcggtacttggagatactcccggatttataaattaatactaatatgtagtacgtacgttaggtcagatccgcagtctcgatcgacggcttattactagttcgttcctgcctggtgtgtttatggtgagagggagacgcatcgcatgtagtccgctgttttggccgcttgccattggtcgacgacactcgacagcgacaacgtactctcccagcagctgccctgcgaattataatccttgtccgctatcgaagaatccgcctcctaatcgggctcgtttggtcgccatgcattatatatgcagataagcaagtgactcctggatcgattaagctatggccgggtgtatgtggagcaacagacagacaggggggatcgatgtgcatggcatggggcatgggcaggcaggctcacgcctactagtcctcctcagtgtcgtcgctttccgaaacggatggcgacgtaccacgtactcactgatgctagctatactagtagtatagggtacaatacactgtttcaagtttaatttagtgacaggaagaatccaattcttagctactaataaatcgtactgctaaggatgccagatgggatggatcccatcgattatacaccaacggatcagtgaacaatattatctgacacagtatatgtcggtgtcctgaatacgggtatctactcatgctatgttaaggtgagtcctcaccctcaggcaccgttaaggatttcacgggtagccggctcagcatggggctaaggcccaccatatggagtcatgaccaggtcagcctcacctct

SEQ ID NO: 469 - DNA, 1958 bp, Zea mays
  misc_feature (1)..(100): optimal_loci_266553_G1, chr7:174880963..174882920, Cluster 3
tagtcccctccaaagacaaaatctgttggcgatgccaacaatgtcctcttttccctcgggggctatcccctcttgctgaataaggggaaccgaggatacctcatctagtccgccttagaaatctcttgagtatttttcgatatccgaagatgatggactttggcaatctaatggtgttacacaaaaaaacaacgttcgaaagctccacctttatgccaaaatcataattaaaatcttcgctcggggcacgccccataataggaacatgcgcaagcagtgagtttagttgtacataaaaaatatgtctacccattaaaaacaatctaacattacacaccatgttcagtgacctcgctcggcatcactataaacccctttggttggtgaagtacccaacgctgccacaatcgtcgttgacaaggctgactatgcagccggaacaacgacgccaccatgacgacgtcccctggctgcctcgcctgaaaacaaacacaataaatgagcgcttgaagggtaataagcaaatgcaaatcaaataacacacctgctctaacttccttaagacttgttcagttaactctcgatccatgtagattgagtgagattgaataagtttaaatctcaaacaagtcaaactttttattttttttttaaatttcatacaatccatgtataataaaaataactgagcaagacgatcgatcgttcccacacgaagacatccacacatcggatctagcatttcttcactagctcgatgcatggtgaggctagcctcgctatacagacttcgatcgatcttgtcggtcatgaggcgatcgatgtgacttcacgggctagcacaccctcatatatagttaatcatgcttacgttggtaaagaatgtttagttttcggtgctctcacctaggagaaaccctgtcggtgcaaagacattgttgagttgccctagctaggtcagccaacatagagttgaaagagagatagcacaagtcaaaaccaacgaaattaaaggccggccgggtgtcgtcatgaccttgtttgggtgggtcgcctaagacaaatgaaaatgggatagaaaaatgaaaagagatttctgaataatgagagtctaaatccaactatctattcaaaccttctggctttatggctagaaacgaagttgcaaacctaaagagccaaccacagtagagatagatattcggagtaccctaccatgcatgcgtgtattcgatcggagccagcacaacatgtctttctcttggatgcatcttccgttaaagctccagacaatagcaccacacaagtagtactagaagagatcgtggtcagaatacacaagtgccaaattaagcttgttcagacatctatccagcgatgagctagcagcttaattagctactacagtacatgctagcagctaggaagtaggaaccactcctcctgagtcctgaaaactaactgttcaatggcttggcttgtgtcatcagattctgaacgcatcatctgcttttttttctattatcctttgagtggtgtggctgaagagcaatgctttttgtgtgccttgctttgcatcttctttggctttcctcttgtgtggcttcaggtgaatgcttttcccttctcatgctttattatcttccttcctcagtcgtagagctttggccttcagttggacttggatattctccatcatccttcaattcaatgcctttttcccggcttgcattgctagacaaggctgttatctcgtttttgttttagaaagcttccaccttcttcccaatatttaaaagaagttccaatgcaattaatctcgtttttattgtttggaagaatctgcaaggatttggtgtgtttgatttaactgaaatgaagggatgaaaaaagattaattcttatatgtcatttccatgactgcttactcaacgcgcttctagaactcttacagaaag

SEQ ID NO: 470 - DNA, 1857 bp, Zea mays
  misc_feature (1)..(100): optimal_loci_266996_G1, chr8:686231..688087, Cluster 3
tagtatttagtgggtgtcacacttgaaagttgtaaatctagataagatgttcaaatttttcattggaaataatttatggtcttaagtatttaatatatgtagtatcattcaattgtcaataggagagtatgtgcttaagtggtagtggaggctttgtgttacctaaggtatgtaagtccatcgagggtattaagcactaagtgtagcactagaaggatattatggacagtattaaccttaatactgtttcgaaagattttgcatcacaaaattcctaaataattttttttgtaaatcattggagcattgttgttttatttaagataatcataatagttattttactcttttttcaagtttattgtttcagtatcattatctttttatatgaactaaatatacactataaattatattactatataatctagttctcatataaaagaactagcttaaagcctcttactgtcttatttgctctaagggtgtccgcaatagatcgtataaaatattgaatttgcactgtaactttgtggtagtatctgactaatgtttttagaaaacagaacagatctgacagctaaagatttggaatctactgaatgctttttctgattttggcgagagcttttatgatatttaatcttcgttttagagtgtcttaaaggattaatatacatacgctttgttggagaagatcaattaatacaagatagctgtagtcaacaatagggcagcatgttatatagttcgtcccggaattgggaattgggagtttctccgttagttcgtccccagctggccagccctagctagctagctagcccaagccaatagggcacgtggtttaggtgctcgtactgccgttgcgccttcgatcgattgttgccatggctttaggagaagctagcgacagtgtgcaataaacgattgagaacgagagctagaatctacgatgttctgtcgtcactgcaggtgcagggacagaagaaaccacacaaagctgcaactgcaatgctaataaatcagcgtcgatctcgacgcatggcagcacatgcacggatcttgcgttgtccagaagcgtttgaaagtgttgcgactggcgactccaaagagtccaagctaattaggccaccacaccacatcgacgacgacgatgatcggtgggtcgtcagtatggatcgtcgtcgccgtccacacacgccgaattgaaaccccgtctccgtggtcctgtcgtcactcgccgtgaccggctatcttcttctcacgtcgatctggacttgagccaaaagtttcctacgacgacgtctgtgtgtgtggttggatcgttttccaatggcgcgcgtctgtgtctgctcgagtaatcaacgacgaccttggacctaccccatatatatgcatcgatatctatacacggtcacgtcccctacgtaatacagcggggcccgcgccgcgactagccggcagtgcagtgagaagctgatggatcgcggtgcgcgtggtccccgcgtcaatgtcgatacgtccacgtcgcccgccaagtgcctgtgacaaccggcttggatttaaggtgatcaccggagaagaaccgagaggctgagagggaaagactatttttagaccttctccggcagattacttatatccatatctatttaggtcttgttcggcaatctggaattctttcccggattgattttttcgccacatggattgggtgaatccaaaactttcacccaatcccttgtgagattaaatcccaaaacccaatcaaccaatgtttgctcgtttatgccatatggattatatcacaaaaccaaaataactatgtttgttcatttattccatgttgattaa

SEQ ID NO: 471 - DNA, 1500 bp, Zea mays
  misc_feature (1)..(100): optimal_loci_267081_G1, chr8:1109703..1111202, Cluster 3
tagaagaattatatagtagaaactcccacttatataatacggatgggtatttgctccacccgtgttacaccacccattgtcatctctctattcccagatgagccggtggccggcttgaaacaagactatccttggaatacgccaatcatccgcaggcccaatcgacggtgacggtgtcctgttccagatgaggccacgggagtctggagttcgtcgtaaatcagctcggcggtcgccgtcagacacctgatgtggctgccgcgacatacctttttctgctgtgggtggtcctgtggtatatgcatttcattttgtcacggacgattgccgtcgcctcgtccggcagtgcggtcgcctgctcacgcttgatccgtgtcgcctgcacctgccgccctgttcgccgcgagcgggattacgcaggaaaaattgatcgtatgacgtatgcgcatctctcgtatactactaattttaggtttggttattaattgcaaggcagagcagcagcgttgcttcggcaccgtgacaaagcaccgagttagggaggaatggttaattaaggctccaaggtcatatgtacacgtaccagaagaatcgaaagtgcatgcccgttggcatttgccaacattgacatatataaatttgaaactcagatggcacaagatgttttcgataatttttttttatagttgatggcaaaagctatgacttgtaattaagaataaatagagttttgtgcgcaaaaggagttagccaaatcagcacattcgaacagttgaccgacccacacaacacggtagagcactaccgtaagccattgttccactagcataaacatcaggccatgatgaagatcaccgcctatctacaaccattgtcgtcgttgttgtcatgctacccaatggaagccctttagaggggcatcgacacgccacctgcacacgctagccgcaccttgtatcggcctccaacccctcgaaccgagcattccacaaaattgaaaatcggacctggctctgctgcaaatgaaatagtggcactgcattttcatagcaccttggttgcaagctctaaggtcactcattgtcactggtgccctcatagtagtttcatgctagcgccaagcattcttgtggtcgataccacctttgttgggtgccccatggcctccacatgctgctatcgggcacacaagcgaggaggtgggcgggtggctgcagaagggaggtatagagatgactgcgtagcagctagaaggtcgttgatcatagtgaggagacaactgccatcacaaagcctgttgagcaggagatagggtcaatatgactagcgacggtgaatagcctaaaaatattctgcaaactcacaaaccactagagcaaagattgattagtacaaaagatagcactaatgcgactatttgctctagctctatttcaccataagcaagccccctaatcaattctagtagcttgatgtctaagtctatgacatacaaacaaa

SEQ ID NO: 472 - DNA, 2950 bp, Zea mays
  misc_feature (1)..(100): optimal_loci_267263_G1, chr8:2413569..2416518, Cluster 3
acgccgtcctctccatatctattccaaagactcaatgagcgactgcatgggctactaggaaggccatctcaaatgtaatgtctatcccaaagactgaatgagcggttgcatgggcatgttggcatcctgtgcgacgtcctccacatctattctgaagactcatcgagcaactgcatgggcatagagaaaattggattgttggtactccatctctattaagaagcttgcttgcaaaattttgagatcaatgaaggttgtttggatcaaaacaatatttttggggatttcgtgtgctgttgggaaggccaaaactaactgagttagtttgccccttccctaaaatagcttaggcacttccagggttcttgtatcgaactagaatcagcctagctggtttgtaagctagctagttttgctggatgaggtgttcgttgtagctctgtttcactagtatgagtttgtttttgttctagtcttttttgcttggttgctctgtctctcgtatatatttgattgcatctcaacacctattggtgtttgcgtgttctgaaggagcttttagtgctttggttccttttgagggctctaggggtttctcgagatcaacgtcaagatgggtttgaggaaatcttttactagcacctatttcacgctcccctctctagtcgccttgcttggtccatcatataggatacaacccacaactatgtctcaatgcatagggatgaagtttagttggcatatagcagaacacagtgaacaacctacaaaggaaaacaacatccaggatagttatggtgccaccagaaaactctagtgcacctcttaggtgctactctaagtgtgtttcttcgtgaccatttggttgggcttgagtactttgatgtcttgaggttcttacttgtcttctaagattttcaatgttcctcttcaacgtttgtctaaatgcatctaaacaatcatctatacacgtttaaacacgaaacaccatgtttgcatatagtttagaccttcaacgctgaattaaatgcgacaaacatcaaaacaatcaaatagaaaaaaacattttaaatggtggcattagttgatggataaattacattgtctatctctttccttctggttttatgcacaccgcacatattttcactctttaaatgtatcgtgcatgtgtccagacctatataaactcaattattttgagacggagaaagcatttttattcgagttggaagaaatttctgttaaacaaaattggcagaattcaaatcctccacgttgccccggaggcccgacctactgtgtgacctctcttatttcttgaccggacaatctaaaatatttttgccctgaagtggatctgacaaatgtgtcaaaatacaactcaacgatgtaaacaaagagtgtgtcctcaaggtgtagacaactcaacgatgcaaggccgagaaaacctgccgagccaggttactctgttgcattttcccagtcgggctttagcccatacacttgggtctgggccctaaattccacaggagccgctacgcggcgggcggcgccctctctgaaaccctagaccttatcgctatatacatagccgccgcagctgcctccgcctcagcggctcttccccactcgttccctccttcagcatcacgtccgacggcggcggtttcggcttggacatatttggtctcgcccatgcctccctcgtttcagctttcctcctttttatatctcggtgttcgcttctattttccgacgctggtttgagtattatttgcggtggccgtcttgttgatgcagatgaggagacacaagttttaatgggtaatttgcatctgaggcatctctgtgatgtcacacccttttcaccttggagatctgatgctatgctccctacggccacttgatctgtctgcttgtttttttttttttttgctttggctgacgcttctcgatttgggttcgtgatcctgtttttgcgtatgatgttccatagtttgtttgttttttgccgcggggagatgatgtgatgatctaattgtttccctattggtttgattggccgccatgatggctcaaactgtattagctctatctgatcatctccttggcgatccgactttccaaaaccacggtcccatttatttaatcaatactatgacattgcaactgctaagtttctactggtggtttcataatacttgttatcatataatcatgtaacacttacgcagacaatttacgttcaaacgtgctagcaagccgcatgggcatacaaatcgaaacaaagctgatcaggaaacttatctgcaaccggccgtttgagatttttccccaatttgtcgacttgctagtataaagatattaaattaatagatgataagatttactatacaataactataattttgtatgaaaagcaaataatgatgtaaaacaaataaactggaaattaaaagtctcatcggcccgaagccctgaagcacacaacagcccagtgtggtcaagctaattattttgtatttgctagcatgttttttaatgcatgtgctagtattcatcgcaatgcgcagcgtgttcttgctggcaattgactaatgttttcaaaattttggatgaaagaaattttaaaaaatctggggtaaacgaggattctagattaaattagagaaatttatagatttttatgaatttatttagctcttgtccctttagatattgattctaattttttaacaataaatctggctcaaaaagttgaacctaaccggcattatccttgacctcacagtatgaggctcatacaatatgaaaggtccagccctgagccccttagggcctcctgtgtgatctagggacaactataaccgctaagtataaacttgtataagagtgaaaacaggatgggtacggggtacctgggtcgggtattcgatacgggcagcaa

SEQ ID NO: 473 - DNA, 1472 bp, Zea mays
  misc_feature (1)..(100): optimal_loci_270193_G1, chr8:18433578..18435049, Cluster 3
gcttgacaggaaccaccccacctccatagcctaggcagccctcaattctaaaaaaacaagctcatcggatcctgtatgtctttctgcagtcgcagtgattgttttctggcgtaggagctgtcctgttattttaagtaatctatctctgtctagccatagtggataactgaatccaagtttatcgatttttatgtctgccatgccacacagcttggaattcctgctcagatgccccaggccccagtccagtagtagtatatagagtctagtggattactaccaagacaatgtgctgaaatttttttagtgtcatgaatctacagggtggtggttgcggctgcggatgcggctaattggtgcaacttgctgttgttgtttgcatactacatgcattattggcctggttcttggaatcttgatccgtttcttgtggcggttcaaacggctgcgcctgcgcagtccccctgcgggtagtcagcaggagtgcaggacgaaccaaccaaccacaagactggacgaagaaagatagcccgggagaaaagagagaaaccaaccactgggctctctgcgcggtgtcagtgattatgggaatcagtgacagtgagcggctagataaagatcgtttttgtttagtactcctgcgctacatctgtttaattcttaaggcggatttctaattgcgccgcgtggatgttttggtcgtagtttatatttggagagagggggggggtgtgctatttgtatttgaatcctacggacggagtagtacagggctttgcaatctggttctacttgtttgatctctttcattttcgggtgcaacgagaataatacgaacgggactgttggactccatgcaggacagcgagacactgacattgtattgatgggtctgggtctgggtgagccaagagttttgaaagcgtggtcagcctacaacgcatggagatctggtccatgcaacgagaacagtcttgatggcagtgacagatgcgtcatgcgtgtgtatactactagtctactactactattaagcacggactcgtctagtcgtctgctacggtgcggagtgggactgtgggagaactgcaacatctcgtctaccacaaaagaaaatggcatggcgcctgcaatcagctttgcatatattttacgcgtccacttggtgaaagaataaaaggaggcaagcagtcagtgcgaccgctggcaattaagacccatttggtagggctcctatggctcctctgtctttttggcttctctataggagacagtggcagagactgtaattttatgaaatattattgtatgccggatagaaggagccaatagaagcttattttctcgtgcttcgattttcgatagtaaaatggctctcactctttgatgactctcgatgatgagctgttttttaagaccgtttagtacgccttcggaaccctgccaaagggggcctaacaaggagcagatag

SEQ ID NO: 474 - DNA, 1951 bp, Zea mays
  misc_feature (1)..(100): optimal_loci_270617_G1, chr8:20817124..20819074, Cluster 3
taacacttcgttatgatttgtatttgaaatatcgagtgtgtgagctcgagatagtcgagactcgagagtcgagagggtgtgtgcgcacagcgagcgagagaggcgcgcatgtgtggccgcccccacaccattctgggcctaacactgtggcccagtttggcccaaatctattagttatgttgggcctgccggccattacattcacgcgtcgtatcgtaaaccgccgcgccgggcacgctgaaatgggggcgagacgatcaccggcgccgtttgctggctcctccgtcttcgcgcggtgccggtggcgaggcgagggctcagtcactgcatgcgggaggacggtcgcggttgtcttggcgcaggcgcgcagccactgactccgatcgctgccggaagtacagtgagatgcacaatcgccccgcagccccggggcgccgagcaggtgagttgtttggtagattgccgatcagtgattttgtagccttgcttttccgcatccactctcagcatagcgacttcctggcagatcagaaagtttctgcaacttgttaagtatctcgttaattttcgctgcatttccttgcgtgtttggctcgcgtgttctatcatcggagtagactgctcccaattccatcacagaaaagcgggggaattcctcccgcgggtttgcactcagcgagtgcgaaactgccaataagtgatggcgggaagtacgctaggcatgcgcatagcttcggtcacctgctcgatgaaatgccggtgtcagttcataaatagcagttgttgcagctggcctgccccctccccctcccctgaagatttgctcgcacaaggctgtcagatggtccattgtgcctttgtcgggctgttcctctatgcgttgggcataagcatggtggtgtggccgtgtgggccaagctgccgtgggcaaatcgggatttgggggcagagtttggtgcatgagtagggttggttggtacatgcaggtgatcggtcgctgtgagcgtaggtggtacaggtcgttggttgtttggatcgtactttgtgagcagttagtgctgttgatcggatcacgacctcgtacctggtagaaggcacagatcaggcgtgcaaactgtacgaggcctcgtgcgtggtagtcgtctgtagctgaaggcaggtatgatttttttttttactgaacttacaattcagtgtttgtcattgcataagcggtagctggtagcgaaaggttgctagttagctagtctcctggtgttagtttcattagagaggcaacgcaaatcacctttgccaatggtcgattggttactccaaagtgcaaacacatcttatatcacttgttagttaaggcgcatcgtaaatctgacaaaatggcacccagttctgccacctgctgatgatgagcatgtgtggagcgcgaaacagatagtgctgtttgttccactctgagcttttatgaactgcttgctcttttgctaacagcattggaagccgatgagcagtagtgatgttcatttagctagctagctgttagctattttagttccttcaacaaacctttcctgcgcccctgtctgttctgtcgacagcacattaacataagaaacccagctgagcacgcccaatggcaggaaacaagaagaagctaatggctcgatcaggcctttttcatacccccacaattttagaactcgggttcacagtattctgaagtacgtagctgatacataagcctggaaaacagcacagccagtgggatgcaatcgtttgtgacactgccaggcagaaatatatgggaggcatcagtaaagcgcgcctctcaatgcattcctctcatgcatgtatgtgatgtaatgttgcttcttcccataatgccgcagcttgttccagtttgatgatctaatgattgttgctacccccttttaggtatacgtacgtacacttaaaa

SEQ ID NO: 475 - DNA, 1680 bp, Zea mays
  misc_feature (1)..(100): optimal_loci_277874_G1, chr8:72758908..72760587, Cluster 3
cttaatctcttcatgcatgcatgggcttatatttcaaccatgcaatagtctagagttgttgaagaagctagctagatggtcatatggatgtccgctcttgacttttaggagcaaaacagcaagtagtggtgtagccaaaattaacctcgctcataaagcgaggggaatggaagaagaagaaaaacgctcgatccgatcaaacataacattccggtgttttatttcaccttttcccctctacgtaaaccagtggagggacgtcgatttcttggaaggtgcaggccgggaagcgtcaacaaagctaaaactacgtacgatacgacggccagtacgcgtttgaaatctcaacaggcacgcaagagcatcgaccggacgaggacgacgtctgctatgcatggacgacaaggccaccggccggatcgcctggtcttgcatggttgttggaacaaacccctccccctctctctctctctctctctctcacccgtctactacggggtgcatgccgtgtgccgacaggatcatcagcacagcagacgacgacgattctttcttccggtctccgggacaaaaaggggatcgatcgtcgttggagcttttctgggagatggactggtgtgtggtcttgcttttgttttgccgctgtgtgccttctctctgtctctctcttttttctgctgtttcctccgctacgtaccgacgtacgtacgtactgtagtgctacacgccggccagtcgtcgtcgtttcgtttcggtagtggcgattgcgagcaaagaatcacggaaagggtgcgacttgcgaggtctccgccgagttttcgcccggcggccgggaggagtcttctttcctgcttgccttgcattgttcactcctccacgcgcgcgttgctcgctcccgcctggggctttgtcgctcacgcgggctgcgtgtgctagctagctctctttaatttggctctctgatgggaaatctggctcataggtcgagcgaagaggcaccgtacatactactactacggaatatattatatatacactgactttaaaagtacacggatgcgatggccttgtttagataaaaaatatggtcggcaggactactacgaggggctccatttttttgttgtataagagcatttttttaacaaatacacgaatatattgcacagatttatattagaaatccatacatgtatcaaaagattaacaagcttcgagatatacacggattaaatgatggatttaatcccaccatgagattaggtgcgtggtatggatttattcaaattaaatccatagtgcgatttcatcccttgtaacggaacaacaagaccttagcaatgtttggaccttttacatgaaacccacctatcgaagttaatttcttcatggtgtacgcaattttctctacagattttgtgaaattaaggtcagccgacctgattaaacatatagatatgctctcttacgcacatcagaaaatgaagaaaaaaacattagattattatctacgcggcgacaaaaccctgaatacaatcagtatctcggggctcccgtagaccaacggtcaagggcgtaatcagtggtagatgccggtattattgtgccgcatgtgattagtatcagctgatcacatgtggtccctggtgaagagagagagagagaaaagtagtatatata

SEQ ID NO: 476 - DNA, 1955 bp, Zea mays
  misc_feature (1)..(100): optimal_loci_278057_G1, chr8:73747248..73749202, Cluster 3
tcaacaagatcgcccacaggaacctatgccgtacctctcttgacccttctccgaccacggtgaccagcgctctctctctctctttggactggacagcgagtggatgactgggtccgccgtccctcctcgcccgtgggttcgggtcgtcgggtatctccgcggggtcgtcgccacgcgcaagtctcttgggtgtcccccggttgcgtttcccttcccgttggctgtcggtcccgagttcttctcggttgccggccggcgccggcgcctccgcctgctggagtgctggtggcctggtcgtcatcatcctacagcgacagatgcgcagggcgtctggtcgcgtccatttcccagcccgtctccgtccgcgcggctgtgcctgtgctgtgcgtgccctgtttccctttctcctctgcgctcgcttttcttttctcttcaggctgctggaccgccgtatcactgacgaagatcgcttctaccagaggcagagaacagatcgtttctacttggctttatttatttatgttgctaccgcctaacctaaagcgtggggttggtgacactaacagcccagaatccactggttccagccgccggccactgtcgtcagagaggaatccgttttctcctagcaaatcccacggcggcttctggccagcgcccgctgggttctgggttacaacatcgtaaacaagcgacgttgaagatagctctgggcgaaagattaaaaataagaacatgcagatgtgttcggtttcgtaaccactcctctcgctctcgacctttttttttgttttgctcgaaccgaaatatcgggacttaggataagccattctctgtggaagttttaagtgagatttcataacattaatttgtatgtcacatgagatttttaataacatggcactatatttattacgaaatagataaaagtagttttattaccataaaactatatcaatccattaccgtgatattggaaagcgcgtgaaataacgttgagagtaattagttttatctccatctatttcattcattcctattggttgaccgtctctgagttttttaggccccggtgcaaaacataaaaatagctccagagatttgtagtatatagagataaaaacaatataaaatatatcgtttcatatttgatctattctcatacttgtcctctcatattatctattttaagtaatatttcataaataataaacaatctttaccttttataccatttatattcagaaatttcaaaaatttggggccctaaaaaattggaggccctgtgctagagctccaattgcgctgggcactcgatggccctgtttagacgtagtatttaagtcacatgttagcttataaaatcgtgtcataaaactctttattaagagagagcatattttattctttattttatcttacgtgacaacattggaaatagtgggatgaaactaccactaagaatggcctaaaaatacctgtcgtttcctcttgcacaagagacggcgttaggatctagaagactgagacggagaacaatggccgaggtaggccacggtgacacttgtgcggctagttaggcatatgacagtgggtttaaaatatggagtaagataagtgcgatatagaaagtgacaatctaaatattgtctggtgaaattattggtaatgattttttctgtaccgcttaaatattaccttttcaccactttctatgatgttcaacccctctagatcttagctcctacagtgattctcattgaatccaatcctctatatgcaacacacaatattcccaatatattctgaattagatatttcacatgtgtttttgttatattcttaaatggtatatacattttattcggcgattaattcgtagaattcgtagtctagagtaccaaatttttagagcggcatgagagaacacgctagatttaggtactggaagatgt

SEQ ID NO: 477 - DNA, 1636 bp, Zea mays
  misc_feature (1)..(100): optimal_loci_282386_G1, chr8:101156607..101158242, Cluster 3
gactatgcaactaccgtacctgctataattatcacctctgcacaatgtgcaactcttttatacattgatcctggtttcctttgtctttactcttatatcctaatttactcactgtcaatcatataatcatcagacattatacaataacgctaaacggtttgccatgcgcgcatgtgcgcgcttcgtacactagtttactacagtgcatgtgcaacagagctagtcaggtggccgccgccgttcacccgttctgcatgcactctctgcggcctgcacacgcagcggacggaatgctggccccaccgatgtccggcgtggctgtcctcgatcgctcgttcttggcgtgcatggcgccatgttcttggctttggcttcatcagcagtacctctgagagcgagagactgtacggccggcactccctctagctatcgcgccagctcgcgtttctatttcgtcgtggctgcttccgtccaaccgagccccatccccatccgccgcgctgaactgaaggaatggaacctacctagctagacgatgagttactgcctagtatcttcagtacactgtctgctgcttagattagatctagcattatacatacttaccgtggggatcgtgtccatccgtgacgctggacgaaaattgatggtaacacggctccgagagagagacaccgtatccggctgcgcacaggacaacggaccgtagacgggccggggccacatgcatacccttcgcggtcgagaggacgcggtaggtaccgtacgtcctcgctcgctgataaaggcaatgccctgcctgcctgccggggctttcatttccggattggtggcgagaggtcagttgtgtcgttccattccaacgtcgactcagctcttgtgtttggggagacatgcacgggtacctttgctgctctgtgatcggatcgtggagagcagagcaagcggggctagctagctgttgggagaaaactactactcgtgtagtaatcaccccacttgttgctgctgccacaccacactcatttgccagcgctgataagcactgcgctgcatcgtcggaatcttgccaccgacgcgacctctacacatctccctgtcgcctcactcagctcggtcgtcgtccctcccgagacgtggaggagctccatttcaccattcgtagggctctatctctctctgcagtagcagcagacatgcatgatgcgcgctagggatcagaggcatatgcagtagcagtagcactcgacatgcatgatgcccggaacagcgctactcattcggcgtcatttcacatcacagccctccacgaaattttgtcggcaaactaaactagggggaaaggcgacgcgcgttccgttcgcccttttttttttaaaatttttcttctcttcttcttccttttctcttcctttatttaccgcaatagtatacgtgaggtatagtagtaggaccaaaccaaatatgcccgatgaattggccaccacttgttcgtttcgttattatcttgtccgtgggccgtaccggtacgatacgcgtataaatatgccaactaacataacgccatactcccggtgtcatcggtccaaacgttcgctgcagctgctgtttatgaattgtaattataacggggtgt

SEQ ID NO: 478 - DNA, 1462 bp, Zea mays
  misc_feature (1)..(100): optimal_loci_2847_G1, chr1:14541627..14543088, Cluster 3
cccaggagaccaagccccatggtgtctagccttgagactttatgagttggggggtcttacacgagattccatgacacttgctatgacagtcccggtatgtatggccctaacaccatgtgagcttcgactaggtcaagtgtgtgacatagcagttaaaaggttttgttatacccatgtcttagacaacaggtgtactcgttagcactatgcaagcacacgccttcaatagctatcaattatgccatattcgacggtgtaggcacctataactaccattgtggcatatcacactcattgttgtggcacattggatgtgtgctccacatacaatacatcaattatgacaagataggagtagttagatctttgttgtgtagggctcgctatctatgtgtggatgtagctctttgcatctttatgctataatctataaaagggaggcatagagcagcgtagaatgacttttctatctctcgacttttgagtctttggtctttggttggagtccaattagcaattagtaagggagcatgtagttagagcttttggttgagtttgagtctctcattcggtttagcaatagacatcgcaagggataactagggctctcctcgctctttagctcggacatcatctaagcgtataaactatgtccatacttttagctaaacatcatccatatgaagaacatgtccaaaactctataaactttgcgtgtgtatacaaccatattggcacactgattcaatggtctcagacataaactcctttctctctctctaattttctctaataatattggtaccgtgttagcacaacaagacgacaacttatatctcctaaaattctagtccagttacttctatggactagttaggctactcccaatgggtagtatcatgctcattaattagacaccacatagtattctttctaatatggcaaggcatatttaataggagggagaaaaaatgtcgtatcttaaacaagatattgctccggcacgatatcttagattatgacataaaaataatatttaggtccattctcatagacacaacatcatattaataaccagtgtagatatataagtatgatattatggggtgtttgggactgctccatgttttgtaagccaaacgggttaaactcaagcaactttgctcccaaaaacatggagtttgggagaactccaccattttggtggagcaataaaaagttactccacaatagttgttttcataggtaaacatggggagttaattatccaccaaaccacttgttatggacaaaataacgtttcatttcctgttctattctccttttcttcctaacgctgtcgacctccgaccatgtcctcttccacatgcacagcttgagcgctgcccatctgcttcctcgtgtaggtcctaagtgcaatgtggccagtagcctagggagcgttgggatgcagaggtctatt

SEQ ID NO: 479 - DNA, 1456 bp, Zea mays
  misc_feature (1)..(100): optimal_loci_290664_G1, chr8:146019976..146021431, Cluster 3
tctgggggtaagtgacacaacatgccaagttcgtggaccgtgtgctttactccttatttttgtatggagagaatacgcggtgagccaaaactaattcagctccaaagtattcgctattcggcaatagaccgtgtgctttactccttatttttgtgtggtcctctcatatttctctctctctctctttatataatatatatatatatatgaatatacaattcaagaaattatcatttagtgtaaaaaagtaacttatattgagtgcaatactttttaatatttataaaacaacaaatgtagattgtagtcataaacacttacttgcacttgatatcaaactaaaatatttcttatgacattttacacttgatatcatttggtttcgagtaagataagagtttgggacaaaaattcaaacttcaaaacctatattagaatagcggcttcaagctccgcccctaagttttttcgagagaaatccaattctcaggataatgccacccaccctgcataaagccttcacgaagtgctcgtgtgatgctaattgagtcagaaaccctatgttaagaaattgatgaacctgaggtgacacgatgtatgtcgtgcaatgcaactagcttagatcacaagccttgtgtcaggaaattgatgaattgattcggtctcttggtgaatgcacccacgatggtgaacatcgtagccgcggcggcacaaaattggaacattgtccagcaagagcacgagggcgtcagttcatttcataggtttgtgttgatttggtgctcaatctcagatacatattatacgatatacttggtgcatacataatattaggggccaaggccccctacctttggggtctagggcggctgaccccttgccgaccctattgggccgaccctgcatccaaggttaacaaaatcgatcgggaaccatggttatgggggcgattttcagttccccgtccggaaaacgggtttcctgtgcagctcgagaaacgagtttcccactgttttctaaaatttatataaattcgacaaaaatactatatatatatatatatatatcagaaaaatatgataaaacaacatgtttttctatgtaatttggtatagcccataattaaattcaagcgcattcaatctattaaaaaagaaaataactaaatcgttaactggacctattaatccgtcggtccatttttataaaaactccaaactctactcgctcctcctcagtcatctcctagctcccctctattagtcatctccagagcttcatttcttggcagcgtcgcgccgaaatccgccattgcacaacatttcccagtcgagaaacaacagggcctgatttcactcgtcgccttggctccctcccgcgcttgcttggtcgagaaaccaccatttctcaccggttgttcatgtttcctgaccgagaaatcgtgttaagaggccag

SEQ ID NO: 480 - DNA, 1734 bp, Zea mays
  misc_feature (1)..(100): optimal_loci_293436_G1, chr8:160087805..160089538, Cluster 3
gcataaggtgcccatccgctagcaactctgttcagttggcggcgcgcatattgttgcttaaaccctggctttcgcttcgctttgtccccaactccaactcccgctcgctccccccccccccccccccaccgatcaatggacccgccgccgattctccgggaggcgtgggagggctgcagcgccctcgtcgacatcaacgacggcgatcgcctagccttcttccgcctcacccgcggagcctcagtactacactcccccgcacccccacctccctgacttcgctactctctcccctctcaaaccaaccctttgtgtgtaaccgtacaataggtccctgattgataacaaaacagctcagaatttatctagcgatgatatagaggcaatgaagcggtgatattctgatcatatttgacttctattgaatatactgacagtgctttattctctgctccctgtgatttacatctaatttgtatgcaatttgattttccaaaacagggttggtgcgactggtgacgagattgtagaagctttaatagcaaatagctcaacatttggaaagaaaattgtcttctcgcaggttagtacaactagctagtattgtccgtgctaacgcacgggaggagggggtggggcggtggggtcatggggagagggggaggcaggggtttagtgtgtgtgtaagggatgagggacgaaggtcattggaaattgaatttgagtgagtaagatagagaagggttatctaatgatctgaactattggttttgaatatatgttacgcgtgggtgtgatttgtttggtggatttagagaagatcatgggtgtggaggtgatttggttgagtggattttgcaagtttaaactggtgggttatatagggtatagataatttcttgactttatttttctttggtcttccgaagtttcaaatttgttgacaattgatttgattaaatcattttgattgcagaagtacaagttaaagaaacaaaagaaatatgcacctaatgttctgataccacacccatctgctcagaggtacctttctattagtctttgtacagtctgcaaacatgttacattattttttgagatgcttacattggtttacgtcgctgtactgttgccatgtaatcatttatgtgaccagatgtttatctatatgctttctgtgtagttaagttcccgatgttctctacaagagataaagggaacatggtaatttctatattactattgatacattcgattatatttaaagcgatgccatgcaacaccttgaatgaagagggtagcgaccagactgggagttgaagaatgcaaacgaaattattctatagcatttgatatgtgaagtcagcatgtccaatactgttgtttcaatattttattgtgtctccagttaactgaaatgaatgatattgtgctctttgagaaatggatgatatcttgtgctttggagaacaatatattttatggcaggtaatagttacaatggcaattagcgtgttagctagagtggaggatcaggaacatttctaatagaaatagtttttttcccatttttgtatttattttttaatattctactataactcatattgggcatagcccaagcctcttgaaatttgattgctggatctttatcaactcattttttaatcttatggacagtagggttaatttgtggtcctttttatgtgcagcatttgtgagacatacttcaag

SEQ ID NO: 481 - DNA, 2004 bp, Zea mays
  misc_feature (1)..(100): optimal_loci_293663_G1, chr8:161384933..161386936, Cluster 3
ccgtcgctcggccccactggctcccagtcccaggtccggtccgtcgaggcccggccacacgcccacacgacggggagcacagggccgcggggggcgcaccgggcggcgcggtgccgccacgcgtcgcgacgggactggtcggcgcgcgtccggtggagtcgctgtcccggatcgtctgcggcggcctctcctcggcggaccgaggcgtgggtcgggttggtgactgatgagatgagcagctaatcatggagcaggaccatcgggaaaaggagaggctttccgcaaaggtggcagtggccagagcagaattatgcatgacagggatcgtctcatccatccgtccgtctccgtactggaggaggaggaggaggaggaggggaggcttcgtcgttccccgtgcaattaagaaaccacgtgatcgtttgtaaattaggcccgctagtactattcctattccggcgactttggttaaggttccgcgtttgtatacagtctacaggaagcaacaagaggggaaaaaagagagcacatggatctggatatggactgggtgactgatggaccgccgctcacctttccatctaagaaaaaggcataaaaaacatgtccatcttatcagatgcttcaaaacctggaatactgttagttagaccctatattctgtctaaaaaccccatttggatccctcatgttataggacgaagaaaataacagttactagcaatcactagcccctgtaattaataaaatttgttaaccatggcacaagttggtaggtgtagttgagatagggactcaaagctatcatctcatcagggacggatctagcggcccaccgcgtgaggctccagtcaccccgtttttctgaccagtggtctggtgggtaattttcaacaaattattaaggtggttttatgagtgcttggcttgcatatgggctccggcttcactaatacaacttatttatgtgagtttccttgataacccttgatgtttcgtgtgcgagagaaccgaaacgatatattgtgtaaccagtggcatgacgagtaattttcgtgcaacttcgtgacgatatatgaaaactggattaatttttgttgacttcaactccaaaaaaacaactttactgatagggccgaatctattttattttataaatatctggcagagcggctttagtagggaagatagcagagagaaatacgagagaaactagtgttttcaacttcatcttaattcctatgtcgtgggacggtgggagaagtaaataagcatcttgtagtaattttttttttgaaaatacctatttgaaagaaaaggcttaattaagacagcactgtaaagctgggatagaatcactaggccttttatccgtgcatggcactccgtactcgcacacactgcgtacgtgtgcaaccgacgtagtagcatggagcatagtgatcgtgtcgcgcgggtttgctttgttcttcttctgctttgcaccctccaggtctacttcgtccccgcaaccttatccaccaaaaaagccggaatccagagctgcattgcatctatccacctcgtctacccaccacctgtcgccggcgtaagtaagcatgcatgcacgtgacaaattgacaagaccggccggagagagaaaaaaacgcccggccgagagctttaattatactatataacagcatgccgaaaaccaggctgcctgtaataataataacagctaagtacgcttatttaaatgggcgcgcgcggccggccggcctcagctcgtgtgtgttcgtccataaattacgcctcacacagttggcacacggccgtcttttatgtttggcttcttcaatttgttcccattgttaggtcgtttgctcctcccttgaatgttagcatgtcgttccactactgttcagtagtaataaataatgtactaaatactactgccatgtgttggtgagtccatccatccatccaggctgcccgttagtcacaacgaccgtgtaaaagata

SEQ ID NO: 482 - DNA, 1556 bp, Zea mays
  misc_feature (1)..(100): optimal_loci_299695_G1, chr9:11606238..11607793, Cluster 3
acaggtatcatagcaaggcccatttcacaggtaaattttttttaaggaaccatgtgtaaagagtttttcggtgaagacagcagggcgtagtcataagtcactctaatcaaggatagatagagtgagttaataacatagggtcagccgttgcagttcgttgattataacctacaaaatcagacacaaaaaaatagacacgatctgcaagcctgacagcaacgagtgaaatacaagcgagcagtcatctcgtctccgttttaatgctctccttttctgtttctttcatagatttctcctttctgcgttgtcttgctcaccgttcacgcaccgagccacccgttggtgtcaaagaaattctagatcaaggcaactagcgtgacgcggccggctatgcaaagtttttggtttgctatgggttattcctggatgccacacattccaaagagttcataacttgtcatgttgatcacgcggaaggaggccatggtgctttattgctctagctagaacgaggagggcggatggggtggaaccgtggaagatcgcggacaggacagtgggaacatgcatgtcaatgggtatgctatctacatgcactgcccatgggttggcacaaagaaccaaagcttttgcaatatatctttgcaattgctggaggcaaaggtgtataaatagaaacatgcattgaccataaacattttgtttctacgctacgggagccatggcgcagcacatgtcaacaagctagttcatgagcagaccgaccttaatcgacgtaactcacagcaggcttgcttgctcatagcgggctgtaatcgtaaactcatcgcattacagtcacctgcagcctcactcgcagaacaagcttgccgacacacgagtcgacacgtggggccgtcgggccgatactccctagcttcttgatgactccatgttcgatgcagggaagacgtacgattggtgaagggctcttcaattcgagttctgctgtaagatttgctgcggccggtgctctgcctatatattatatggcctgcaatgaacacagtacccatctgatcgaattccttcgtttcttggtgaaactcagaaagtggaacacagcacagcgacggagtcgatatgtgtggccgtgcaatgctgagctgaacggaccttgtggatgctaataaaaatgttgcacaacctgtgttgggatcagtgactggagctctataaaattaacgccgtgggccgctttataaaacttgaaggttactttaaacagtctctaatatattgtgcggctaaatataccgctaaaacaaaatataccacaaacatagactaagatagtatttacttcaattcagcatctaaaaatacaataaacttgattaaaaatataaaaagtacctatatagagacgatttggtccttccccgcctctaataacttcatcaacattagcacgtgaatttgaacctacacattgcaagttcaatatttgtataaaatgagagatacaacatgacaatataactaatgaatacaaaaatgtataagtgagtacaaaa

SEQ ID NO: 483 - DNA, 1637 bp, Zea mays
  misc_feature (1)..(100): optimal_loci_300332_G1, chr9:15357579..15359215, Cluster 3
cgtagcatggtagcagtagtagcacctcgctcgtcccctcccctgccagccgaggcacaggcacgcgtgttgctgtagctttcaccctggagggtcactcaatccgtcgtatcgtatacaagttttagtacctgatgatacgaacctttgcatgctgtaggtcatgcacaggagtaggctgctccgtctcactctcggcgcgtgtgcgtgcgcaacgtgtacgtacgtacactggacgtgtaccatactgactcaggccaaagtacatacagtgcagtgcaagagaacacaaaaccctaaaaccaaaagaccggacggacgggacgacaatgtccactatattccattccaggccgtatttatatatagaaacagaagctctaccttttacctgtgcagcgctgcccacagccccacaccaacccggcccgaccagctagctctagctctctccttgcgctcgtgcacgctgcgctgcgctgtgcatgcatgcagccggccacagccacagtggggccactgctcagggtgtgacaagatgtaccaggccacccgcgctgaaccagggtccagggccggggccatccatcgccatcagactgttcaggggtaagcgaagggctagctgctgtgcccggcgccgcgccatgtcacactgctgctgcactggctccacatccaccactgcttgctgatggcctcctgcctgattgatgcagcagagctggtgcgcaaagaccacacacaaagggcaaacaaccaccacagcacgcatgccattgccatggacatggacatggacatggacatggactgactgactgactggtgagaagaaaagaacaatcactgggaacggcatgcagtgcatgactatttaaggaaacccgcttgaccctgccgccgaccgccgtggccgtgcggtgcgacgggtcggggcgagcgtgcgctccgctgctctgctctgcttccattccatgccatgccatgccagcgcgaggtgaggtgtcagtggtggagtggagaggtggagcagagcagacagagcgctcgggaggtgtcggggtgctcgtcctttcctcgcttcaggaatggaagtcccgtcctcgcctcgcctggccttttgcttcggccacccaccggccaccgcccagcggagagagtggtggatcggagacgagacggccactggcctgtgtggcctgtgtgctaggctggctggctgtcacgcagctgatgatagggggtggggcgggcgtgtagggcagtgttacagcgaagaaaaagggcgccacgccagtactggcagtacatactatgatttgaggtctcatctcagaggctcctttgccagtgccttttcatttcgccaccaaaagatctactcattgcaacccaaccccccccccccccccccccccgccgccaggctccccttcaccaacagctttcaccaggcgagccttcgcatcaacatttctttctttcttttttctttctatttttcatcatgccatattggatttgttttatggcatgtcgggagaggtagataaggtgtgagatgtgagaaagagcagccgtacgttttttttttgttcccacggaacaataggactttcgtaggagtttcaaaa

SEQ ID NO: 484 - DNA, 1431 bp, Zea mays
  misc_feature (1)..(100): optimal_loci_301732_G1, chr9:23324456..23325886, Cluster 3
ttgacaaggtgaaaattccaaactagtttaagaagtggattttaagttgccgaattaactttcgctcttagacgccacggtcccttcgatcgacttaggaatggaggtagatggggatttttttttttttgagaatataatgtgatctttgcaacaacaaaaaaaggcttgaactttcacactggttcatattaaaaaaatttcctcctcgccatcatcataaacagagacccggccaaaccggaactgtatctagttattgttgccaactccgaaacttcccttgtcgatcgatgccgaggataccgacctcgctcgaccgctgtagcctgtagtagtgcgtcatcgtcagaccagtgcggcacacacgcacgcacacgggggggcaggcgggcgggcgggcgggcgcgcccatgcatgcatgatgcatgtacgcatgcgttgcggctcgcgcatcatcatcatctacatggtgacaagcgactggaacgaccggcgatccggcgccggccgggcgggcgggctagctagctgccggctggtaccaccctcccgaccgctcgggcccgggcgtcagcgtggcgcgcgtcgccgtcgccgtcgccgccccctcccacccggcgtccgtgcacacgctcgcccctccgacgcgcgatgcggtcgaccccgggcagccgtcgctctcgcctttgcgcggtaatataatatcccgcgaagcgcagggccgtcgccctcggccgggatcgcgcggatcaaacagttgcccgcgcgcgctcgcaagtcgcccgtcgccgcaaccggccagctggacaccaggcccggacgatcgacgtgtgcggccctcccgcccgcgcgcgcgcgcgtcgtcggcaactcggcatggcggcactgcacgggcacgccacggtgcgcgcgtgtggatccgagaaggaatggaccaaccgggccggccgacgaggaggttgttgctattgctactagctagctcgggctcggcgcgcgcggctggcttgtgcgagaagccgccgtcctaggtagctgtagctcagacccgatccccggacgtgcagtgctgtgcagtgcggtgtttggaggcacgtcaattcgcgcgccgccgcgtatacgtgtccgccgccgctagctttcgctcgatcgcccgcctgccggctgggccggggcgcgcgacgaccataccggggttagctcgctcatcgccgcgcgccgcttgtccgatctgatcggtcgacgacacgcgccaccgccgacgatgacgaaacaaaccgctgtactcgatcaccatcatctcgaagcgatcatgcatatacagcgagcgagctccactgctagctggtggattttctatgtggttctgcttccaaaagtgagagcgtgacaaattcgtttggagctaataatataatctgcgtcgtc

SEQ ID NO: 485 - DNA, 1631 bp, Zea mays
  misc_feature (1)..(100): optimal_loci_301849_G1, chr9:24135769..24137399, Cluster 3
  modified_base (560)..(560): a, c, g, or t
  misc_feature (560)..(659): n is a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
  modified_base (583)..(583): a, c, g, or t
  modified_base (584)..(584): a, c, g, or t
  modified_base (585)..(585): a, c, g, or t
  modified_base (586)..(586): a, c, g, or t
  modified_base (587)..(587): a, c, g, or t
  modified_base (588)..(588): a, c, g, or t
  modified_base (589)..(589): a, c, g, or t
  modified_base (590)..(590): a, c, g, or t
  modified_base (591)..(591): a, c, g, or t
  modified_base (592)..(592): a, c, g, or t
  modified_base (593)..(593): a, c, g, or t
  modified_base (594)..(594): a, c, g, or t
  modified_base (595)..(595): a, c, g, or t
  modified_base (596)..(596): a, c, g, or t
  modified_base (597)..(597): a, c, g, or t
  modified_base (598)..(598): a, c, g, or t
  modified_base (599)..(599): a, c, g, or t
  modified_base (600)..(600): a, c, g, or t
  modified_base (601)..(601): a, c, g, or t
  modified_base (602)..(602): a, c, g, or t
  modified_base (603)..(603): a, c, g, or t
  modified_base (604)..(604): a, c, g, or t
  modified_base (605)..(605): a, c, g, or t
  modified_base (606)..(606): a, c, g, or t
  modified_base (607)..(607): a, c, g, or t
  modified_base (608)..(608): a, c, g, or t
  modified_base (609)..(609): a, c, g, or t
  modified_base (610)..(610): a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
  modified_base (623)..(623): a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
cagggcaccggtttttcaatctaacggtctggaccgtggaccgccggtgctcaatttcattgttcaacaatatttttgatgattcaactatcgtttgggtttggtttaggctataaaactcagaaatatttggctgcccaactgtgaattcaagctgtttatgttttgccatcgatcgagatgtgttttgctgagtggttttgccgacgtggacgacgagtggaggtagtccctcccacatgtcaatatgtcgttgctgtattattccctcctcctagtccatctcttctcctctcacggccaaacccactcgtccgctccacagcagagagctcaccccgcacgggcctagctcaccacgaggctgcctggctgggcttctcgttttccctccaaaccaaaatccatgcaggccggccgccggcaagcgcagtggcgcagagcacacacaagcacagcctcctccgcctgccggctccgtgagcagcttctacttcgccatagtgcatgcatgcaaatattgcatttgcatccatccctgcagcagcatcagacgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggaaatccgattcatgatggctgcttctcggcgtatgcattgcaatcaatgcgcacggcgcacgcgtatcgggcatatgcactactgtttctgcgctacgcatgcaaaagagttaattaattcgtgctaagtacgctttgccttgcctgcgtctagctctgtagtacaatactgtatgtatgtatgtatgttatggttgctgctgcaggaatggaatgaatccatgcatcctttgatcgattcaaaggcatttcgcctgtgttgtaggatccaagatcggtgacgtatatatatacctacggttaattaattaattaatgccctgtttggtagaccttcacttcaagaattccgacttcgttccaatttcttccacctaaacaggttcggctccacaagctctagttttttttaaaaaaaaatcaaaactaaaggtcagttttatgaaatttatgaaacttcttagagagtgtttttaaaaacaagcttcctcataaagctgtatgaaaattacccaccatgccactggttacgtaacatacaacttccgttctctcgcgacagtccactaatcatcaaagataatcaaggagactcacacaaaaataattgtactatagaagctggagttcatatgtaagccaaacactactggaactcacgttaacaatttgctggggttgttttatgatgaagctgaaaacccaaaactgaagattttgaagtaaagttattccaaacaaaccctaacttcgttcctttaaactgtttaagatgaagctgaaaccagttaataaccgttagacacttgtcttccacggagatgtattggggatcaaagtgtgcactccctttccacccgaagtacgcccccccccccctcatttgcggtcccccccccctcctttatcaatacaacaagacgttttacattgttttctagggacaattgcgttgtatccttatttt

SEQ ID NO: 486 - DNA, 2559 bp, Zea mays
  misc_feature (1)..(100): optimal_loci_303562_G1, chr9:34907166..34909724, Cluster 3
atctctatattacacgaactatactgagttcttacgaaacactgaaaaccaagggcgaagattgctttgttcgactttgatctcgctctcgctcgcaactcacctctccctctccactcgcacctcgccgccgtctacccgtctgctgtcctagccccgcttctgccgcagccatgaacccttccatgccaccgcctccgccgcgtaaccctaattccttttcgtcatccgcctccatgccaccttctccgctcccaaacccctcgccgccgacggcacggccggaggcggcgtccgagcccgacttgtcttcagcggaggtgaacggtcgcgctaaccctagcacatcctcctcgatgcctccgcctccgcctcaaaaacccgccccaccggcaccgcagatggaagcgaaggcggcagaggctgagggaggcgctgtcccgagcccgagcgtgagcggttcgtcagcgaaggaggcgcccaacagcagcggggcctcctccggcaacaacgtgatggaggaagcggccgcgtcgccggtggagcggcagagggctcgcgcgccgtacgccattcccgagtggagcaccgcgccgagccaacccttcttccttgaggtgctcaaggacgggacgatcgttgatcagcttgacgtgtgagtttgcaattcccatcctttcatcagttctttgttaatttaatgatatttttatttcgtgattaaggtgtttggttccttagtcaccctcctaaactttaagtgcctgaactttagtctctagagtttctatttgggccctgtttgggatagctacagtaaatttggtggagttgttggagcagagttgtaagcctttagaagctggagttgtaagcctttagaaaacatttaaataagtcattttgtttattatttaaataaaaaatatttttaaaactagttaaattgatattataaactacagctctacactggagctgtttggcagttcagaaactaaaagtgactaaacttttagtcactaaagtttaggaggtgggaaccaaatagcccctaagggctggtttgttgaccaggatcacgaggggatacataggagaggaatccccttactattttgaaatgagttaaccctcaatacccaaatgagcgttaaggatttctccctcatagatcccctcgtgatccctggtcaccaaatcagccataagttgttgtttagttgtgtgaaatgagttaaccctcagtacccaaatgagcgttaaggatttctcccttatagttcccctcgtgatccctggtcaccaaatcagctctaagttgtttagttgtgtgaaatgagttaaccctcagtatccaaatgagcgttaaggtttcttacccttttttttgttcactgctttggctgttgctgctgatatataagtcatgttgtttgttggcattaccaagattagaattggtggaatgacctgtattacacatatgttgcaggtccaagaaaggagcttacatgtttggtcgaattgatctgtgcgattttgtattggagcatccaaccatttctcgattccatgctggtacgttttagccattctctttatcagcctgacagtcttgacttcgccatagtttgcaaaaggaaaatttggttacagcacttataaaatggtgtttttgaaatgaaccattacatgaaaacagcatcctattgctagcagctaacattgtgaaaccatccatccaagcctacaagccagcagccattttcttcctcctccatcaatctgctacttgccctgattttcttctccttgacctctctctctccccctccctctctctccagtggtggagccagaactttttaagttgggtattccctatagatatcactggtggtttggataaataattgtttaatcaatttgttcttcatttttcaaaaccccatctacatgaaaatagcaattggttgttgcatgtctatttgtgtgtgcatagcctttcagcatgttggatgctagcactactcgccttgctcaagaattggtattcttatactctgtgccgacagcatgcctaacctaaggtttggatcatttgaggagttgaggagatgagggctaaaagagatgatgagcgacaagactcgagaatcaaagagatatgagcgtgtttggatgttggcgctagcttgtccaacctatttgcgtctggtagcgtgttcttttggatcaacactaaataatagcatgcccacgcaagatgagaaaaacactggcacacagctacacttagccaaccaaatccttcaccaatgcttggctagccagtacattggctgggtaagtggatgatagcttccaaacacacataaagccatatatcatattgtgacaaggttattgatatgggctacctcataagcaagaagacggtgaacatgctaatgcaaagtgcagtactagaaaaaagaagtagctagagtttaatgggctgctcaagaactaaaaaatcatttcgataaaaaaacataaaactatgtttacatagta

SEQ ID NO: 487 - DNA, 1671 bp, Zea mays
  misc_feature (1)..(100): optimal_loci_31101_G1, chr1:191279425..191281095, Cluster 3
agcatcaaggatgaactgggttgatgcaaggacttgagcaccaaggcaaaggcaaggatgatgagaacatgttagcatttggaaactgaatacacatctgtttgagaaacaaagatttcttaccgtcttttgtgaacagatttaaggtgccaaggtcttattatcaggggaggtagccatttctagtgaccacgaccccgtccagttatgccaaccccatctttggttccctgaatctctgaacctgagtaatttgtctggtatgaaatacacccacccacctttctccagtgtactcctatttgaatgctcattttattttattagaacaattctttggccagcaacaaatctgatgtcgttacttttaaatttgtaatgttaaaatttgcttctgactgcactactaaaatattgccaaatgtgatagcaagatcaatggacactacattgagcgagccagctaaggaggtgggtttctgttttggtttacttctattattataccgttatactttctatatttaacaaggcaaagggggagaaaggcaaatacagtagaggaatctgttcagaatctttttttggttgagtgttgctacataagtagtgtattagtttcctgaaacatcccttgtcagtttttattaaccaattgtacctggcatcttttgtattacaggtgggtgacaagctatctacttcattccaagttataagtcgttctgactctgatgtgcatataggttttgctacacacctagatatacatcatgtctaggtacatatatagtaaaatatatatatctagaatttcatctatatacaagtaggctaggctatatagttaccttaataatttatgaataatgtaatgcagatagtgagagtgttgtaaatttttactatggtcgtttctgtttaggtttttatagtactatcatattatggtcccagatgggagcgtctacagtgggagggatatgtaggtttagtgtagcattagtacaatacttttttttcttgtacacaccagaaactcttttgttgtttgctcacaatttgcactaaggaagttcatgtgttgaatctttataggctaatttagtcttaatgatgattctccggtaaatttaaaatttgtttcaagaatttgttagcattatctagcgagagttgtaaagtagcttaaaatagttgttttgtggttttttctgcctattatctttcacgcaggggtaataaaatgttggtccaattcggtaaggatacaactggaattctgatttgaggcagcagaccgacacgatgtctgatgtttaaaattcatgacatcaagaagaaaaatgccgcttaaatatcttaatagctatggtcacaaaatgttaaccgtaaggaaaacgatgaacacattgctgcagtacacaaacaaacaatgagtgttcacagaatcaaagtgctatttattctcttatattgttgtatcatcaaatgatttagtacaacatttttttaagttgagcatgttcctttgtatgttcagtgctgctgagcatgtattttggtgcttatccttttaaacactttttcaatatattagtgggttataatgaaatcgtcagttcctgtatttgtaatttgtattgattttctggagctaggaatggatgt

SEQ ID NO: 488 - DNA, 1955 bp, Zea mays
  misc_feature (1)..(100): optimal_loci_311588_G1, chr9:87439449..87441403, Cluster 3
cactggcaggccctgttcggctttcacggattgaagacccggaacgattcctagagtatcgcttctatagtttatataagtttggatgagttggaacaaatcttggtccaatcccgtacaaatgaaatgggccctcacttgataacaagggcggatttgggccccgggtcacctaggccatggcccgggacgcagcctagaaatcttcttatatctaggataattttagcccaaataatctagtccacgggcataatatccccttccactcctgattcgttctggcgcctcgtggtctcctggcttccccattggcccaatccctcacgccctgcctagctccagtccacgtcttcggccttcttgtctcctagaccgaggtaccggtggcggcgccttcgcactacggcctccagtctatgcctccacctccatgctccactccatggatccgacaactgtgacctccctgcggtcagcggtctacgccctccatggattcacaccacatcgttcgccccttgacagctcgtgatcgttgatggctactgttctataagtgcaggtacaaggaaccgttgtatgaattatacaggagtagcaaacgttgcataaaatatattgatgctatcaaatgttctataaatcataatagttgaaatcatgcagattgtcatactataaaattagagttctaattcctagattgtatagactgttcaaatgtaatcttgttaatgaaatgctcaaaaggtattttgcaactgaaattttgtcacggtagtgctcactggaattttgcccatatcatatatcagtataatcaaatggatgtatatgagtaagggacattccaagtagccaaatgataaagggtgagcatacaacggggcatcaattttacgatgctccgctactgcttgataataaataccggctggacaaagccgtacaaaacttacactctactgacaaagcagcaacagttgcaaaagcaccgaaccctaacatctctttctctaacctttgattttgtgattttttatatatatataaagtatgccaaaatgatctcgtacttgcttgcctcattggtaggtcgcaggcgcggtactactagcactgcagagctggcgctccggttcaagcaccaagccaagcgcgtgtgcattgaatttcaattttgcatactacgtttgaaacggtataaccgcgtgtgcaccggctagacaatttgtcaaaatgcacctgcgtggcagcgtgcgtgtgtgtttctggaagcaaaagctggagccaatcaccaacgcatccgccatctgacttgcgcggccaattggttcggagcgaatagtttctcccggcgaagcagtggagtgcacgctgtggagcccgtcaaaggcacgctcgacgctctggaccagagctggacggaggacggacttcatcagactagacgagagaggtcctcaaaagcttcgcgatttttgctcccgtatcttctctgttaagggaacttataaaaaaaccgttttcgtctcccctcttgtggccgcgtggcctgaaggcgcaaccattgcgtcagtggttagttgcttggaggaaaatggccgagcaccacacctcaccttcccttcagggccggccttatcatccttttttttaagaagaagccggcaggcggcagggatccccgttcgctggtataaaaagagtgaaatttgcaagtgatccctaagcaacccggtgaaacaaacaccacgtaggtaatcggggacgcagcttttcttcagcagcaggttgtacgtgccggtaaacgcaggcgtggtaggtgaacttgagcagtttgccattgtttgtttattagcacattgttctctcgtggtggctaagattctagaacctttctcctttttcaggtcacagattggctcgggacgggcgagccaactaaaggc

SEQ ID NO: 489 - DNA, 1970 bp, Zea mays
  misc_feature (1)..(100): optimal_loci_315319_G1, chr9:107855126..107857095, Cluster 3
ggaagtgaaattatataatctcgcagattataatctcaaatgaagactctcatagtgcagtcgctgtagggtatttaagctcgactgggcattgccgcaaccttgccgccgcgcgctgccgtaaacactaggccgagaaggtgtgtgtccgtggctccgccgcgcgtgcatgtgcatcgaggtatattaatcacggtcagcggttgagttggccggggcacgtcagcagatggcaacggagaaaataagcgaacgatggcttagttgtgaccatgattccatgaaagggataatacacatacacatatgccactctcgtcgactatgaaagagcaaaaatgcacgatagagaaaaaaatgagtgtactagtttagaagaagaacagatctagcatgagagtttttatttggtaatctaactaatctataccactatataacaatccaccggtataaacttcgcaaaacccaaccaaccaaatcaccctcgcatctatgacctctaataaacgtaccaaacaaattacactcagacttaacacaccatcaaaactaacaattcagattgttggataacctactctcttttactcatccaacttcaatagataatattatttggatcatccttcatctccccttccccacgacccctcatcctcccctaactcacgttgccaccaccgttgacccctccctcctcaaaatcataatgttagcacatcatatatgctagtgttagataaaacatcatatccttctacttaactcatcctcctcccaaatcaatctcgccccctccctctgtcgctgcaagtatcaccgaaacatggtacaataataccatgttgcatatccttggaacatcgttcccgttctaagaatgtgggaacaaaaatcatgtcctcgactcctcatagtaggagaatgtccattaaaaagcgtactatgctccttgattgccgctctccatgacccaatcatacctagacaatggcggacctagcatttttatatagggtatgccgcaacaaatttttcgtatgcagcagtcaaaacctcaacttataataaaaagggattaatgttatatgaagcatgagcatcagaagagacccttgcatatttgcatccacatatgaacgtgaaagaatgattttgcagcactagctctccaattctctcattaaattctaaccaccaactaagcaatgtgtgctacagacttgcacataaatttcaactctatcaaatacattttgattctcaatttttagaatctcaccacattatccaatagtaataaacttcaccccacttctgctacaattgtagcactggttggctcatcatgtatctaaccacatagagaccacaacgacgaagtagcataggaggcgtgagttgagaaatgctcacctggaaggccggtgtcgtgggcgacagtagcgggccaccgaccgtcgtgtagacgaggccatagggaggtgaccataatgaatgcagatggggagccgagaatagggagtgcaacgagtcacagcgtcatggcgcctgacgcatggcaccaaccacgatttgatgcccggcgactgactggctgtgatgaatgctaggacgacagcggcgacgcaagctctggtcaagtgcggggctgaaataggggcagatcttggtgggctgggtggttgccttagggtgtgccacggcccacctaaaaccccctgtgaacagggtccgtccatgtcaccgtaaatttgaacttgaagcatgcacattattttagggattagaaagaaagatagactagtcgtaggaccccatctagttcatttcaacgtgtcttagtttatctactaaattgccccgaaaagaacattaactcctatcaagttcatggcgggtcctatcagaatcttatcaagttcaactctcgtctagtttcttccaccatagacacactaatgtcc

SEQ ID NO: 490 - DNA, 1442 bp, Zea mays
  misc_feature (1)..(100): optimal_loci_31876_G1, chr1:195796502..195797943, Cluster 3
gtcaaactactcaagtacatgttaaatttgtcgtgtacacaccaactatcaggtgacaacattagttgaaatttgtagattttattatccacgatatctaatatagtatgtatataagttgttggcgctcattctgctaattcacatgatcaccttctttggacattggttgtggggctatggcagaggcgagtcaagtggtcagctaaaatcggcaactgcctagccagacgataggatgaatcataaaggggtgaggttcagatatcaccgtctgcaaacgaattaggattgatgtttcatgtatcgattggtcattcaatgaatattttatcttatatgctttatctcttttagactttggttgacatactataacagagttatggatcattcattatcaaccactatattaaacctttggttaattgtaatgtacaaaatttagagtatatatatttagacacacaaaatttagactatatatatatattttttttttcttgtacgtgtgtcaaagccttgggaggggtcatggcccctgccggcccccctggctccgcccctgactgtaagtctctagcgtgagcaacttgtctcttttcaacatcttttaagttgaatttgcttcaaacttctcttagacttctataagattatctagtactagatttcataaatgtacatcaccacttaccactaaacttagctagatgaagctacccatccatatccccatttatagtatgttcaaataaaaaaaacaaaaggtcgtatcgttaatctatgtatccatcaaatctattaacacttagaactagtcgattgttaaccttattgatcgttctttgaaaactgagaattaaataccatcaacaacggcacgaaaaccatgtaaacccaatcaatcatcgttgttgtgttccaacttaaattgttccggtaaaacaaaaacatatatcaattataataatcaagtgttattattaatcgttgaaactcaactagtgacctactagatgcttttattaccaaccagcactaaatgtcatctgatacctataaaatttagacccgggactactcacgttactcatggttttagctctagtcaagactgaatcaaaatctgttgtgtgctggcgtcatcactcgtctttaccaacaaatattctcagtcgcctcatgcagttcagcaaatggattgattcgctttactcgtctgaccacctgtctgtcccatccggaatcgttgctcctgatgagctctcaactgctgacttacctagagaggctctcggatggcatcatctgcacagaataaccacagatagatgcctatgcttctctgtagcttcacactctttgttatgcatatcttgatcttgataagggagttgtttggtcgtctctagaaggagaatcaggtcccagcaactact

SEQ ID NO: 491 - DNA, 2604 bp, Zea mays
  misc_feature (1)..(100): optimal_loci_320242_G1, chr9:134558944..134561547, Cluster 3
cgtcaagcctaccgcaatattggactggactatacgcactagtacaaagatgatttatttcccctggtgctggcgatttttctactgcatggtgttcgatcgtttagagaaatcactagtgtaaatgtgacattcacgttggaggttacgttgacttaagttccgtagaaaaattacaaatcctgctgcttcaattcacgattagaactgttatccgagctactttttttattggtgacgaacttgaaggtctaaaatttataaaatacttcgaaggaggcccttccagaaggttaattaaccccccccccccccccgcctctattttttacatgaatttttttcaatttgagacaaatttagatctaggattttcatggctgagttttgagagggagaaagaatggtaggttttggtcttcgttccttcaatataaatgaggttgctgtaaggggtttatttaattcctcatatctctttttgcacgagcccttcttaatttccgtgaaaactggatctatagtttcgtggttttgttttttttatgagagagaaagaattgtagtaattttagtatacggtttcatgattatccccaaaattttagattagtggggttgtcatgtgtattcccgccatatatacatgtacctcatcaaccattaactttacaattgacgcatacgttcaaatacataataaataatggggaaaagtgttatctagatttcaaatatgaattagtttcttagattaggctacttattttattcatacgagtaattattgctatatgagcagtggcgaagctacccagtacgtacgtagggattattctggtgagcgagtacgcgtgaccctgacacacagctagttttatcttgtctctgacgccaaaggcccacagaacgcatcgatatcggcctgaaaatgacaaggaatgtagcgaaacaaagtaacagtgtcctcctctccgatgtcgacatgcatggtttcgctcgtttttcgatcgggaaacgataaaatacacgtacgcgcacgctgttctttgtttaatttaactcagacaggagacagcagccgtcgtcaagtgctcgtcccgggcatccgtcccagaaacacgtggtggatgtgcacggggggtggggggactatacacgttgacaggatgcaggagcatgcatggcttccaggttctccagcctgctaataatataataacgtgcgtgtctcgatccaccgttcaactcaatggcagttagtgcgggcgtacgtgaccgggccggccgctattagttttacctgctgagaggccggcggccgagctatctatctatctatcaatcgacgacaatcgccagcggcaggcagccacactcacgcacaccattgcaaagtgacagcgtcgcgtgcgcgcagtgcaatgcaggcaactttctcatgtgtaaagggaatctgctcctcttggtgtgagtgtgtgtgtgtgtgtggtgtctgtctgtctgtctgtctccggcgagaacagagcgggcgggactctcatcgtccaggcatgcacatactcgcggtggcgggcttcaacacatgtcgctcggagtaaaaaaaaaatgcgtgagactgccggactgcgatctcaccagcgtgctagcgcgcagttctgatccgacgaacaatgaattcgtctcttagcttgcttcctcccagtcccagtccccgcatcaaaatccatgccagcagagcaggtacgaccacgacaaggagccgtactctttcagcgcgacgctggccgggccgggccccaacaaaagcgcgatcccaataccggaccgcggagcgcaacgtacacgcatgtgccgacgccgtgcaaagtcgcgcagcccatggacagagcacagcactgccactgcctccgttcgtgtcgctccgatccgtccattattggtggtccaggcagggggctgcagcagagtcccgcccccccccccccgccccgcgcgcacacgagactccactcccctccacagcggaaggaaccggtcgatccgtccaacgacgggctcacccgcctacccggcggtcgggtcgacaggccacatgcatgcgcaggctgctgctgctgcaaccgtgggctcaagcgctgctggcctatatggcctctgcggctctgcctccctcgctcggctggggcgcggcagcatgcgggcatgcacggccaccgccgggcgggtacgccacatgcatgcgcgcgccaggggcaggcagggaaggggccggtctgccggagccggagccggcgtgcgcgcgcgcccgcccgtacgccatgtgccaggggcggtggatcgatgcgcccggtccaccaccctatcccatcactcaatgatgcagatcgcgcgccctagcaagcagtagctcgcgtgcatgttgcacccccatgacaagtgtgtcgtgtgatgtaccaagccaagacatgggaaggggggctaataagccatgcatcttggtcggttccaagtaacagctcgatcgcgaccaccattcgctttgccattttggtatgcatgcatgggcgcatcgctctccggatcggatacatgaggcacggg

SEQ ID NO: 492 - DNA, 1667 bp, Zea mays
  misc_feature (1)..(100): optimal_loci_320522_G1, chr9:135811778..135813444, Cluster 3
gactgtgagtggcacagccagcgacgagaccagggataaattgacagacgctaatgataaattgctacatggcgtgtgcacgtggttctctacgctatatgcatatatagcatctgtaagttaaaaagaagatgaggccagggacaaagagaacggacgaactgcgctgtaatattacctggctgcaaagccaagttgctcgtgaaataatgtcatccttgcacacggaagcgactttttattggacgtgtggtcttttgttggaatgttttttttctattgctctcccttcagatgtgccaccagaaatagtttatgattccatcaaaaaccttctttagcggcttgtgatatagccatataggtagctctgcatcttttccaaacgtcagctatggaaaatatggcaccagctctgtaatgtaatattgcccagatctcctttttctgaagatagcctttacataagtgttacggtgtttcgggctccaatccacaaggctcacggatgagatcgtttagccatccccttaatcaagtcgttagcagtcaaaaatcttttggtgcagcaatgtccaagccaatggaaaacctgcatttttggtctgtctgcgccctccaaattaaggttagccaatgtttgctgaaggtacccgtactgtaaatcgtattttgtacgcgcatcacttgtcatatattctccatgcgctgtcccagcgcccgtcgtatcgtattgtgtccccgacctcgtcgtgttcaaccgaacctgttgtacggtttctctacgagttcttcaccgttcacgatttgttagtggcaatacatgacctatctatctaattgtgttccatctagggcttttgtttaccccctaactttctttattttgcatatttttcaatagtttggtagctttgcgttttattagtaggagaggagtcatattgttggagctattcgttcttttgcatctgcagccaacgtactgaaggtcggtccagaaggaagtgtcggagtcatatgctctttgtgatgagcgagacgatgcaacaagcatcgttcagatcagatgctgttcacatgagctccgtcatagcgttggtcgacacggcgctcccttcacatgcatgatcggctcatcaaaagcacttcacggctgcccgtccccccggcctccaatcttttttttgtgcccatgctttccatcagtgcacgcacgctgtatagattcgtcccaaatttaatactgctggttaaatactactctctcttttaaaaaaaaatacaactagcacaatgtccgtgtcttgcgacgacatataatttaataaaatattatctcacaacgattgtatgaaaacgagccacgtatatattataatcgaccttaatatctcacaaattgtttcccaacattcaatacaaattctggtttgtctccttctcaccctcggttgttcagccacgtatcaccaacggcggcggctcctcctcctctcactcagctattcttgccccgttgtttgcagaggcgtatagcggcggagagtcgcatcgcatggtcgtggagagtcactacatcggtttaaggcgcttgccgacggggtgcggaagaatctgtacaagggaggtaaagacagagaaagagatgagaagttattaggggt

SEQ ID NO: 493 - DNA, 1784 bp, Zea mays
  misc_feature (1)..(100): optimal_loci_320772_G1, chr9:137035537..137037320, Cluster 3
gtccgttggcaagtttttgatctagcaaaatgcaccagcaaaatatgttatgcgtagcaatgtctggtgtgctgtgagccggtgagtacacaaaacgatgaagagccagcttgtaacacgcagcaagctagtagggccgcggtttaattgctaaccggccagtccgtcgtctgtttatctctacatactcttctatatatgttcatcagcaaccaatgggcgaacaaattaaaagtgccgcgcggttggtcgagtacgcaaaatgcatttgctagagcaggcagccagccgatcacgcgggagacggagaatgtgcttggtttgaggaatgaagggattcacctttttatttctcatttgttttatttggtttgcaaaataaaataagttgatttatcattatcttatttcttataagctaataattattatatacatgaggagtgggttgattctattaaaattcataaaattaacttatgatgtatcatctgatgaagcatatagtgactacagaaacaaacacaccagaaataaaagttttttgtttgcattgcatatatattgtgaatgagatcgatcagcgccaggcgtatgtaacataacagtggctagctaagtaatagcagagatcgaccaacgaccattgtatagtcacatcacaaggtgcgtagggtcgtcatttctgtgctcgtgggaacgaagacgggcgtggaaggaagaagacgcaggagccctcggttgagatgagaagcgaaacccagggtgcgcggcgcgaaagtgcctccccacttgcggcgcgtcgcgacgtctcgagctgtaccgctaccgcccccagagccaaccaggccaacttgcgctggcagagcagaggcccctgtcgttgcctctgcatctgcctgccctgcctgccggttccacccacctatcgcgtcgcgcccgtcctctccctcttccagcttccaccgcccgttttccaagtcgctccttgacctcgcttttttaactatagcagtagtacacaatttaaggagtaacttattattattacttaccggtaccaatgtcatcttcgtcataattatactcctttcgtttcaatttataattcgtttaacttatatatcttaagtttgatcggctcgtattattaaaaaatataattattattaattttgttgtgaccatataatatactttaaacgtggctgctttgaaattttcattttccgccaaaaaaaggacgaactggtaaaacgtactaaaaagtcaaaagaattctaatttagcacggaagaattctaattccgcaattctaataataataataatataattattattaaagtagttttcgctgacactgcgacatatagacagataataattaacaggtcgcgacatgcagcttgtgcgtacgttgcggcgatggagaccggcggcaacttgccgttggtaaaagacacaagagggaggagctaccacgggccagttcagcacacgtacgtgacgtgagtacaaaatactgcgcaagtggggtggggcgatcaacttgcagatcgcggtgattagcagcagcaatctggcttatggaccggtcgatctttctttcctccttgcgccctgtcagtgcttccactttcgtcgtaaccggcggccccggccccaaaaccactttgccttctcgttagctagctaagctacctataggctgcacatacataccggatccgacatgatgctgccgtgccaagttcggtctctcactctctctctagtcttta

SEQ ID NO: 494 - DNA, 1408 bp, Zea mays
  misc_feature (1)..(100): optimal_loci_321523_G1, chr9:140793464..140794871, Cluster 3
tagatgtttgggttgccacgctcccaacttagtgatgcctttttatacacaggcacacatctcaatcagaatgtgtgatgctctgttctgttatgatactactatatcatgagtagtggatgtccaaaaaaaaattatgaaaaccaaattatgcttcctaacaaactctggccagaaagtatccttgacgtgcctcttgccccttgtatttcaagcattccgcttcctgaaactcaggcctaacataagattttcatctatagggcatgatccattccattcaaaatagtgtcaatgctgaagttaaacacagccaaatcctaaactattggcctctcgtctttaacatttttctctgtgagatggtaatggatattattcgtacgaacattcactttgacagaactgcaagtagacataacgtcaatagccaaccaatgatcaggtgggttctctgaaacctttttagtcattatgtgctgcttcacagttcaccacaactaaagaggatattgtacagaaagcaaaagggaaggaaagtaacagcaggacaaccaataaagcattttaccaagacaagtgtctttatttatgatagcttctatgtatgtcctccagattggttgatgccagttttcaactatgtctcgctcgccctctcacatacaatttgttaactgatacaaaagtagccatcaactaattcagaagtaggacactgctacaaactaaacctggtattctcaaattaaatgatataatagtgctttagtaattttgtgaggatctaaatttcaaaaatatgttgtaaccttgacgaagcctcccgacttaaccagcaacagctcgaccatgtgtgtgcaagtgcaattgctatgaataaaaaaagctttcgtagccgcttccgggacaaagttgatcaacgtctcgccaaacatcaccatctggtgtgtgcaagtgaaattgttaagaataataaaaaagctttcacagtgcttggggaatgaacatgccaaaaggttgttcctgaaattctgagtgcacggtaaaatctaattacacccaaaattaaatctatgcaaactattttcaaagtgtaacattattaagtgtatattccatggtgcaagctggaacacgatcactctaagaatatgtcagttacataaacgacaaacaagtgtacttttagaccaatcagcacgtctatatgacaacacaataccttcgagcagtcagtgatggacttcttgtactcactaacctccttatgaggaagcacttgaaaacaacacttcgataatgacaacacctcgaaaattatttaataaagcaataatctcgtctagaatagaaagcactgaataagaagagaaccactctgacataatcaagccacattttcacg

SEQ ID NO: 495 - DNA, 2327 bp, Zea mays
  misc_feature (1)..(100): optimal_loci_322780_G1, chr9:147418573..147420899, Cluster 3
gttgctaaacatttttgtgatgctgaaggacaagatgtgcttctgtttattgacaacatttttcgtttgactcaggtaatttctgctaggcattacttttgcatgaaaatgatatgcatcttttggagcgataatctttgccggatgtgatgaaccctcctatcgtgtagatttgtggcttctttgttgatgcttgtcatttagcttacatttgctcttcttttcacaattcactgttcctctggcagccaatctgtttgttgtaactgacgtacttatattgtcaaaagggtatagtttgattaactatagctcatggaagctggaggggggactcatttaaatgatccgaaatttactgtagtttctatattcatagcaagtaaccatgagatcatttgtatgtggtttaggtcaagtctgttatttttaaaactaggagctttaggtacaattgtgaaacttagttgtaagggagaacttctgttgctgccagagtttgatgtttttggttttgggattcagaaaataggctgatctatcagtgcagatcatgactatgagacttcgtcattgctctctttagattatgtagctccaaacctccaacaaacaactgttaccagatgatggcaacaaaagatgatgctcagaggatgaaacaagcagcaaagtagtaggaactttagtatgtatttgtgatttcgcaaaatggtctttatggagtagttattggtggtactatgattatttggtacatttcttggtttgtagagggatactgtaatttctccttctccctgctgttattgatagcaatcaaaaaacattagaaagaaggtgcatatggtactactttagaaattaccattgttttgttggtgtggttgtcgaccatcaatttatatcagttggtgcttgaaccagttttagagtttagttacctatactgtactttgctttatccataacaagtacacaccctattgaagaaaaccggacatctcaatcaagtcgggtcaccttaaagctttactatttccccttttcttacatttcctaagcactaaggtactcttagagttttactttcatctcatacatacaagtcccaatgcactcttaatgtttcatgatcagtttttttatatgtatagaacaacagacaagcacaaacagaccaaaagttgcatctattttttatatgtatagagatgcatccggcttccaacaattgctgccctgcaattcctgacagatattcgaatcttttgctcatcgaattcattgactgtctggccggttagtggtagctaaatagatagatgactactcatgtatatcattatttccctgtccttataattagcattgtttttttcacagtcccttgcacaactaaggtggagcctgacaaagcaagagtggttgcttgcaaccggcctgacaggtattttgttattttgctcatcgaattcattgcctgtctaatttctgcttacctgattcctacacagtcgaattcattagctgtctaatttttacacagtccactttatgttggtaattgagttgattatacaagctaaacttatttaaaggtgcataaactgggtgcattttgagtttttggccaccacagagccaacctggccaaaatggaacaggagttgcaaaatgatcaccatagaacaattcaggaaacaagaatgttgtgggtcatcataccttcttagtatccgccacctcctgcacaggctggttcactccacttttgtcatctttgtttccttgaactaccacatgattatccatcctatacatgtaagatcttggctgccctggtctgctagccccatcagtttgtgaatgcaaatgtggtggcaagggtggccgcacaccaccagcagcaccccaagtgctccagggcctctttgtgataatcctactgacccaaaataaattagcttgtgagcaacagactgattctgttgccatgatggcccattgtatgctgttgaaggcaagcctgtagctcgtaacagtgtctcatcatgcctaagagagtccggaagtgctgggggcagagtagttccagcttggtgcctctccattaaataaagatcaacacaaaactctctcaaagaaagcatgccatcattgtcttggtcagacaaatcccatacctgcttcaggacctctaaaatggttaaaagagcgacacgtgcattaatggtatttcatactatgagatatgtttagtgatcatccaaaacaacattatttattgtgtattttccagcaggcaatttgcatctcccaacaac

SEQ ID NO: 496 - DNA, 1496 bp, Zea mays
  misc_feature (1)..(100): optimal_loci_324117_G1, chr9:153622994..153624489, Cluster 3
cccggaatcaaatgaaacggtcggatagccacaggatttactggttaaaatttccatcgtccctaactgctattgtcggtcactttcttcaggctaggccaggaaattgacagtctcgacggccggcctttatttttctcctgcataaaaatatccacagtctaccgtatgcaaggacgatatagtacttactagtactacgggcttttgttttcaaagctctacatcatcactacttgaccctcttgcaagtctaggtgtatactgcacctgtacaaccaatccaagtgacccggaatcaagtcaaacggtaatgtccagaaaacttgccgggaaagattagaaatcttacaatgtcccacgtgctacctttcaaagatcgttgaactctggctatattgtagatcgctgtgggttttctttccataaagtaattatattcagacactcgctcccaccccagtataatacagttcattatatagtttccaaaaatatattgaaatatgaggtattcattctacgtgatggacatgctcacacttgataaattttgtgaaagaacatgatttgagcataaactttttaaattaggttcaatctacgggtatatatgtcatttgaccatgcgttgagaataaccttaggccatcttcaacagatcccgtattctatttcatatcacattctttattttaaactttactatgtaaacagtgtcatctactaaagacgaccttgtagcacacaacctcctagagtcctagtaaccgatgcctatgaccatattttaatatattttaatctattggcatgtatgatggagtgatcagttgatcgagtactatcagcagcactgtcctgactactccctcggcccataaaaaatgtacacctaccatgtcagcatcgattaatttatcgcaaatttaattaaatttataataaaaagaatcggtatttatgcttttgatataaatttatttttaaaatatattttatacagctattccaataatattcatgcatgttatattacgattgctcatacatatttatatatataaatagttaaagtgctccttaaaaagcaagaattgcgttttttttatggatggagagtaatagggagccagcacatactgcacaggtcactggtgctagcaattttttaaacaccgtgcgagtggaggttactggttgtgatctctcatctgatggatggatgattctctgataatccctctcggtgttggtggcgcttgcctttcatttcaaaatgggccgcgaggacgatgcaaccggtggcggcatattctgccggggcgccgtcgatttgggtgcggaccatatccggtgcgtggtcacattgttgccgaatggtgatgcacgagcacgacggcgacgagcttgtttggaatatatggccggtaggtgctgccaaacctaaggagaaattttgtactcccctccgtaccaaattagaatttgtttta

SEQ ID NO: 497 - DNA, 1534 bp, Zea mays
  misc_feature (1)..(100): optimal_loci_324981_G1, chr10:2424147..2425680, Cluster 3
cttactttccttcacctcacactatatatcttaatgtgtttgacctcgtaaaatgacgtccgtatagcgaaaacatcatattgtgtattcgagcacatcacttatatagatcaacgaacggaacagtatgctcatagaaacgagtccaggtgcaggaggaggaagtaagagaccctgcatgtctgatcatgaacatacaacttatactagttagaaatctgttctatagctatgcaacattctcccacaagaccaataggcaacaattaatttgattcaatcctttggtggttgcgagagtgccgggggcgtcgtcgacagtctgcttcgacttcggctcgcggttgtgtggtgcgtgcggaaagtttttctatccggttccatatgcccggatggagggggtggcgaccgatgcagttttgcggttgctgcggtagccggcgtgtcgatgccccactcgaagggtttgggtcagggcagcggcgacagcgaaggcaacttgatctgtatgttttcatttagatcgcctggggttgccatagtaagtcggagctgctggttgcattgcaatcatgcttgacaacgatgactcatggcagtttgtgtgctcttccacgtcacgttggtgggttagctgtcctttgtttgctccattaagggctaccagtttgtatttgttaggttttggatccggttttttcttaaaacaggtcaattcctttttttttcttaattgagaggcatagcttatctacattttcatcttaaaatactgaaaattggccataggcaattaatgcgtgtgatagtatattgtaatagactagcgatttatttgtttaacatcacataaaaccattgctaactataagaatattagaaaaagtaatggagaataaaggttggatgactcactgaaaaattacgagagggcaaagacttccacgttcatcattctttaatccttttatttacaagcccttttgatgattaaaacgccttaccactcagaaacggaaaatgctattagtgattttaatcattcatttaccaaggtagtaagagccagccacttttgtcttccatgccataccagacgctcacacaccttagggatttggacaaataacatataatatcaggtaatttcggtactgatacatattacccgatttacacaatataattttggttttttaaacctaggatccgaactattgtttgggtaggacatattacccgatttatccgatataattttggttttttagacctaggattcgaactattgttgggtaattcaggttcaggtagatcaaatacaagttcagatagttcggattcaagtaatgagtatcggattttttatccacccctaggcactattgtatcaacacaagaaggcaacatgcggagccggagggtttgaaaggatgctcgataaatagtacaaaacattgttttacagagtcttatacagagcagagctgatagctatgtagagatagtgaagtgaaacttcgaggccagagcc

SEQ ID NO: 498 - DNA, 1887 bp, Zea mays
  misc_feature (1)..(100): optimal_loci_326617_G1, chr10:11188716..11190602, Cluster 3
atggggaattccttttttacgtagggtacataaatggatggtgatatgtacgagcgttgagaattcgaagtatgttaattagaaaagtggtgcacatatgaaacaaacacctccattaaactggaaaatctaaaagatatattgatatttggcctcaaattgcatatatatacattcgaaactcaagagtttgactcaggcaaagagaatcactaattatgtttaacatattaatatatttcctgtgcgcggttttgggtgatgaacatgatctacagtattttttaacggtgcgtgatcaaaaatcgacatcaacaagacaccacgtcatcgctgacagctgatcggccgccgtcgctacagccgtgacacgcatgcacgcgcgcgtacggcacgcgaggtttccagccccaccgccgagcggacgagccgttgacctccgacgacgacggacgacttgcattgcatgcattgcatgcatgctgatatcaaagtggcgcccgttgacgacgacgacgataatggcggagaaagggagtactggagaggcagggggtcaataagcagctggccaccgttcatgcaggacccttttcgctagcccagtgatcgatcagtcactcgagcgatatgatccactaactagagttttggtgcggcggcacatgcatgcatgcaatgcaacaacagtcagctagctagctagctgactactcgtagacggcaacgatctatcgagagggcgagccgcgagcgttaacctagcaagctagtatagctaattaacctacgggaaattaaagctagctgtcgtcgttggagtgatggccggccgagttcttccgctcttccgcactgtcaaagggactgactgatcactgtcaaccggtcggcatcatctctcagctcctttcccctgcttgtacctcttctcttccgttcgtgttccactcgtgtccatttcgttagacgatgatatagttttggtgcatgctgcacgcgccgtggggtacatggatgccgactaccccaatatcatgacactcgatagatcgcgcgcgtgtgcagcacggggatctcagtgtgggttaactagctgggttctcgggtgggtttggttcagctaatgttttctagctttctaaattatattaagtttagctagtgttttttagactttgccgagtgtcaaagccgaagcagcacaggtacgtagtgaagctagggtccacgacagggacagcacacatgcatggccgctggaagatcgagacgcgcggccacgccggtcatcgctaataagtccgtccgcggattccagtgccctcccggctcccgcgcgccgctcgttcgcccattgaaaaattccgctcccagctagctagggccttctttaatttagccggagaccgaatgaagaagaatactcctattttctttcttttataaattttttttaaaaaaaggtggtcgacgtacgtacgaaagcaacacaactggtccaggtcgatggaccggtcctgccgataatctcgcgctacagccagtggcagtgcgatgcgatgcgatgcgatgcgagtgagtgcctgcgcgtctccgtctggccatccgtttcctctttcgagcttatcatgatctatatccgtctgtctacctaagattccttctccactttccctccctcatgcatgctccggttctctctctctctctccagacctcctgctcctgcctgccttgctagctactagccacactttcttcttgccgaccgatcgatcgagttgacgtcagaggccggcaacaagggatccgttccatgcatgtccaacaagcaccaaggttctcatgggtgctagctaggagtctaggactagagtgccgtgt

SEQ ID NO: 499 - DNA, 1989 bp, Zea mays
  misc_feature (1)..(100): optimal_loci_327208_G1, chr10:14462164..14464152, Cluster 3
caacgacatagtcattagccacacaagttcattgcaagtttgcaacacggttaagcggtatattctcacgttatcattggcatattcgccgagtctttaagccagtggttcggactgctatagttaccacgtgctaccgttatctcttgttttattttcactctgacgactcacccacaacgaagcactcaaaataaccaacaaaaaaaacaagttcccatgaaaaaactctccgaaaatgcaaagctagagttgttcgcttcttcgacaaaaaaaaatgtgcaagatgtccaaaccaaacacaccacaggttcgcatctagcgattggatgcttttggataagtttcttgctagagcgtacgtacgagagcccaataaaacacccatagaccgcgagatggacacactagttaaaaaacattttacacgtggaaactgtactagctggccacgacgacgtgtgattacatcagcctcttattacacacacgcttgcctttttccagcgccttgtttttacatcgattctcgacggccgcgccgtcccgatatatatacatagtttatgtatgtggagctctgtgtttctaataactagataaagctctggtctaataatatattcgacacaatcatttctagccgaaccaaatttttatttggaggtccattattttagcacaaaccaccagcgtgtttctttaccctaaacaccacccccatttctttgtctccaattttcctccacggcaccgcgctgccgccatttccctccattcactgataggcaccatgcctccgcccatggctagccgcgtcttccgtcgcgtcgctaccttcggtctcgtcgccgccagtgtgaggttcctgcatcggtgtccaagttgatgtcgccgctctcggttgaagttatcgtaggtggcttgcaccagctcgtcgtaggagatgatggacctgcggacgtccatgtccagcgggtccaggaggtcgttccacgagttgttgccctgcagctcacgccacctggttgtcgttgccgacgacgacgggggcccgccgccgcactgctcagcgatgaaaccaggaaatgcgtgaagtaacaacatcttggcatgtgattgatgaggcttattgtatggtaatgctcctagattgtatgctgtaaattagatattaccttgtgtcctccacatcttcacacatatatatggtgtttatggggggggatgactagggtgtcaagtagaaaaacataatggttcaggttctactgcacctctttcaggctaagcgtctaaacaacaatatgtaaattatccttttccaataaaatacatgcttaaaccgtggctgctaggtgaatggttctactttagtcatcaaatgcaggttagcttatctttttctaatgcattattatttgtggttttccatcaaatgtacgttagcttatcttttagcaaatttgtagatgatgtcaattaactttttagtggaattttatctgctcattcttatattcaggaattccactactatatgtgccacttgaagttgttatgtcaaaatattatggtgaaagcgagcgtctattgggatctgttttttatcttgcaaatggtcttcctgaaggaggtaatatattcttagatgaggtatatatcgtaatccttatagcatacacactcaagccattgcaaaatgtattgaaaataattattgtgtgtatgtgcgtgttgagacaccaaaattcatgaagctacacgaacgatcttgtccagttgagtacatactgtcaaaatccatcagaaatatctaactgatagttgttatcggtagctctcctacttgatttgttaaatatctaactaattgttgatatatgcagggaggaaaagcagggtagacagaatctctgttggtgtctcctgttttattgtgttcatgatgatcctttcagtaatatgcctttttaggtagtaaaggaa

SEQ ID NO: 500 - DNA, 2065 bp, Zea mays
  misc_feature (1)..(100): optimal_loci_337020_G1, chr10:77294005..77296069, Cluster 3
cactgatgatatatatcagctggcatgcagcgtacacacacataaagatactaatcctaagatcaagtccagagtgttttccagtacgacatgatatgatgcaatacatagatacggtacaagaggttaactgatctgatcggatcggacatttatatcccagctgtggcagcatgcaatgggcattcttcagtttgttctgaacggccggcagtaatataatggtgatcttggagcctcatgacaaacaagaggagacagcagcggaaagctagatgcgttttgagacagtgcatgatgcttcgtcacgtacagtatttgtaaatgccaactgctcgtgtccatcaaattgatgaatgggctacggcctacgagtacgtcgtgtcgtatacagggagcgttgaatctgtgttgaccccagcacggtcctcctccatcagtccatctccttttgggtgccggcttcagctgtagccgtacgtcgttgctgtctgtcatactcaacaatacacagagcgagtgagagagagagacgaccgctgcatctgcatgagagagagagagagagagagagagagagtaaatgatcacagcaatcaagaggcgctgcctgccgcagaccaagggagagggaggagggactgcacgtactggagagatgaagctgagctctgcattgcatggggaaggagcagcgagattgctgctgccatggcactgcagacgaccactgcactcgacggcaccaagagggagacgacgacgagagagaaaaacaagggaggaaagcgaggcgaggatgatgggtcacctcagcggagagccgccgtgaacagtgcagcctctgaccgtctttcccccctcctcgcgcggccgctgctcccagcagagagtcccaactgcccccctgcacggctacatgaatgaggccctcccactcccatgcaacgtacagtactggtactccattccatgggaaagagccgcagcgctaagccacgctgtagccgtgtaggacactgggagtaggacaagggggggagcatgtacatagctaggactaggcactactctgtactaccatcatgaggtaatcattctcaaattattgacacaacggttcgacgactcacacattatgacattatataccaagctaatgtgatggcaaaaacttggattatatttgattgcctacaattctactcgaacttattttcaaggaatcggctcgttttcaaggaaaaaaagcatagtaggtagtaggaaaaatcaatgtgttgttccaaagggagcttgctaatttagttttttttttttgaactgaatcatactgctgataatacatcagagaggataaacctgatggagactgccagtgtgtgccttctagctagatcgaagaaaaattagggttggcttattgaactttgataaactaaattatagggccgaacaaacatctgaagtggcatatatatatgttgcagcacaaatgtaaaaaagaggaaaggctgaacggggaaggtggcgcgatgggccaataataataataattgattcaaaagcaaaaggatcggagcgccaccaactacccgatcttgacaaaatccagcacaaagaaacggcccaatagcagtgccgaagcgcttcaacattggagcacgaattaggaatgattctattatctgtataaagatctgaatgaaaacatgcacacacacagatgcatggaacgccagctctctcttgcataaaaagcagcacgaattaggaatggttggcacgttccgaagcacaactctcttgctgggccggaattgcacaggcacacgcatgcaacggggaatccgatccttcgggcctgctgcagccgagctcccgagtcacacaactccacgttggcaaggaaacggacatcgtggcccagccttcacgttaatgtttcctgttatggcctgctgcctccagaaacataaagcccgccaggccgccatggtgcagccgtttgggcccaggcccaggctcaggaagaggaagtaggcacagcgacgggcctgcgccg

SEQ ID NO: 501 - DNA, 1766 bp, Zea mays
  misc_feature (1)..(100): optimal_loci_337961_G1, chr10:82174829..82176594, Cluster 3
ggtgttcgtttaggtctgagaagaaatggactcattttgaataggcccggtttggactttttttattccaccactgttcgacattaatcttggtctagtgccctccatatccaatctgtaatgctggcggcggaggaggcgaagagacgacactgccaggtgacagcgtggcggcgcgaagcagcgacgacggccaccctctccgctgccttctcactagtaagctctcgttaatgctttcaaacatcgcggtggtccatccggcggcgcgcacgtagctgctgctcgcgcgggtgcagaagccggcgttgaggcagctctcgccgccgagcacgcgagcgcgtgttgacgacgtcgtcctcggagacgaatcgctcgcgggggatagcagggacgcgtccgccagcgcgtccgtgaactggccgccatactccaggaggagcacacgcgagtgctccgattagataaggatgccatggctcgattagataaggatgcacgcgcgagcgctcgtcacagcccatcatctaatctgtgttggttaatgcgtttgtcctctaggttggatccaatctcaggctgccgaacagagaaactggccaggtttcagctagaataattctctgatagaaactgacatggatcaagtgaaaagcccggatcaactgaaacctggcctgttattgttcctggcctgaaactgaaaccgggctgccgaacagggccgaattttgggaatctgctcttgagggtttctgatttaggtgttttataatcgtttgataattttttttataaaataaagtcactgctgaaagagtccaaattagttttgtacatccttcggctgagcacgtggagagtttttacaaaaatgcagctgagcgcgtgaggagaagagtgtgggaagtgaaacatcagccggttttgtgcatatgtgcacaaagttgggtacaataatggagcatgatgttcagtgtgtagcacatagagattgtacagcgttcatgagaaactccaacatagttggtttgggaactcggctaactatttcatgatatatacgtacatggcaagaagctctgcttcaacagtttgctcccgatgcacttcttttataataatcagcatacattatttggttcgttcaggtagatgagttgtctctgctagctgcggacacgttacatgtagcattaatatgcatgggttgtctcctgacttcatgtattgtcatatatatatatatatgtatacttagatgaatacgatgctctctctaaataaactggcatgagcaactggtggtggtacacagcaatatatatgtcatccgtgaattgtattgttttctcctgcagcaaacagtagaccaaaccgtggatcagtgtagtagtagcagtagtagtatatcacaatgcaagagtggttgatgcacgcgtgtgcttggagcgagaggcgtcgggaactccaacttctccaaaactgttggcctatctgcgttgtggcatcaggacatgtcaagacgctctcaagtacgcgcagcagtgaatccatagccaatggtgcttgcttgattagtggagcgcggcctggatgtagccgctcggcctactcctcctgcagaacctctgatccagcaacggcaaagcttgtcctatggagcctcgatagagcatgggtgtgtcatattcttttcctcccctatgtcaagtttattccatcaaagagtatttgaaacctggagctcagttcgactttttgaa

SEQ ID NO: 502 - DNA, 1513 bp, Zea mays
  misc_feature (1)..(100): optimal_loci_34077_G1, chr1:207722002..207723514, Cluster 3
ggaatttagagctaaaatttatgctcaaaatacggacgtatagcatgctggaaatagtagcacgatatggatctgatgctcactctctcggtccgacgctcgcataactgaaacctaacagggtcacaatatggtccgacacaaatggtctacctcgagcgcgaaggaaccatgtggcctgatccgcgcacaagtggaggcttagaacttcgagttctaactctgaaaatgcaagggtttgcaaaagactcagtgccacgaaaagtcagatcagtgccacgaaaagtcggataagaaaagactaggctccacctgtcctcacgcactctaacctaaaaaccgaagggtgctatagggggagacggcctgggtcgagccgatgccacgggatcgccatgaggggacagagcgcgctccagaggtccagaatggcagcgaccatggaggccaaggtcacgacgaggaggaggaggagagggaagggacgtacatgtttttttctcctcttgtgagccatcttttcacagactactaagaatgagatagtgatggatcaactcattctatttcataaatcaaacaaaaaatgaagagtgtcaagcatgcatatctgtggagtacttttctgttgtaagcctgctcgttaaatttttatacataccttaattacatacgacgcacaagtcttttgcgtattctgattaaaaaacgttcgacaacttgctggccacgctgccaaatctaggccaaccatcaatacatttatttcccagggtgacgatgcccaactaactgcaagatcagaaaggtgccggccggcgaccaggcatgccacccggccattgtccggcgagtggaggcgattgatgtgagcgagccaagtggcagcgcagcactggtgaaatcgggataatggcgcaatgcaaaaatctacatcgatcatcggcctagttaatttggttgagttgttgccgctattcaatgcaacgatcgatccatttggcagatgcttgagctcactactcactgatagaggagaacttttcctgccgtcttgttcttccttcctatcgagttcggtggatgtctccgctctcaacaggttacatcctttagacaaccttcgaatatgatgactacctcgacgagtcaagtaaagacgttgcttaatcctaactattctcgttttctcaaggatttctgaaagaagatgacgatgtgacttcaaagagatatataataatctagattagcatgaatatatatatgttactattctcgttttctcaagcatttctgaattctttttctttctttttgtttacagcaacaatattattgttctttctagcatgcatgcgaaccaattcaagtagtgcgaatatataggaccacaggacccaaaaggccacaggaacactttcactactagcagttggacaacctcacatcaatcagtttgaacactttcattcactactatgctccctaaggcgaaatagtcacgtacgat

SEQ ID NO: 503 - DNA, 1874 bp, Zea mays
  misc_feature (1)..(100): optimal_loci_344833_G1, chr10:119883096..119884969, Cluster 3
tcaaatgatatgtttatggtaatttgtgatgagtacttttattgaactttacgtatgttactcacattgtcagccacatcttagacaaaatcatacatcacgatgaaataatgcttgccaacaacattgtgctcgactagtgatgatgagactcatcctccatggttcacattcacagtttatgacgatgttcctctagacttaccactcacatctcctttgccatgaaactttcaaaccatgtatccatggacaaaaccccactagatcaaatgagattgcacatcactgccttctagcatccaaacacgcttgttcctatagtgagaacacgaacatatgattccctgataattcacatctagagcatgcttttgagcagtgtaaaaaactttttatcgcttgttatgtaaagggttgtgataatcttgatatgtggtacatccattctaatatgtccatgtcaattagccttgtatgtagcaaaatatatcaatatgacataacaaaatgagaggtgcatcacttgaatgcataacttgttacaaataatataaatatagacaatatataattaacataaacaaaaaacaccactagatagcagtatgtagagctttactatgtcatacataaacataagtatagtagtattacaaaaaaaccattcaaatgaagaacaagataagttttctctctcttctaccatagaactagttccacattaccgaaaacttgaaaaaagaaagcaaaataaggatgtgagagcgcataacaacctcctatgatgtcctccttcaaggaatccaagagagacattccacccctaaaacatggtgatttttggagttagcttcaacctcgtcaaactgaataggaaagctcatggaacaataagatagggtgggtgaggggtctgattttataaccatatattagagtcgggcatcctaaggctgaccacctatgttaatgaagccaataagggaggcgatctttgtagtagcaccatctctgttaatagttattaacaaagacaatcaacgtacatcgctatcttgattaactaaatgatggaggcgatagtcgtaaggcgtccaactctattaatgtactattaaaggaggcgattgtcttatgttgatcgcctctgttaacctttaatcgatgtgaccacttagctatgaggtctatcaatgattaaatggggggtcaaataataaaacaaatttatagcattaaatccactatttgttaaaaagatcaaagaataaaaggtattcaacgaatgacaaaaaagatttgaatataatgaaataaatattaaagtgcaaggcatattggtagatcctgtcgtgaagcccaaaaagttaatacaattatgaacaataattttctaatgaggtactgaaggccgttagggttacacaacaccgataatataggctagttttacctctcacaagacacttatcttaatcatagatgatgcaacgctagttcgaccgatcaaccatctgatagatctaaaatgacatttgatcatgaacgatatcttttaaagtagtaactcaaaattatggtcaacttcagcaatgctttctactttctaaccggtcggttagttcctaatggccatccaaaatagtgcgtgcctatgtagtcgaagcgaaggtagtgcaactgcaaataggtatgaagcgaaagtgaatgtgaacgcgtatacattgaaggatgtgcagactaacatgctaaaaaatgtaaaaatatgagttttttctctttcgttcataaatcctatccccaaaacacacgtgtcaagcatgatggacactagtgtttgtcttgacttaacaaatgagacataaggccat

SEQ ID NO: 504 - DNA, 1977 bp, Zea mays
  misc_feature (1)..(100): optimal_loci_347203_G1, chr10:133750759..133752735, Cluster 3
  modified_base (888)..(888): a, c, g, or t
  misc_feature (888)..(987): n is a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
  modified_base (952)..(952): a, c, g, or t
  modified_base (953)..(953): a, c, g, or t
  modified_base (954)..(954): a, c, g, or t
  modified_base (955)..(955): a, c, g, or t
  modified_base (956)..(956): a, c, g, or t
  modified_base (957)..(957): a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
  modified_base (962)..(962): a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
  modified_base (973)..(973): a, c, g, or t
  modified_base (974)..(974): a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
taatgtaatagaaatatttatatgtcaagagaaaagagctgattgaatttgtattttccttagtggagaagggaacgtaacagatgttaattaactactataaatgaaacacataaaaggttggtcaaatacgtaccatataaatacaaaggaatgaaatggttgtaaatttaaaaaaaactactatataaaaaatataaatctagaagtaagattgtaacacgtacctgtcttcgagcagggttttcttttttcagactaatcaggatgaacagtagatcaataacatgttaatgtggcagagaggtaagggtaaacattagctttcaatcggttgcagttaaaaaaatgctaacttagcaaatcttttaaaaagaaatgtcatattaagccatatgtacgaccatttcttcaacatatattcagtatttgtgcaaacttttgtaccggttgaccatgatattcttttaatctgaacgccaaaggttgcgaagacacctgaatcgacgatttcattttattagccatatcataggaaggaattgagggcaagcaaaaaaaaacaagcatgttgggattatgtggttactttctaacatgcttgttttatatatcattgtatctctgtttgtttctatagaaaaaagaaccatcaacattatagttccaatagccttatatataatatctctccttttatacacagatttttggtagaatcgtacaaactagcgcgcaaggcgcgcgttaggcactagtacagaactatgtctgcattcctagctattttctcccttcgtcacaaacctgcttgcgtttcacctggtacatcatcacttaataagcttatctggcaaccacttttgtgtggaactatatttttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccggatcttaaaaaatctgaggttaacgattcgccctttagtgtatcaccagtaaaatttctagccttcaattatcagccccccttgcagccttgcctcgtttctgggtccatcacttagggagtatctgttcatcacctagatacacaacttgtgtgtcgggtgttctactgtagcgtgctgctaatcccttggtatccatcaggaagccaccataggctcatagcataagttctgtcagcgttcagcgccccctcctgtccttcccttgtggttctctagcatttggtccctgtccaacctttgttaagatactgaacatatgttgccatgttaagttagtcaacacaagaattttgcgtagtgttgtcaccatgcatggtgctcttaggttggtggttgttaaaattgctttatttatttacatctccattgcacgccgctggttgttggcgatttcttccttttatctccaaccgactgaactttagttttcttatacagtttgaggctttgtcatgcctttaaatagctgatagctgattattccaaggtaatatttcttccttttatctgttcaagctggacattgatgagctgatagttgattattccaaggtaatatttcaaattgtctccatgcgtgcacatattaacttcagatgaatgataacatctccgtgttcctgattgataggagaactgtatgtcactctttgaattcaaacgagtgtggatgggcaagaaattttcttatatctgtgaaggcagacctaagacaaattcgggtttattcatgcaatccctctttctgcattgtatcggtagatgctggcttcctggaagagcatatttctgaactgaacccactgcacacttaccgataatcctttttgtggtcacagctgaactattttccacttaattttgcgctatactacatttactatctgtatgagtgccaaccatacaagccgcagttcaatat

SEQ ID NO: 505 - DNA, 2456 bp, Zea mays
  misc_feature (1)..(100): optimal_loci_347876_G1, chr10:137184019..137186474, Cluster 3
gctgttgctatctgatgcttgtgttggatgggattacagactttttatgcttttaccagcattattacaagttaatagttttgggattcctaaaccactaaacatccgttgaaggttctgcgttgctgaagataatttagacagaggtttgctcctctcaggcacaattacaagcaaataatactagggtgctatatagcacggttgttgcggcatggcaggcagcatttcgcgtccagggtacggtggtcacccacacgcgcgcgcgacccatcagatgcctagctagctagcttcggaaccaagggatggaaaggagtgccctgcacccgcgggcgtgcaggcagggtgcagtgcctcgacgtctaccgccgtggtccgtaacagtggagctggtgccgcgccgttgcctgccggacgtcagcgtacaggaaccaccggccaatgcaactatgcaagccaaccgtgcgcgctagaggcagctgcaatgcaatggtcaattagtacggtggtgagtggtgaccttggctagtcgatagatggccctataggctatagctagctagtgggttaagcgcatgtgtttgacctaatttccctgtgtcttgcattctactactctcgagtcccacttccatgtagtacatacagtccatagctaggtggacttagcgagcgacagagactgctgatctttcaaaattagagggttctgtataaatagtatgcacgtacgtacgacgatgattgtgcatggtagcattacatgtacaagataccactgatcaggcacttacgtagccacgaccatcaaggtggtgtcgtttcagtttcaacaacgcatggggtggcattattgtaccgccatacatcaaaccataactccagctgtttagtttcattaatatagtttagttgatacatcatcatcttactttacacagtgagagctatctatatcctgtcacgagggcgaggcaggcaaggacagcatgcagacaataaatagataagaaaaaaaaggctgattaatacttacaaatgatcaaacgacttgacgaagagtcaaggagctagtgtttaattaatagcctctagctaaggttagatcagcagaatgtacgtagttcgtctgagagtctatatatatatagtcgtagtagtacacaagctatatgtctatatagaaacacgagagaacttacctaaaagttcgtgtactatgttactttatctatagtaaccctaaaccctaaaagttcgtgtactatgttactttacctaaacgtagtagtctaatctctttcctatggctcgcatcattgctttggcctttaataacactctatatgttactttatctatagtaagcaatgatgcgagccataggaaagagagcatgcatgcgtgaaccatgcatatccacacattgttaggttgacactgccatcaaactaggacctaacaccgatataacacagtaattgtttggcaattggtatatatactgcataccataatactactccccttcagcacattgaggcagaatacgtacgtgcgttggttgagtaattgcccgatgcatcaataagtacttcttcaatatatagagtgatgaagcacatattcctcctgccctcatccctaggcggagaatgttttttgttgtgccccccccccccccccccctattatatattacttttatctcaagtagcaggagtacgtcagcttgtcgatcgtggacatggacggtgaccaaaagagtctgctgtgtgccatactgctgactgccattgcagtggtagtacacattttacaggccatggacacgacgaaatgcatggttggtacacaggcttgttggaacgaagaagtaccattgggtgacaactttttggtgtgggcaggtgaacaagcgtgaatgctagcttattaacatcgaacaaaaaccaaatgagtaaaaagttgcatttcttctctctctctcacccacttggacatggaagcatgaggagaaaggtgcaagaagcactatgatgagcagttagagggggtgctagcgttgtaccttttggcttacaaaaacgataaaggtggcacaaatggcttgcccaggcacttgcagcagatgggatggccaaacatatgatatgataatacctatatccatgtggagagagatggtagagtctctctctctctctctctcatagtgtgccaaacatacgataaaggtgtttgtcatacgtacatattctccatgcggccatgcctcttctcttgctcctccatcctgacctcctctctttctctctctctctatagtgtctttcatggccgctggaagattcttggtttgggaagatggtgagacatgacatttcagagctaggcagctagccctgctacacgaaaaaggagcgcatgaagcggtgacagatagaaagaca

SEQ ID NO: 506 - DNA, 1571 bp, Zea mays
  misc_feature (1)..(100): optimal_loci_36962_G1, chr1:223170424..223171994, Cluster 3
gtaatccataagctagattatataatcctgaaaggaaacaaatatggccgaaatttaccatgcacatttgtaggggttttaaaaaaaaagaaatttggatttgtttgagtgaatgctgtcgattataataattatacaaaaggtagtagctctggatcatattgcttttgccatgcatgatcgagaagccgagaaatttaaagttccggaacaattctctgatgtggttaacgatccgaaatggtcctccatagaaacagtggttctgatgtagtgacctgacaatcctagaattggatttatgactagtgttgagagctgtatgttgctcccattaaattcattccatgcttagtgttgagggctgcgatgttccatttctctgaaccttttgtgtgtgtgtgcgcgcgcgcgcttgatgtggtgtctattagcacttagcagtgccatgtccttagttagcaacacgccctcaattcgagtggcaatcgtttcttttgggtaagccaatagttcttgggtaaaacagttttatttcccccaacataatggttacccataatttaccaaatgtcacccacttgcatgggtacatgctattgacaaaagttctgttgatggagtatatatactaggggaaaaggagcagatgttacgtgttattgttgatttctgtataatggaagattggaaggtagctttgctttgatactctgatttcaatgcacggctgggtttggtgcctggcaattttgtatttttttctcaaaattagtgtaaccgaaacatgaacttggagactatcacccgtacaacagtagactactgtgttcaatgtctaatttcatgatttgtcaagcggacataacatcaaagaaaaagttacggatgattgatgatagtgtacattgtctaatttcatgatttttcgtgtagcaggaaaaaagcgtgaaggaaggaaggcccaacgccagttacagtggcccagagtggattcgtaacatggagatggcccaaataccaatcttgtggtatgtcctctcctctcctgcgtgcaggttctttcaaattaaaggcgagctcgccggcgccgcgaagcagattgtggggtggatgttatttctactagttaacctattttttggacggtgtgtagcgaatggcttcatcatgaaatctaaaactatcgtcgttgaaaagagcaaacatgcatgccacacgacaagataagttggtgataaacaagggtgaactttggccatctcatctagctagctaggttctttcgaagcgcaatcacctcacgtcgtttgcctggctcacattattcagacagaacagaacacaggttcgtttgcctggctcgtactaatggcaatagcatgcaacgttgggcgacgatgcacagtcgtagctagtaggagaaaaggatttaaaaactgcagtagcatgcaagtcatgcatagacgcgtagtagtagcagagtattcaattctctttctcacttgtcagcgctacagtatcagtaacacctccccggagtggctccggcaaggcatggcagtaaataa

SEQ ID NO: 507 - DNA, 1604 bp, Zea mays
  misc_feature (1)..(100): optimal_loci_37357_G1, chr1:224925474..224927077, Cluster 3
ttacataaggtgataggaagaaaaaaaaaacaccaaccatgcgtacgtggtccggacggaacaacaaccgaaaacacaattaatccacctctgcttcgcaaagaatctgagaggccggcggttgcatatgccaaacggaacccttgagcaagatgcggtggactggtgggcatcacccaacacatctgctagctgctgctggtgaccggccggtggccgctggcctcctgttccgtgcgcgcggggccggcgggggggacgtacgaaaacgaccatgcatgccgtcagatagtcattatcaccatcattccacaccgagcgatcgaccccggcgtggtgtgggtcccgccggccgggcactcggtcaatggagtggagagacaggccggctcccatgcatggcacccggccggccggccttctctcaccagtcaccaccaacctggtcgaccggttgccggctcctttggccaacctcacctcgacgacacagccctagcggccggcagagcactgcctgcctgctgccagtgcttgttctcagactcaggtccatatgtacgtacgtacacacacaaacagtgagacgcacgcatatggccatggtcatggccatggaaaagtgcctcgcgctcgctcgcctctgcaccatgcatgcacgtacgtgacgtagacgtcgccatggatccggctgccgcgccgtcgcagctcgcccgaggcatcatgcatctccttttttttcagacgtacagcagcgcaaaataaaggggccggccgggccggccggcgacgagcggcgcctctcagttccagacgactacagtgacgcgcgcgcgcccgcgggcggcaggtgacgacggccagagctatattagcctccctgatctggatcgccgatcgagctcgccgcgcgcggcggaggagatgtactagagatcgacgatcccacgcaccgacgacggatgccgcagggccgtcggccgctagctccggtcctttgggtcctgcgtgaatggtcaggcatcagggaggtactgcctgccatgcgtagggctacagtgcagctacgccgtataggggggcatccagtgggcgggtggagaagaatactagcgcgatggggtcctcgggtgtgctacgcggtgtaaaaaggcgacagtaacgttcttgatgctgagatagatcgatcgaccacggatccatctagattttgcggttgttatctgctggattgcaacgtgcaacttcttgggggtgatctttttcaacctagccggttaccctcggagaggtgctcaccctatagctggaccctagaagagtttaatctatgtctacccctcttacttgataagccattaaatgttttttagaccgttgaatcaatatggatattcgttgtgtagccgggtgagtatcgcaagatttagtgaatgtcaagtaattcacgtccagacatgctcttatagcctgtacagtgtttgagtatttatgtttataactttttttgtagttaaatattttcatacaatgaatatttatattttctataaaaatagctaaattaagtaactttagctatagcttctaaataaggatgttaa

SEQ ID NO: 508 - DNA, 1451 bp, Zea mays
  misc_feature (1)..(100): optimal_loci_37811_G1, chr1:226935068..226936518, Cluster 3
tggtggtctccctcccgggggctcccgaaacgttggcagcgccgcgcgcgctggtgtgaagcggtgtggtgtcggtgagcgacagctcacggctgctccctgctgtgctgcgcacaggcacagccacatggagccgggcgggagacaggcaagaagcgacggcaggcacgcacagcacagtaactacgagacagacacgacgacacgagagggaggtcggtgctatagctatcacgcgctgtacctgtacctgtactgtacagtacgtgcagtacccctctcctagtaccttgtcacctgcccgcgccgatcgatcttcattgctcgttattagtacagtcgtaagcctagcacgctggaagcatgatcgacagttcgacatcgattagacaaaatagaggacggtcagaacaatgatgtatgtactcctacgttaccggatctacaatctgtgtcgcacaccatgtttcgaaccctccctccaggtccagcagtactgctacataccgtggcagccgcccagcagtgcagtgaccacgcggtggcctgcgtactgcccgaaaaggacagagacagtacaatcagatgcacgggtcaattggacaaggtctctctgtctctatctcgcctcccacgcacctcgtggatctgtactagtttttaccttcaccagcgttaccgtctggatcatcccctctcctgtcgcccgaagaatcgacgcgcgccagagcagacagcgcccgccgtcgcgcccatgcccagcccatgcacaagaagagacacaactgacgcgcggtggcgggctgcgacaacggccccacaccgccccggacgcccaaggccgattccacgagtttgggcttcacgcgcaacaaggctttagcggccggatcggactgcccgaaggggtgcacgagcgcatggtcggcgacacgtatttttttttctattttttttgtcaaggcgcttcttgttaaggctattcgaaattcgtcacaaacttttcaacgttaccacatcatcgaaacatcaaaagtactacggtgctatttggttcgtcaacggtaacacggatggaaacaaattagagccgtgcacgtacgataagtaatgcgattttgaactaatctcgtttctattaacgacaccattgaggcaaccaaacatcacctataaaactactaggaataaaacaatatcgcactattttacatgctagcgtaccaactaaaatggccaatataaattaataaaatatatgaatacgaaacaaatcgttctcaatggagggtttacacgtttttcgagaccttagacacgagttgacatggtttcattctcgtaaaacaaaaccaatctcccatgaaactcattcttcttaaatgctacgttatgtcatctacaaattataatgtgccaaactattacatgtgcatgaagctactaccatt

SEQ ID NO: 509 - DNA, 1495 bp, Zea mays
  misc_feature (1)..(100): optimal_loci_38204_G1, chr1:229092804..229094298, Cluster 3
ccttattcttcagatggttctgcagcttgtacttcctgagcacgagcatttgtatgaatgttttcttcatcgtgattttcactagtggcattcaactgtgtggattgttgtgccaggaacaaaggcaaataattcagtgcaattactggaactggagaactggagaattactggatgcaattactttttttcttcttccttgtcatggcctaggagaactggagaagaacaggagatcaatcgctgcaatgggagtgtcgtcagccgtcaggaactcaggatggcagattgagtgccacgccgccgcaaatcgacgagagaagatcgtgtgatactgcactgcgagtacgctgggcaacagggcaaccgaactgttcagacctcactagccaataaggcttgtagcctaccgtaacttaaaagcccatgggcctcgtacagaataaaggccatataggctgctaccaccggcgctcggctccctggtaaatttttcagtggggtgggggtatcccaccatatgtcatgtatggcaagcgccagaccgggccacagcttgcatctgccactgcccgcctcctaaccggggttaaacataaaggtaaggtcagaaagaagggtcaaacctttggcccccgcaaaacagcacatattgaactcatcaacgaccaaggcaagcaatctagctatactagggtgagcaccattgaaaacacaatcatgtctggcgtagctactccacctcactccacctctagagtcctactgccgaataccaacaaaggtaatgcatgatcctgttataataacatctggactgacttatgaaagagaatatatatagtgagtggtggttcaatgaaggacataatacttgtcataggacacagatgaagctatagaacttcaccatgaatccaaatacctgcatgagagatctcattttcgattggtgcaaagagcatggttttaccattttcggttttattcctccaactgaaaatcatcacagttacttactagagcaattgtggcagcggcggcacatgctccaccacctgacgtgggtgcatcactggtattgtgagcacaaggatttgacgggtgaagccctcaccttagattgtcaaagaggccgacgtcgttgccgtagagagggacaggctcgtgcatcctatatcggtggtcggagacgttggctgccactctgccagccacagcgagggcgaggaggataaggagtgctgctgccgcggctggcgaggccgccatcgctgtcatcgcacgacgttgatgagagagtgggacgagggtttggggtgtgaggaggggcacgagtggagagatctaagcgaggcctgagggtggcgttgtcggagcagacggtgtcgacaaaggcccacgggggaggggaacacgacggctgccgagggagagggggagatggcgaggcgacggaacgcgtagagagagatggatgataagttttacattt

SEQ ID NO: 510 - DNA, 1735 bp, Zea mays
  misc_feature (1)..(100): optimal_loci_38227_G1, chr1:229179850..229181584, Cluster 3
aggaagcttatttatatagacaaataagataaagatagtaaagcttttgtgcatctgcttcccagtgccacaatagcatagcatatggtccgctccttggactctgaacaaactacaagaggaacacgtgattgctatcacacggttggaagcatctttcttttttttttctttttctgtttacgccacccttctgttccattagtgcagcaccaaaccaaaccaaaatcgtcagacccgtgactccaacatgcatgcacattttgtaggccgatcgacatgcattccttgcaacgctccgcacaaaacacgtggctccatcatgcgtgcagtgcaagggagagagagagagacacaagacgcatgcacccgcttccatcttgctttctttccccgctctccatatgagcccgtttcctgcaacaggaaaactgaaaggaccacgcacgcaaagcctacactacaggacaggatctaagcacatgtcgtcgagagtttatatggtaataagcaacagaaagcgcgatgggaaagcaaagcgtcgctctacgatcgacctcctcattagcagctaggctgaaaggtccaaaacaagtgtgttgtgcttgtgcggtcgtgcccaccattcctttggtcaatccggcctgatgaggcgatggtgagtgtgcagcgcacacaagtgttgattccgctccaccgcattgttcaggcgatacaattgatgtgaaaccagatgagaagtacatcgatgtggttactgttgacgggtttgatttctggtttatggacttcgtgagctgtgacaaatcgttcagataccttcagcgtgtaatttcaaggttcagatgatataagcgtagttctgtacgtagtaacatactgcataccatgttgatgtggtatatgtatgagaacatgtacatacattatatacggatacaattgatcacagtgttactgccacaaactgcatactgcatactgaatacattagaaaatgtttttctaagaccctaaacgattctaaaacacaggctgtggcccacaggtaaaaaaagtgaaaaaaggcacacatacaacgtggagccacaactgagaagaagccttaagctgaaagctaggttcagaacagtgttactcttttgatcactttaatcagcacagcagtgtggtataactaaggtatgaggtaaagtaaacaactgaaagacctttctaggtgaagacttagccaaatatgcgaaagggtcttagttagccaacattcatctacaatggtcaagacttattagccgcagcccacgtggccacatgtcaccacgtcagatcaaaagtgacgtaggggcaggcagacacagcgtcttgttcccagtccatacacattttaatcaccaacaaccaccagtggctttatcgagcaatatcacctcgatcgctgacggggttgtgtgtcaggtcagcacatcagacgcgtgtatttgcagacctggaacgaagcatgattattatatattcttcagtccatgtatctgcagaaatcgactagttgacacatcagacgcgtcccgttacacatcatgcacaggtccgagcccattgcctgggccaccatgttcctaaaccatgaactttacagggaaataccttttacatgtttgtttaagatccaagatgttgtgtctcacatgtgcaagtgaaaactgaaaaggcatacgtaatgttgcgtcacagctaa

SEQ ID NO: 511 - DNA, 2322 bp, Zea mays
  misc_feature (1)..(100): optimal_loci_42348_G1, chr1:249545923..249548244, Cluster 3
acaggaacaaactcatttctgttcctgtcctggtagatccttattcccccatttaatttgggatcccgcagggaataatgtaacacacacacgcacaaaatattcacgacatgataacattacaaatataccaattattaaaagacagcaagacaaaaataaatctgaggatgttcaggagcgtcagagccgtccaagggtattagagttatccgactgtgtcgaggccatctgaggatgtcgatgctatttggaggtgtcgcgaccatcagaccaagaagcgtgacgtggcgtggttgtgactatggtgtgactctaatttctaggtgaacttttttttgccgcttgggttagagcagatcaccttcttcctattattcctggtggacatatgatcttcttgttgggcatatgagatatgacacacaaacatccgtttagattgattgtggtccgctactttgagcaacacatgatatcgacttatgtagcatgccttgagtatgggttgacccttggaggatataaatttatctctggatttattaaatattcaatttaattcttagtatgatcagtatgtttacatgtagtatgtgtttgctaagtctatggatatgaatttgttaaatttagtatgtttccttatgtaatcagtatgtttcacttggatgtgcctagtaactttatgagtaataatatccgtgtacaggctaaataaaatgcaagtgtttctcaggaaacacgagatggaatctgtgccaaacttgggtgtttggaatggtggctaggaaacaagtatgaactaataatatataaaaccgagtgactagtgatagaagcgcagtttctttctttttttaaatcaaagttaagaaccatctctttgtaaagcaatgtactactcgattgatgatttgaaatagaaaaagaagggcgtgtaaggtaaagggaggcaagagaggagtaggacaggcgaggaagatgcaaagcaaaggaaaagggagatactatgagagggaattaattaaagggtagaaaatagagaaagatggtcaggcaggcaggcaggagtgtagtgtaggacagataggaagacagcgcgaataaaggcaacgcggaaataaaaagatgttgttgctccttgctcggcaccgaatcggtatgggcccgtgagttagaaaaataaacggatacggcctgggcttctcttttcctcttccagctggctcgctggcccaatgccgagacatgcctttctgcctttggtttttactttgtgtatacacgaggaattatttggatactctaatattcatgtcgatctatatatattaaagtagattaagttataaattcgtttaagtttcactcgaactttcctcgatgtatatagattaaggtaatatgaaagtatccaaacaatgcctaagtaagtgtgtgtccatatctctctccatgtaatgcatgattccgtcctccgtccattgaactaataagattttgtttggatcccttcccaagtttagttggttactaaacatttgacagattagcatgtttatgtggtcttggtctaacgagcctgcgaaattgtttggtggagtaaggatccgtttggtttctttagtctagactaccatgtttgattttaggtactaaaacttttcgaaacacattaaataaatcataagaggaataaaataccctttagcattcttctgccattagtgtaactgaaataaaggagggacaaaaaatgaaatttatatgatttagtctcttttaatcaccctttgagtgactagagacaaacagtttagttctagttttagttccaccgtttcggtcatagctgttaacctatcgcttagattaattgccgggggtttacgggtagtagcggcctccccaaaccgctgactgactccgctcggcgaacaagcatccgaggcccatttgcattcaggcagagcgggcgtgctgaaggaaatccagaaaccaacagctgtgagtaaagcaacgttattattgggggaaaagtcaagatcagcgaacatgtggcacggttctcgtacagccttaccttgccttcctctctgcaaattaaatctgcagcagctagtactagtagtctgaggtagattcggagaacatgtaaggctaagcagcgacgacgaaggtaaccagagacactggtggcatccaccagaatcggctaaccaatgctgtctactggacgacgaaggtaaatatgattagcttttgtctaaataccatggcttacaatgttgtatgcaaataatattccttaaactcatg

SEQ ID NO: 512 - DNA, 1697 bp, Zea mays
  misc_feature (1)..(100): optimal_loci_45708_G1, chr1:267878323..267880019, Cluster 3
cactaccgagtatctttggagcttgccggttgaagaacaggccccactgcaaatcaacatctatgagcttagttttttagatatttcttttgtctcataggttaatccacaatcggtggcatgttgttgtttgttacttagaatttgagtcctctttgtgtaatgttctggagatatatgatcacaacatgaatggagatatatgatcacaacatgaatgaacttgaggaaagtgattaggaggcaatagaaggtattatatctaacaatggttattttactttagctggattgtttaggacactaaataatttcaagtgtatttgaaaaggttggttttttgcctttacatggcgtgattcagatggtagagctcccgatagggcgctttttttctagtggagtatgaaaagctcgagcgcctctggacacatttggattccattccagtgaaaagtcgaaaaggtgaacaggccgtcactagctttttttctacgtgaagtcaggaacccacttcgctaaaaccatagtaataaaaagtaaaatattcttaagtggaaaagggataaagcgaaagacgacgacaggaggcccagttccgggtcacgttctccgcaatgggccggccattacgagtcgagggacatgacggcacgagccgaaaagccttggaaagtgcactcccctgcagcgaatcgcgaggcgtacgtacggggtgtactagcacacagctgcacaggcgcgccgcgcacggcgacgtcgacccgacgccgtcgcgccgcgaggcccgacgacgacgagcgcctcgttccgcggcctcgcgcccccttcccgcgtggtggatcctcaagcaggaacggtgaccgaccgaccggaacaggtgggccgtgggcggcgtctcggtgcacgggcagcgaaaaacaatggcggctcgtcgcggcaaacgcgtaacgcacggcatgtcggtacgaggccttcgcgaaacagcggccgacccggtccaaactggccgaccggaacagccttctcgcggtcgcctacggcgtaccggtaaataaataacggaacatgtcacggatcaatgctgcctccaagagcttttcttgctggtggttgcccgtctggattgtgcggctccacgtgctagcctttcgacatatactccaacaagctcgtcgcacacgtgcacagcaaaccggcgttcgatcgtgcggcatctcgcagaccggcatgtacacaccacaccttcgagagttgctggattcggcggtgttcgtccgacactgcgagtctcagtctgcacacggggacgaggtgttttgcccacgcgatcatgccggttcgtgccagcgtggcattactgtccggtgctgcgttgttcggcctccgatgcgttccccggttgccaaatacgacctatgtggcgccgtcacgtgctggcttctttacgcagaagacagcgatgtatgactgggcaagtcgtaccgtcagagcgtcctcccttcctgcacgagtacggtgtaatagcagactgactccctgtcccctccaggatcgctagtcgctgcccgtcttgggctatgttgtttccgttccgccctggcatgcggcctgcatttgggttgctggcttcctgttacaggtcgcacgcagtacgtagtagaaccataagttagctaggggcacgcgtagatccg

SEQ ID NO: 513 - DNA, 2208 bp, Zea mays
  misc_feature (1)..(100): optimal_loci_46718_G1, chr1:273351421..273353628, Cluster 3
attccggtatagtgaacactgtttgtagagaattttttttgaaataggggatggaatagcgaatctgattgagatagcctaaggcaatctaattttcttggaaacttagatttgaccaaacttatagaaaaaacacaaatatttagaacatcaaataggtactactattaaaatataattaataaagagtttaatgataattatttggtaccaaaatcagtggtggttgcaggaatggatcaaaggaggggctagtaattaagataggactattttttagcttaaactaaaatatataattaatgtttaatatgacaaaataacaagatataatccaaatcttcaaaaaacatttagactaaataagtaggtatgaaatctgtaaatacaatactcaatatgtaccgttcatgagttacggttgtgagacaaatttatcttctgagttcttatgtctcgaaaatacttcaaaatcttttttgtcgtcaatgtctgcagacatatattccactcaatatagcatagtgtgctattattcattcacttgtcgtacatttttttttctttcgatcttcataatctttatagtagtgaaagccaagaactgtgggtagcgacagctcgtagccgaccaactgtggcgctggtggcctggcgaacccatcatcagcactaacccgaacgcgtacccatcatcagcactaacccgagcagtgcagcactgaaaaatattggacttatttcctgtatgtcattaaacattattttcatccttgtatatcatgaagtggtatatagtgattttttttttttatgtatatgacatttgagtccagtgacacacaagggatggaaataattccccatgacacacaaggaattgcccatgtagtaatcagtaggtcctggcacggaaaacatttcgtgattcttatcgatctctacgtggcgtgcagattccccgaaaatctgcatggagtttgatgaaaacctcgtcgaagtcatcaggaacttactctcactgctgaagcctcagaatctacggcaattggtctggagctcacgtcttccaccgttccacgcgattaacgcggtccgtatacatgtatatgtgggccttctcgttttactattttcccccgtatttttattgatttgttaatatacacctactaggcagctaggcgcagcaaaataacgctactagtcgagttagcaacgcgcgcgccgagctcttgaactgatcgggcgccctgccttgtccgaacggcgtggtgtgtcgtcgcccgcgctaccgtggcaatttcccgctcggttcagtgtggcgcacgcacagaccaattcccagtttgacaattttcccgtaccgcgtggtacctggtgctagttgactcttagcaaaagtgcaaaactcgcgcgaaacttcaccgcagtttagcatgaacaatctgccgcgcacgcgcagcattgcatagcctacacgggacggccgggctcgagagaacgtgtgtaaagtgtatttatactcacaatgcaaagcacactctcgcagctttactgcagatcgaccaacaggcaacagcctctattgcagaagcagcagcagcagccatccacaattagtttaattgctcctttccgattccccagcgtgtagcgctgcaaagacgtcaagatgagcatggcagttggtcagaagctagggccgtgctcgtgcgtgaagctgttggtcgtcctggccctcgtgatgtcggcgtcggacggcgccggtgcctcgaggcctctcacgacagcggcgccggcaggcgagcagcagcagagcaccggcggcggcggcggcggcggcctggcgtccgtgaagttagccgtggtcgttaggcagttgtgggcggggccttctggctgcaccttcgatcctaacaccactggaccgcgctgcccgtgataagcccggccgatccgtatcccatcgtaataccggtttaatttaagaccaaattaaactaccatagaaatacaaacggtaataactgcgtactagtagtgtgagtgtctgcagcgtctatatacacgacacatgattaaattcatatgttacgctttcaaattcttttgttctttaaatccagcaaattcatgtgtaaatatatagccactctctctgtataaataagtttcacaggtcggtttggatgtctaaatcttcca

SEQ ID NO: 514 - DNA, 1470 bp, Zea mays
  misc_feature (1)..(100): optimal_loci_4723_G1, chr1:24214317..24215786, Cluster 3
tcatgtctacgcgtgatgccgtgtcatgtctacgggtcatacgtattaagcatccaagatttgttacactatactattgttttggaagtgccaacggcccaacgccgaattacaccgtttcacatttttttttaagtttgtgaggaacgttgtagccgtacgtaataagagacggcaacaggcagataagttgaagagagttcacgagcgatctgcaatgttgccagaagacacagaagcagcacagggatttgcaaaacgagctgagccaggatcgagcttgtacatcgcgtggaaggaagagtaattaaacagctggtcgaacggtcacctcgtataaacatactgtatactactgtcagagtcagacgtacacgtacggtagagtccaagcaagagcacaggcattctggagcgtgggaatcgaggaatctatggctgcagcttctccgtattcaccacgagacagatcacctgttactgttatcgacggaatcagatcctctgcaggtagacttccgttccctcggtgcacggctggggtcacgggctcacgcgtgggaaggggccgcgcgcaacctcccaagcccatgtctgcatcggcatcggcccgtggatatgacaagctccccacgatcccatcccatcccatgccagggctacgcgacggccacgctgccatgggcacaccgggcgggtagtactcccccgcggacaggcaagcgttcgccggctaaaaactggcgcatgcaaatgcaattggtaatgactggactaccccagtgtaccacttggacgtagtattcggtttcaacgccgagggcctgcctgactgcattgcatttaatatacaaccagaacatgacactacacgcagagcagcatacatgcatgtacaaccagaacatctgtaacgccattgttccgtttggcattttgtcttgcatgacctgtagtgtaggctgtgtagctttggataccccctgtgggccatgtaactctctcttctccatgatcacaaagctagggaatttataaacgatgcatgcatgtatgcatgcatatacgatatattcctgatggccttttaatccaatacctctgatgcttgagacgcaggcttcgatctgcaccagctaacttgtcgttgctcttgcttgacaaagaactcgacgccggcaagctagtgctgacgatgtaacagatgtggagttggcatcttagatcctccaacagggccggtgctggagcctggaggggggcaagtggagccgccgcaccgggcctccgattttggaagggctccaagtaatatacatgtatatataatcttaggtgttgtgtctaatacggctgctctacttgtccctcttcgcaggactgttctgacgtttaggtaaatgatctactatccaagttaaaggttttgaagttaagtttgtctgaaataccaatgtcttttatggagat

SEQ ID NO: 515 - DNA, 2617 bp, Zea mays
  misc_feature (1)..(100): optimal_loci_47676_G1, chr1:279134682..279137298, Cluster 3
caatttggtctactaaacattgaatggtcggaaataatttcctcctatatatactctgttgaacactgaattactaaatgtttgtcccatgtaaaattcgttgaacgtcaaattgttgaatgtttgcttgtgtgttgtacttcgttacacagtgggtgactgaagtgaactttggattactgaatgtttctttcttttaaaatttttaaacgatgaatggttgaggggtgctcaacatgccactcaaatcctttttggagtgagatgtgcgatgaacctgttgatatactctatccttcacatgaatcctctcatttcctttcttttcatgtcaatgagacaaaactttgaggtagttcaagctgttgttagggtctttggcaaatgaaatggaaatgggacccctcgacttctaagtgagtcaatcctaatagagagaggaagtcctttcaaaaggaaagtaggaacgattctgaagtagtactcaggaaagtagtagccgtgtaagtcagtctgtctaagtaaacattgtatacttgaatgtttataactgctatatttcattaattattaaatgactgaagtaaacctttgaattgttgaatattttttcatgttgcgacgggcaaatcagcccggttaaacgcgcgcggacctgtttcaactcctagtcgactgatgtgttcatcaccataggtaatgtatatcacataggtatatatatgtattattgcttaatttaaacatatataggtatccttttgggaaagaaagatcataaatgagtttagagaataataggtgtgatttctttggtatcccatttaaaaacctatgtgggaaaaagaaaaatgaagatacaaagtgcaatatcaaaacttttttcaaaacatttcgttcgaagaaagtacaaaaaaaacaagaataatagtcaaagaaagaatgcaacaagaggccagcgggcagcagttgatgtggactgggtagaagagggatcggcgccactccttgcgcctagcgcgcgaccggcgggcagcggttgtcgtccagctccctactgcgcggccagggcggcagggcgcccttgcgcctgcgcccagcgccctgcgcgcgtacgtggggagaagaagagtcgtcgtgcatggggtatcgctcttggggtagaggacgactgagtggacgagtgacgaaggcctgatgcgtgacacaaatgagtgtttggttcgaataatcactccatctaaaataaggtagtgtatcgtgagcctaagcctattacttaaatttggtagaataactctatttatcatattagtactaactaactattacgaataaggtggtgattgatcaactaattcaattaaataaacaaaaaaaaataaagagtaaaaagataatgaactagattatttctcaaacaaacaccctaaaagaacctcgaccgatctgagtttggaagaaagttgatgtcgtacgtttatttttaaccacttattattttcgtaattttttacgaagagacagctcgaggtaaaaatttgcaccggtgtttcatcgattaagaccgcatagaggaatccgggagcggaatcaccacgttccatagagtttttatctgcatcgtgtagctattgcgacatcgagcagcggagcagtcgatggaaaaagtactacaagaactctcaagccaccttttttttacattcaggatctctcaagctggcaaggagattgtttcggggagaaaaagctgcgtccagaacatgaaaaggcatggaaaaccacaggatataagtagctgaaagatcagttccgcaacaacgacatgcaccgcagagtctgcaccccatcgacgagacctaccgttccagctttgaaggttagttagtcagacacccagatcaccctccactgaccccggcactcaggcagtaagagtgaccagtgacagtcggcagtaggtgagtgggaagcctattccgaaccacacggtccagtgttacgatgaaaaggacttgtcagggaaccaagttttccatgggaattcttcttcatggaccacgaaatgcacgcatcaggaggagcacacaaaagcgcagactatcacatgcggaaagaaagttcagctcctgaaagtgagacggtaccaattgtagcacagcacgcctgaacaaatgtagctcaaaacacacaacaaactccagacgcaagctacagacaccccatcactacttgatagaagatttcactccgattctgattctgactggcagctaggcagggaggtcgtaggtatcctgttgccagtatttctccttcacgcccttacaaacttcttccgccaggcaatgtttgaccgcccggcaaagggatgaactgcgccgaataccccagattcgtgagctctaaacgcgacaagctggcaacacacgacgtggaagaacgcattgtcgccgcagaggccattgaagtatgagtagatggctccaggctccagtagtatgtataagaaaacaatggcattagagaaggtttccctactctggttttcatggctggtacttgtggaaaatcaagttattttatggtactatctgttctaagagtgagttca

SEQ ID NO: 516 - DNA, 1843 bp, Zea mays
  misc_feature (1)..(100): optimal_loci_48108_G1, chr1:281326020..281327862, Cluster 3
gttgtcgatgatggcatgatgtcgaatcggctcacccaagagactgtgacggtgatcctcttgccacgttgtcaaaacatcgttacaaaatttatagtcgacatttgtttactagacactacattcgtcaactcacagctactttcacaatgttcatagctagaataaagttatacaactaaaccaaacagactccttagtggtcaacgacatctacttgccgaagccaccggttggatttatttggacatagattcttgaaaactagggcctgtttgagaatgtagttttgaaatagtgtaattttgagatattaaagtttacaattgtatatgacacaaatactacggtattactttacctcagtaaaatcacaatattgctcaaactcgagatatatttggttccattggaaaaataaagtatatgtagagagaaagaagaaaacttagttcctgagtggagttttgaaaactccaaaaaataccacagttttggataaaccatcatatttaaagttgtattttgtctataaaaccaaacaccttttaagttccaatactatagtatcattaaatatcatagtgttgttttaaacagggtcctaatgtctcctctttggacttgggaagttttccctattcttataaaactagattagttcctgtaaaatctatattatttgactcttgtgagattcctgaacctaaatggatcctaagaatttgtgtgttcgattttcattatctactctagatagtctaggatctgtcatgttcgcgtgacatccttccttctgtccatcagtacggcagcgctcttgtttgggccacgcgtcgctcgctcctccaatctcggttcagctccagtagtggtggcggcgccagtaggcagtgtagcctctgaggagcgaggacctgggtttccgacgagtggccggtccgacgacacgggtgcagttgcagacacacgtcgccaccagggtcccgcccgatgacaccgcgagccgcgcgtcgcccaccctatctatcgtatccgcgccgcgcagcttccgctgtcacaccagcaccaccagctggtggtgcggtgacgccgcgggatcccatggttatacctgccgtgatccgcttggccgcggccttgcatttgcattgctgatcacctcagcccgcaacgagcagaggaaggaagactccgcggccttgcattgccaatttgccatgcgcctccgccatggcgccatgcgcatgctcatccgccactgccagcctgcagctgcaacctcgcgctcgcgatcgcgcaccctcaggcttgcttcgcagtgcggcgatcgcggctggggggacgggaaaaaggaggtggcggcatagcgaaagcaaacaaccttaaaaacgagatccgcgcgccgagccgagccgagcggggcgcacgagatccgcgcagaaatcttcgcctccgccgatggttccaatcaagcctttggcccgcctatccagacgctacatgtaaaagaacccaaggagaaagggagagagagagagagagagagaaaaaaaaaggcggcctttttctgatcctggtccaaaggccaaagccagcatcgctgccgtgccgagggaacaggaacaccccatgtgtgagccccaatccactaacccgctttaggtcgtttgcttgctccaaagagcgcttttgcatgcggctgatggaattcgcctgctggaaaacatcgcggaattggcgcggccggaatggatgcatggtcgtcggatcggccttctcgcctcgcccccggccgtcttggtttcttcttttttttaacgccggagttgttatccgctgg

SEQ ID NO: 517 - DNA, 1467 bp, Zea mays
  misc_feature (1)..(100): optimal_loci_49377_G1, chr1:286439185..286440651, Cluster 3
tgatgccaatctgttcgacaaactagatctcgctcgtcgcaacaatgtgattcatttccgatagttagcgagcttgacgaacaacaaaccatgacttttatgtggtctttctagaccctataaattcttgcgtctggttgaaaccgaacccaccggctcagccacatattgcatcgtatcgtcatgggttgagccgttgaggtatgcactcacggatcatgttttgcaaaatttattcaaaatcctaccgaagcacacgatttcatctgcaatccacacatgcgtcgtccaacgcatcagcttcagacgtgttttagcaatccacacatacggacccttaagaactcgtaccatgacaggtcactaccgggaggcgggaggcacgcaggtcgccctacaggcctacacatatcgttctccctctctttcacccatgacccatttataatcatttatactcccagatttgcttctcaccttttctgtatcagatccagcaagtgcgttagacataacctgggggcagcagaggactagccggtagcgtcaacaggctggatggagcaaacttcctcttctactcctcatctgttgccgctccaattcattccatggatgatgccctcattgtgctcgatgaaatgggcacatggtagagcggcggctggcagctcctactcattccatggatgatgccctcaatgtgctcgataacagccggctgccttgctccactattttatgctcattagtatgacaaacactgaaacagagcctgaggcacacaacaaaacaggagctagcaggagtaatacttgtgcaagggaaaatgaggttaggcaacgcaattgatggtattaagtcttttggtttagtctaatactttatattttctctgcctattcaagtagccatttcttttctgtgtacatgatttctagtgccgccaggcctgcaagcacaatgctgttggtatttttggcattaatgggtttctttagtttgagtgaatggtgttgcacacatacttagatattggcttcagacgtgtagtcatcagatgtcattatcctctcacaattgagttgattcttctgtgtgcagttggatctgaatgttccttgctgccggtgcaagtccatcatggaagtcttcttaaatctttccattgacatgagttgatcaatcatgaactgtcaagcatctcgattctgctgctctcgtctgagcaactaatggacacacgacatatttgttctctgtacggtggagtttgccagcaagttcaggatcagcatgtgacctcagaggttgttgtataaggggatttggtcccatcttcgccggtttcttggactcactgcttatctttgttgatctccttggagtccaggcttttcactgaaatttccaattcttctcgcttcttggaggaaggaaacaagggaaacaagaataggatacatg

SEQ ID NO: 518 - DNA, 3521 bp, Zea mays
  misc_feature (1)..(100): optimal_loci_49589_G1, chr1:287733457..287736977, Cluster 3
tgtaaaagattttttgagctcctttccttcagctttttctcggctatttaccttgggaaactattttagcgaatatttataaaaaatagctttaaatttactgttcaaactaagttgtaccaggtacgtccagaatagagtgctatgataccattatttaggtaacaaataatggatgccttaaaaaaaatttttaagaccgaaagtgtagctggcaagtggtcgcggatgccaggctgcaaaataattcccgtctgcaagttgcaaattgcaaactgcaaaatagtccaccatgcatgcgaaagtgtactgtactttcaaacagttatatttttatcgtcctcctactgcgggctatggtggatgtgaccatacttgcccactagctacctaacctatgtagtctactacgtttctaacagaaataaaaaatgttgctatactactatgtgtagcttaaattttttcttaagtgtaactaaatttatgaaacaatactattaatatttgtaccttaaagtacatttattataaaaatgattcgataatatatatgatgatactaggtatattataaatatcaatattttcatatttgttaaattttcaaacgttaataagaagggcacttttgagacggaaaaagagagcattataggaggaggcgagctagcctggtacgagtacgacggccaccagatcctcctaataaaatcaaatactgtcgaccacgccttctccatgggctgcagagctgctgcagggaaccagggaggaaaaggagcacggcggctaggtcgctactgccttttgcatgcatgcgtgtaggcggggagggagactactcaagcgggcccaagtccttgtagactgtacctcggcttcgcaaaagagagcaaggccaaatagaaaagccacgacgatgtgccttcactgacactgtgcgctagcttatttatgccttccgatgtgggtgcttgttggttcggtaatcgaactactaggccttttctagatcttgtcttttctaaggcgtagagaagatgcacgcttgcatggggaagcatgctaacctttgctccgcgcagctctttttatgtttgtgcatgtgtttctcctatttgtacaaatcacaaaataagtgatttttgcgagtacgctatgggagctgatgactgtgtatagcatacctttgctcgcgggctggtaacagccacagcgcccagaaatatcagaattgaatcatccctcagatgatctgatctctacttctctagtacatctttgtttaacattagcattgaatcatccctcatcatagttggatatataggaaaccagctgccaacagaaatatcagaatgtaagaagcaatatcacgcagaagtaataacaacttcaaaatgcagcagctgcatgcagtaataaacttgaactgtctttcgttcaaaaaaaaaacttgaactgtcatagcaaatctgcaaagacgaattcagcacaaaaataagcatcgccctctttcatgctattgagagttcgcctgactcaatgttttcatcttttttttcctgacgagtttgattcaataatgtgttcatcagactagaggagaaacggcaagattttgacagttagagaatgtagcaacagcatgcattttttgctaagtggccatatggggcattgagcctacataaaaccagcataatcgttgtccatatggatctttgcaactagagccaaagctgagccccatgcgccgtgtcctgcatgcacgggggaatcagaggcagcacgcatgcatgcctttcatctatatctatatactatatatacaaatgcagacaaatgtggatttctcggaaccgttcccagcagcattgataaagtgatgccctcctcagttctaaagtatagcctacttttaagtttttaacaacagcaaaattaaagtcattttttttctaacttcaacgaagttaatgaatcaacatctacaagataaggttagcttcattgaaatgtctatagaatttgtttaatggtgcatttatttaaacttgtatatattggtgtatttttctaaaaacttgatataaagatagaaaaagttaacatagaataaatataaagtgacttatataatttagaacagctgagagtattatatatatggtgggccactactgtaatggtagaacatatgtaagtaaaaaattgcaagtattcagatgcttagcactgaggtaatgagtcatacacatatgaaacaaatgcaattgcctgaccaatggtttgagcaaaagattcacagaggttgtggaagaggcagcacaaaaggtatcataaaagttttgtatatggatctctatttgatttttgttcttttgagatcgtcatctctatatggttattatattgctaacacatacaacatgtctacgacttcagactaacaattaaaggcaaatagtagatttgtatgcagcaagtttatggtaaacttttgtaactaaagtaagtgggaaatggaaacagaataggcagctcctgataccgcaacaaatgctcgcctcgccttagctcagcgaggaactggtcggatcacaattttgctggtggacgagtttttgttaaattctatgctagtaagacgaggcttgatgccttgatccaatgggatcgtcgtccgtgtaaaccttgctccgcgacctaacgcccctcatcctgaaaatatcaaataataatacgtctgtcgactggcgtgctgcttgattaggcattacatataccctttgaatctactctacgtacactgcacgctccatgatctcaattttaatacatgcctacctgtggtccacacacaccactgtccatggtcagtagcaaattaatatataaaaatccggttgaagcaccatacgacagatgcagtactgcactgatctagatctcttagcaggtgcaaccctagagatgcttagcagagcataggcggggcatggtacgcatgagtacttgcgctcctcacctcctctcacatccaaaggcagtgtactctccactcccggctcacccagatgagctttggatgagggcagagggctagctagctggagcctggagggctagtggtggtgtagtcgtatgtgagagcagtgacagcagctcgagaaaagactgtcactgttccctccctgtactttgacaggaccaaagaatgcaacgcaaagtctggatcggcgccaaaatggtggtactgttcacgagagtgcattgttttaacgaaaatgcaacgagctctacgtttctctactgtactttgaagcttttgtacaggcccaggtgcgtgcgccgtgcggtgcgaaggagtacacccgaaggcttttgcactgcacacatctgggaacagtgctagatactttcaccgaccagttaccgccacagctttgttcttgctcgatatcgcttctacatgcggctccaacaactccaatagtattttaccacgctggtgt

SEQ ID NO: 519 - DNA, 2418 bp, Zea mays
  misc_feature (1)..(100): optimal_loci_50607_G1, chr1:294083488..294085905, Cluster 3
gtactatagtcctgttgcaggggcagaggtgtatctataataggggtacgttgtcatgttgtatcgttgaacactagatttcatgacgttagtcacaacgtagtaatcgatttagtaaactatactttataatacttcatcgtacactagtgtgtccatgtgtggctataggagcgatgacacagtatcggatagtggtctttagtgcgtctgctgcctaagtttacagtgtctcaggtctagaattttaggtccttttctcatagggtctgttcggttaggggtaaccgaataaagtcttagagccggttcgattattcaggaatctagtccaggaagcatttcagctggaataattatataatttgtagtataacaagttacttggaatagttactagtcttattccagtctaatcgaacggggccttaaggtgcttgagatcgaggtcattaggatggtggacctataactttgccaaagcaaatgcaatgcaaggtatatcaccaggagatgtgcctcgtataatttgaaggtacattcggtgatacgccctttctcagacgtcgacagcatgcatatctaactctgtatgcaaaaaaaaaagacatatgaacgaagaattcgatcagcacacgcatgtttaagcctgcaccagccagccagccagtggctcagatcttgagacgttgaatctatccagtcaaagctggatgatgcatatggatgggatttggtcgcagtacaccttgtcggccggaaggaaagctagctctgggacagtgaggaggggctagctgaggcctctatcgggcgaaaaggagacgagcactgcccttcgccgctgtcagcgcagcggtggagcacgatcgctttcgagatgagaatgagatagacgacgacaactgcatgcgttgatgtgccatccgactgtcactcgcggctaataattacatccatctctgcaccggccgggccgggccggggtggtttcagtttcatccacacaaacaaaccacacactgcagatccaccggcatgtgtagttgcatttcattgcatatcaaagcttgctgaagattgattgatgctggcgtggtgtagtccatgcgttgccgacagcgtgggtcgtcgacggatcggatgatctacactgcatccactccacgcctttaatttgcggctagctccacttggcgggtccttgatttggctttagaagagtcagtgcctgtctgtgctccaactagcttattcaagcacatgaaacaaatgcgcgcgcgcggcagaaatctgtacagcgcggccaggctcgatctatctgtgtggatggatgatcgagctgattagtgcgcgacgatgcttaacgagcaatccagatcgatctccagactagtgtcgtcaattcgtcatgctatattattggcaattggcattgtgcttttcaggaggagatcttgcattgtgaagctactatcaggctttgaccaaatgctgcaaattaagccagaggtcgttagtgatgaggcctgagggggtgcagtggtgtcactgtggcctgtcggggtagtgcagtggtgccggtccacatgtcggccgctgccgcagtctgattactatttgtcaatggccatgcatgcgcctttgttaaaaagagagagagacatgcgcaatctgattactatttgtcaaagtttcctccacactaatttttttttacctccacaccatctctctagctcaccatgatatatacaagaattcagtcaggctgtggtatgtggagcatgcatggaaaccaaagtctcatgatgggagcgacatgattagctccaagtttagtggacaatctcccggtcaacccctggcctacactaaaaaaacagaacgccctgcatctagtctactagagaggaattggaataaatatttagcggcagattgcattccagccacacgtgagtcttttctctctctatatatattaccctggccacatagtgattttctagcatgatctagtagtctaacctctgatggggacaagcatatatatgagtagtaaggtggcgcctacgccagcgctagttattaatgggatgaattcagagaatcagctagcacgtagtagccatttgttttaattaaatgcgagaatcagctatccatgacaggagcatcaggcaaagcacatttgggaccagggtgtgtggcagtggaagacagtaattaacgagagttaccttgttgctcttgcatccaacacccactggcttatcctagctagtgcgcttcgtatcaatccatcatgaaaacctagccttgacagccagggccaagactgggctgcctgccacgccataacccattaatctcatagatgcttagttaggtagtgtttggttcggtgtcaacgag

SEQ ID NO: 520 - DNA, 1775 bp, Zea mays
  misc_feature (1)..(100): optimal_loci_5152_G1, chr1:26443948..26445722, Cluster 3
ctgaaagctataaaagctgacttcacagagtctcaggctcacgtggggctgttttcattgggttttggtcaatatttaaaactatcacatgcaaaactaaatggttttattaagagttaagtgtatctccaataacttcttaaaaccctagtctcatctttattttagaaagagaaaaaacacgtccaacagtccctagctccatctggcacggcacaaggacggcgatggtatcggccttcctgcagtcctgcgctgagccgccgaccccgtcacaatgccaaactcaagcgaacgttggccatgcatggaggcgtatcgcgagctcgtcgacgccgatattgacgaagatgccataagtgaagcggtagtccagctccttgaagctggctcgatgaagtgacggcgacaagaggccgacaagttcgcccatgagaccggtgcgcgcaggaccacgccagcacatggcgcgggaggtcagcatcatcttctacctggagaaaatctcgagcgagtccatcacattgtcgaccgtcgcggagtctggcgaccacacgagccaggatgtgccggcatgcggcaagaagcttatggcgtatgacgcaggggacacgacaacgacggagggtggtgggtcgccacacctcaacacatcgcggaggcccaagcatgtggtgaagcattgatccagatgcattggggaaaattattgagggttgttggagtagtagtattttttaggatttaaagttttagatagatcctaattttttttctgttggaagaaatatttttaagagttattaaagatgccctgagatagttaaaaatgatattatggatcagaataaaaaaacatcggacaatcgcgatagttgattgaaggagataaaccggacttcttcctataaaagcagcctgtatacataatgggccgacaattctctagcttagtggcgaggcctccgggccaaattcctcgcggctgccagacggctgggccctgagcccctgacgctttggggaacgcaaggtggcgcgtgtcagccctttgccgcggcagaattctgacccggcgcaatgcagagccgccgtcgcggctcgcagtcgcaggcgtcccgtgatttgaccggcgccgacgagcacaggtgcagactgaagctgagcggtgcggcagctgcgtgcatgcattgcaggctgagctgaggttggcaggtttgccctagtctgggcgtagtatgaaattgttgcgctgtgtttctcggtctgaatacgcaacggttgcacgcgagacgatcgatccagttcatagagacatgaatggacatcttaaggctgctaggctgggtcaactcctctaaagatgtgcgcctgtacactcaactcaaatgtgtctactcgctcgtgaactgagatctggcagtctactgggtctcttgaaaattggtatgcagcgttggaacgtgcattggggtatctaagttcaccaaagtttcttaatgcacttgacacggaggtaaagtctactttcattgaagagtttagttatacaatatcaagactgtcacgttattatttttctgtgacaataaactttttcctaataaaactcttattaccttttaatatttaatgtgtcaaatcatcaaatcctcttatcacacctaattttatttttctagaatccttttaaaaaaatagtttctatatctttggatccaatctcgcttaggaacatgtaatttccattgctaatacagtcaggagttgtttgg

SEQ ID NO: 521 - DNA, 1989 bp, Zea mays
  misc_feature (1)..(100): optimal_loci_53524_G1, chr2:9371370..9373358, Cluster 3
acgcccccactgcacccgaacgatcgatcgatcgattgccgactcatcccatcccatcgcctcctttaataatggcgccttacaatacgttatctaaaacgcaatctacgtgcagatgacgctactttcccacgcgacgcaacgacccaagccgcgcgcgctcatcaaggatcggccggccaacgcttttgtgccgccatcaacatcaaccagcagagcctgtacgtactttttattaattgacaactcgctccgcttgcacaatgcatgcacgcacgccacctttcttccagatccgcaaagcggccaccgagaagacgtacggcgtagtagtattataataattgatgttggcactgtggacggtagggatgcgacgggtgaaggaagaaaaggatctcaatcaaaacccaccctctcctcctccaaacctgatagatctactgccctactactactagctatctagcggccggcaaagattcggccggcgttgttggatcgccgcccgcccggcgccattaacccatcgtccaaacacagaaacactcacacagtgcggccgtgttcttgtgcggtggggatgggcgcatgttttcatactacaaagcggagaggtctactagctgctctgttgcgcctgcactgcacgtgaggtggtgagtggagaccacggctgctcctgccgcttgcattgctggtagtgtgtagggaaaccaggttaggtcgtcactccgatccggctccctggccagtggcccctgcagatctaccaatcagcaccgtcacaagtactacttcccacgtgcttctactttaacccttatgacttgtttggaaacactattttatcaaggaatttctattttttaaagaaaaaaatgaaaaaaagtgttaccgtcgccagttcattccagcgagaaggaaacgatgtgtgccgcgacgacaacagataatagcacatatatacccatatcgcctctctctggctcagcatctgcagcgtctgccagacgtgccatgcagcgcacgcgcgcgcgcggaccggaccactggatcgactggccgtcggacgcgcgccagagagtgctagcagagtcgtcagcctggaataatcaatgcaaaatgcacatgcttgcacagcaggggcggtctttcttctttccattgtgcacttcggatcggttcgtcgtcgtgtgtgtggtggcgtcgttgccatctggtaggtatacgtggcgctgttgtcgcagcttgctgccacgaacgagaacctgcactggcactgcacaccgtgcgtccgtcggtccatgcctgcatagagctagtaaaaggctactactagtctgccagtagcccagtactaccacttatcgatcgctactcgcggtcagtcaatagggggaggcaaggagaatgaaaagcttccaaggcctggcgccctggctcacggcacttcgtttcatgcccacaaagtgtgttggacccgccaaagtgccaaaggatcagaactcccgatcgagtgtgggaatcgccccatcatgcacacagcacacccccagtccccagataatagcgaagaatcagttgcagaatacgacagggaatccagagccttcttgtccccaaagcatgggcgtcacacaggccggctcccaggatgcgtgctttcagtcttcctgcacgtacggtagcaaagccgccagccagccagcctcgccctcgctctaataacaaagggaaaccagagtccgataaggactagggaagtttccttgccgcgcagcttgtcggattctgtgtggagatttatagacaacgtgttttcagagacctgtgatggcagagtatggacatactataatcctgcacagggtacggtggcgtacgtcaacatggctcagacttgggatcaggtggaagaggctggtttggtgctttggattccagcgccaagtatcataaactagctgttagtgtactcatgtcagg

SEQ ID NO: 522 - DNA, 1454 bp, Zea mays
  misc_feature (1)..(100): optimal_loci_54062_G1, chr2:12135826..12137279, Cluster 3
ttatcatggttcatctatacacgtaatgtccccgttggtaggcaagaagtggagaaaaactgacatacgtacttcacacatgacgcaccacgtacaaaactcgtactttaaagtagtagagattatatatgggtatatgtctaatatatattattgtatagcctcttatggacacatttatctttagttcatataacctatcgaaaatattttttttacatctagaaccctctttccttctactatgtttttcttcctcttatagaatcctattctttcactgctatccccctgattcctattgctctcttggaaccagttactaaaacaagataaatttgctgctctaaatttcagacgtgatgcggactaacgtgaggttgcatacagatacaacgcaagggacttatgggcctgggccgagctgggacgggggcatatcccagagctacagaatgtagggcctctcttttttccaacacaatgtttggcccccatgggccatgggacacgtcacacgtcagacctaacgacctgttgtactgtgctctcaatctctggacacgcatcatccaatgatgattcaagctcgtacagccacatgctagcgctccgaactcgtgatgagcgctccactaccactagtgaggacactgtgcacaccgatccactcgcatgtgagcgtccgccgtacggtcgcagctgcctggggctgggactggggtgcaggctcgcttggacgctactttaacacgtatccacgctagaatcattggccatgcaacatgccagcgtctcatgtctcacgagaggtgcccagcttttactagccgttgaccctgcaaaattacgtcctaccccattcctgtcgggtagcatgccatccgccgcagtgcacgtagcacggtcgcgccgtggcttgttaccaagtttgtttgtccgtttgttgtttgttgggatggggtctcacgtcttcagtgtttcaagtggcagcggcacgtacgtgcagacagagagagagagagagagaccgcccgggcgccttggaaacatttttgtatttttcaggtgcacgtcgcccctcgtcagttggtcctctgcgtcagcgcctgtctggccgaccggggcggcgtgctcgcaatcgcaaggcgcacgtccgcccgtggccgtgggacgtcgacgcctgccgtggcagctaataacattagggcctcctttagaacgcagcgaaatcttacagaaattagtcaaaaacataggcgagcgggacgcggtgacgattcccttttctatttttttattaaggtgtgtggattagatagaattctttatcagtcctttatcatggaacgaataggttcgttgcccttgccccgccggtacttggagccaaccggcctgtcggcgcgtgggcaacagcgacgtgcgcgggccggccggggacacgcgcaccg

SEQ ID NO: 523 - DNA, 1633 bp, Zea mays
  misc_feature (1)..(100): optimal_loci_54073_G1, chr2:12240262..12241894, Cluster 3
ttactcaccgccagagcgaccatgagtcgagtggtgatgctgtaatgggatttattgtaatgcagtccgcactactttttgacaaggacaattgagggagcccatgttagggattgattatgactttgtaaaatagcttgaaaatagtgtcctagcactactgcactagcaaggtactacctccttcattttatattctgaaaggtagatccgttattcatgtgactactgttcaggatgacaactaagagtaccctctatattgattatgttttttttttgctgacctatcccgtgcttacatggtcatgcttcaacattgaaacagcacacagaaatcaacccccttttttcactacgaaatcctcgtgctgttgtggaagtggttagcgtggtgttcgtgtcgttattgatctctgaatgagaccggcctgtttgtaatgtagccgttggttctgtttgctggggaagcttttgtttttcttttgcatttttttgtacgtttcgcccccatgctttaatttggtcaccttttatgctgaagtcgtttgcattcgttggatgcatggtacagtgatggatcggcaaactgatcgagttcgtaccgatagcctgccggtttctccatttccccgcttgtttgatcaatcattcaatccacatgtgttgggttgagtttgtttgaataccatgaatccacgtgttgtgttggattacaccaacatgtgaaaaaagataacacaaaggtgtccaaataatgaagcccttgcattattgtgcttatacactgggagttcgaaccaaatgtctgaccaagcagttgcatacttgtacaggccagcagcaggtacatgccgaattaagcatccatcgctgagcaagaactgtcggcaagagagtacatggtcccagagcctttgccggtcagtggagagtggagaccgccgtagcatgcatgggagagagctcgacactggcgcgcgccatgacaccaagcaacgcgccaaacgccactgcacagtgcacacactgcctgctgccgccccccctcgctacgctctgcctgtgccgcgcaagtgccgaccggtgtgtccagctttgtcacatgagaaagaagctgcgagtggcgcgaaggcaggcctctgctgccactccctggacgccatacgtacggcgccactgatgcacgtctcgatgaaaaagaaaagaagctgcgcgtcgcttgcgtagtggtatagtactatagtaggtcgaccgcgagtgcacatgcacacacgggccggccagtcggtcgcatcgcatcgcattcgaatgcatgtacgcacgcacgcacgctcgcatcgacggtcccggtggtactaatgtttgcagcgtcagcgagacgaccgggccggatcggagctggcctcttttgaagcacgcgtgtacgtgggctgccgcggtgcttcttttggttggcatgccagaatgacaggggaaagggaaagatggaagcgtaattaagtaagcctttgttcgtttacaccaatcccgctctggattagcatggattggaattaaatccatgcctcaatccatgccccaaaatattccatgactacttaattttttttattcggttaaacccattatg

SEQ ID NO: 524 - DNA, 1865 bp, Zea mays
  misc_feature (1)..(100): optimal_loci_5417_G1, chr1:27818298..27820162, Cluster 3
gaacaatgaagccaaaagatgacattcaagaaaaacaagaagggtcatatctatgtgttgaatgtgattctgatgcgtcaacaagtgacagtgaagatgattatagtgataagaagaatacaaagaagaaaggttaaaagttagagccatcagtcatctcaaacagctaatcatcggatcgcttggagccgtagccactgacagctactaattgcatatagaaagaatagctagatctccacgaatagttagttgtatctaaagcgagttgcagatacgcttggagatttagaagcatggtttaaatgtataagtataaaattttacatagagtagctcttggaatatttaaatcagcaagtgtacaagaatttttttggacaatgtcgttgaaatcagtcatgtttgagagagtttcattttaagaattataacttcggtttttcaacttcactataaaacaacttcaacataatggtaaggcaaggttcaaaagtatttgtattgcacatagactccagcttctataatacaattattttatattagtctttaattacccttgataattagcggtgaagaaggagacatgaatcggtaggtcatataaccaatgatatgatgggtattttttgtgcgacttcatggtgagatatgaaaatagtgtttttaaagcaccctttgaggagctttgaaaatttcataaaactggactctacttttagttttttaagctacaagtcgtagagctggatacgtttgggtagaataaactaaaatagacctaaaattcttgaagtgaaggtttcctaaacatggccttaaatactaaagaaattgtggaaactcatgcacgaaggcaaggctaaatatttaaataccaaactttgctggagcatgtaggtgtgtcacatgcacatatagtctagctaggccagcagcttgcacggtgcagctaccttttgattaattaaattatttataatacctgtagctgtctagctgatttcatgagatagattatagcgtgaacgacggcattggaatattcaaaccatccttttttggaatgattggattatcttggatacacttgaattgcaacatgcggattaggttaaacgttagctgcgaagaaaatcggaggtgcggacgatgctcgcaaaagcagctactgatgctggccactgattctgtaagagagagagggctgttttccaagagagagagagagagagagagagatgttgaagcaaccacatctacagctgcaaaaatcagcgggcgattcggcccgtccgtccccacaacttgacagcgagggtttcatgttacttgcacggaatagcgacggcgtgcccttttacatgatgcgatgcaacattactctagtgagggcgtgttaatcaagcttatccatctaccaacctcatctcctggcctctacaaatctacaatctccaaggctattctcaacagcaaagtaaccggtcatatacgtgatcagttggccatagcctaagtaacactactagaaatcaaggcttccgtctcagaacatcagtaccggttcctttttaatcggttttaactcccacgtcatcatagaaaactttaatacggctagtttttctaaccggtaataatgttaagtgtttaatgccgttgaagacaaatgcttaatattagtaacagttagacatcaatagatactaatgttcttattttatagaccctccacttctttcgttcgtgaaatcctaacgggggaattttgaacagacgtcgataagttgcaattttttgacaacccccgtgctttgcaccacaatccgctcattcgtccctgcccgccgccatccatc

SEQ ID NO: 525 - DNA, 1499 bp, Zea mays
  misc_feature (1)..(100): optimal_loci_56489_G1, chr2:25401193..25402691, Cluster 3
catgtctgttgtaacactggataggcattcaaagagcatgtcaaacaagcagtcctgatacatagtgcatcgaatgtgccctatgtggcaacggacaccacaccgtacagggcacccagagagcatgtaaattgcacagttcgactgagtactcatcagatgtgtctcagggtgtgctcgatgaatgcaccaaatacctaacacatttaacaactagtctatagccatcaaaattatatctgttggaaagatcatacactagatgtgtttggtgcagaaaactattggattttgacttagagttataaatagacctcttggctaggattggttgttattccttcacttcatacacttgagaacacttcttgtgtagttcatcatttgcatttgagaacacttcttgggtgataacacttctacactaggaaaacacacttcactcatttgcatcttgtgtagttcatcatttgggtgagattagagagctcctagtgcatcacatatagttgtagcatcttatggtactagttgagcgaatttggttggttttactcttgttgtccttggtgattgtcgtcacctagagttcgtgagatcgttgagcggccattggagattatcattggctttaatcatcattatgaggggatctcatgttcattcctcgtaggagattcacaaagagcaactatagtaaaatcatggattgttgaggtgtctctctacaatagttcttacgacaccattattgtggacttaacatgtgaacctcctagttggactcgccacaatgagaatgttggttgttagcaagcaaccaaacttcaaggatatttcttgtgtcatttcttatcctatgtagttttgtgcttcttacttaccttgcagttatctatctacttgttgttcaatactagttcatcaagtattatgtagtttttttcatagttataattgtcgtaagtagcttgttttgttcaatttatagtagaaaccaaaccactagtccttttagggggtttgcatagcataacctagatcaagagcaagtatagacttttgagccatcttttatgtcgatcatctttgtttaatgataattgtgttattgaggaatttttagtctattcatcctctagccatctagttctctagtgatgattgtgttgttattgaatatttttagtctattcatcttcctctagcgatttaggtcttaattggaccgtcatattaggaattacgcatggacatggagggggagggggagtgaatggaaaacataagaatgatagagaggggttgattaggccgaggatccgcatgaccaattgatattgcgtgggtgacttgtgggcatataggcccacatgtgggcatatagccccacatgtcaaccaccctaagaaaacatacatagtgggagagatacgtgggcacacgctcaggttaatcgagaacaagaaccgcaccacatgtcttattcttaacataca

SEQ ID NO: 526 - DNA, 1898 bp, Zea mays
  misc_feature (1)..(100): optimal_loci_57436_G1, chr2:30899538..30901435, Cluster 3
tccatgtagaaaatagagtgaatctagctagtgaaataactagctattggagacgttctaaggctattcttaatagtgtgtcacattagatttttttggtgacatagcataacatttgagaggattgggtttcatgtgatgaaattagttttatggggataaaaccatgtcaactcgttttccaaggtcttggaaaccatgtaaaacctctattgagagtgatttatttcatattcacataatttactaacttctattagacattgagttgcgacatttaattggtatgttagcgtataaaatagtgacataaaatattgtattgagagacattgtttgattcatagttttatagcacttaattatgatgtgacagcgttgaaaagaatgccgtcgtcttgagatcacgctaccaccctatcatgccttgtcgtcgtgttaaaggtgaagccaaaaaagaatagctcggccaattttagttcacatacaaagttatcctcctactattgattagttgttttctcaattcacagacacacaacaacttataaatagagattgactatattagtcataaatttccaaaactatatctagacatgattaaaaacaatatagaagccattttatcaaatggttttttatatttttgtcttctctataaaacagttttgacatagaagttagagtcaaagttattttttaaaagataaagtcgtacaaaaggaggtccaaaaaaacaggggatgtatatcgagagcaagcagatgacatgttggaagagtcccaaccggtcgttgtagtgagtgaaatggtggtggatctcatagggctctagattggtgtctatgatataccatcaggtggcttagaaaatgggaagaatatgggatatcgagagcaagtggaggacgaagttgacatgttggaagtagttggttcaccatttacaagtttgatgttcataaatacacggcaacgacaacctcttttatccacacgcaacgcaggcgacactcccactatctacacaacgttaatacattctgggttgcagaatcttaatcttcctaaaccttaggccaactacaatagctcctaaaaacactgatctcgataaatattttagggataaagaaaaactacggtccagcaattaccgaagtgttctccctatcttttcgcacgcaaaaggagacccatccatggcgcaaacattcacaggcgcacgaggtccaaaactgcatgttttctttgttcccgcgcctaagatttccttcgtgcctccaccggtctctgttcccgcgtttgagatttcctttgcgcctccatcgttcctatgtcctccccacccctcgatttcacgcgcgagggaacacgatgcacaattgaacgcattgttgaatctctctgccaagctttcagccccgttgatgttgtttggcgagtacctctagattcttcttgggcaacgtcgacgcaaaatccatctgcaacggctgcagttttggaggtaagcaatcgcaggttaccttggattggatcataggtcaacatagactgggatatcctagcgtgcgcaggacaccggtcaggccacttgcctcgcaacaaccttgggccactgcgaacgcgcaagctgatctaaatctgagcggcgaggtcggagggacttgcttgcagctacgaccctgccagctcatgcacgtggggtagattaaaggaggggaatggaggagatgggatgggacggaacctgaagcatagtacgtaaatgatggattattggaagggatggggtacccagagcttgcactacaaaccaacattgtgtcgataaattttcatccataatttctttcaaaagtacctcataccatactatatccatataggga

SEQ ID NO: 527 - DNA, 1601 bp, Zea mays
  misc_feature (1)..(100): optimal_loci_5773_G1, chr1:29519610..29521210, Cluster 3
tttggcgcattgctgcgctctcctttgacggcagggagctagctagctagcagtagcacgactgtaaaaaggggggggtcgtcgtggagacatcagcagggcaaagcgaacgatgcgaaaccgtacactccaaatgatgtgtggttgcagtagcgcgccttgaggcaggtgacgttgagacgcctgatccagcacggtttggattgacagacggatcacccgaacgatgcaaagatcgatcatccgaaaacttaaccgattcggcttggcttgcatcgtggctttgcatgaatcggtcggtcgtcatcaagccgtgcggacttgtcgaccgcttaggtgttctttataaaaaaaaacaaaaacaaaaaccaaaagaactgcttgtgtttttcctatgcgaggctctccgcagctacaggattctaatttctagagatgtagtagatctcatgaaaggaagagcccgaacaaaagaggagttcgcattaggtgttttatcgtgggccggcgcatttccagctgcccatcatgttcatgccgttaggaaaagctcggtcctttatggtgcgtgcttgaggcccactctcactaccagcccgccaccaccgcgcgtgatcacgcctagtaaatgtaaatcgagggagcgaggcgccaacggtaaacgttactactacgtgtcacgggaaatcgggacgtcagtacgtgcatttattatagtacgtcgccgcaagtattcacacgcctcacgggatcgtcgccggcgacggaggagcgggactccccgtgtagctgggccaaaaaaaaaaacggattcggctcggcggtctacccgttcgaagctttcacggcacgcgcacgagcatttaagcccggcccatcaagtatttaaaccgttatacaattccgttcgtagcctagcccgcaaacatatgccgtcactatacactgaagatagcaggcgcggaccatttccactgtcgtattacaactcgtgtcggcccaaaccatacagacagcacctgtgtctgcctgtaacgaacggtccaccatataccgaactcttttgcgacgcagtttacgcagggaaaaaaaaaagaaatgcttttttttttgcctccaggaagtatagtccgagtccaattaagttttactttaaacgttagatggattgtctccttccaaaccatttaaattaaatcatcccatgattccaccccagctctgaaagtattctcttgctacactttagctagcagtagggtgtttggttaccgagataatgggctagctaatacagataaaaagaacgtgtcaaccatcctgtacctttcagtagctgagaggttgagtaggtaataagataacgtagtcgtctggcctctacataaagtttatctcgttcattagctgttactatgttttggtttgaaagtagctaaagtttaacggatatatagtaatggttatctgtttggagctaaacaagccctaagttcgttcatgtgatgattgggtaattcctttccctaatctatgttcttcgtgagtgttcgcgtgaagacatgcaggccgtcacccgtcagcaaattaattgttacaac

SEQ ID NO: 528 - DNA, 1420 bp, Zea mays
  misc_feature (1)..(100): optimal_loci_58041_G1, chr2:34671827..34673246, Cluster 3
agctataaaatagcttgttttgcatccactcatgtagcctgcaactttcttgtgcaggcaaccaaacaggagctcagataaagtcaacgcatatggtggtccaagatgagacgatacgggtaaccaaacatacagacggagacaaagatggcaacaacggaaaacgtaaaaggaaaacataaagagtaatacggagactgcatgcgcaggcctctccggtttatttgctgcttaataatatttatcgccggctacttcaatattttttttaaaaaaataaaacagaactggttgctgctagctagcctaccatctctctcgaccgaggcgacaaagagtgcgtgcgtggacggggtgcgcgcgtcgtcgttgcccccgagaaaagctgcggccggcgcgggcgctggcgctgctggaacggaagctctgcggcgcgctgccgcctgcgatccatttgcgttgtggttgtaggtaaataaagctgtcacagatgctcgctcctgtccatccagtttagtttttttactgctcctaataaggcttcctttttcaccttaaggccacattatttcttgcttatataaatatcgtcgatacattattatacaaaggggggggaggaggaggaggaccactgcagccggccgagtcagcttattattgccgagagtccgtatggagcgtccgcttctgcgctctgtaccgcgccggcaccagggatgggcgagttatttcatccggcggaacaagacacccaacccaagtttccgttttggtggtccatgcatgcatggggctagagacagcgcgcgactagccggccggccgggcagaacgggagcgcgatccgcgcgacagaagatgatgccgatcgatgcgcgcacagtacgtacgtacgtgccacgaacgacgagcacacccatcacaggcgctggttcattccactacgtagtctgcgaatacaaccgcatgcagcgcgtactagctactttgctgcggacacacacgtacgttcaagtatatatgatatgtacaacaatacaagcaaaccgccacttgctggtggtgctggacctggaatcaaccgtcgtgtgcgtccgcgcgattgccgcccggccacttggtgctacgatacctgctgccggccccggccgtaccgtacgtgctaggcgacagacgctggcgccgtgcccggctaccgcgctgcgcaaagctcttgcagcgcagatggctcgctttcagtgtccctctcttttccgcgtcgtcggtcgtccgtcatccgatcctctgcacgccagccgtcagaggattggaaagaggagaaaaagttactcatgccgctgcatgcatgcgttgcttcggtttttctttatcctgtttcgtgctttgtgtgtacgtgacgtgaggacgaagacggggg

SEQ ID NO: 529 - DNA, 2564 bp, Zea mays
  misc_feature (1)..(100): optimal_loci_58992_G1, chr2:40138714..40141277, Cluster 3
atatggtaagcctaggacaccacaccatcgctccaccctcttgtatccagcaacggcggcggtggcgttagcggtgtgacagtgaggcaggtgacatggaggaacatggcggaagccctcgagagaagctgcggggacgcgtgcgggaggccgcatccgtggggtggacctggagatgagcggcgtcacgagcgcgcgccctggagagacgccttcgagctcgaccgcgctgatgtacgctgcctcaaactccgcgaccccgccgagcggttcgccgccctgcagctcggcctcggtggctgccccttccgatgggggaccctggcaagtctgccttcgttttcgccccaatctccttcatgatgttctagtaaccccactagtatgtacaggaggattctgatgaacatcttgcgatcgccagattaagctgtctcaaaaagggcctcaatttgcaacgaacccaggcccagggtaagtcgtgggccgggccgtccgtccggcgcgcacagagctgagacggttcatggcccagaaacggaagcagaaagtagtgcgagcccccgcgggatccacgcgtagactgttcgtctgtaccggcacatttcggtgcggccgccggccggtgtaattaatggtcgcccatcctactagtagtccgaacaaatacagtggtgagaagtactacatacacacacgggtgcatgtgcatacagttgggggcgttgggcaccgctcctgctttccaagacggccggcgcggcgcggcgttccttttttgttggacggacaccggctgcagcgatccttctcacacttgcagcaaaggttggcgttcccgcgccgcgcccaaaataatgccatcgccgggcggcttttacgtctgtcgggcagcaaatcgagcccgcgtcggcggatgcacgcgcgcgcgcgcgtggctggcagcagtagcagcagctctagctatgccgcggcccgccggccaccgcccgcccgcccgatggcagatggagccggaagaggcccgcgcagcgagcgccgcttgcttcgcgcacgctacgtcgtcttgacccttgagcagcacctcctcatgtcattgtcatgtgggctagcgaccgttccgtgctgtgcgtctgatctgctgagaaccaaatggcagccatccaaataaaaagaggagcacgggccgggggcgggggcgcatcccgtcacgtcacgtgcccccattgccctcgagggcaaagaaaacctaatcaaacaggcgtgggggcacgggaacatggaggcgggcgccggtggtgtcaccgagatcctggaaaattctcgggccttggactttgccaaacagtcgcggtcaaatgattgcccttctgttctgtgcctcctctgcacgcacgcacgcaacgcagctgccccccgccggcttgcagacaatgaactattcgttggttgtgaggtagctaataattagttgcggtgagtaattttggaacgtacaataacaactattttttaatagctaactgccgactacgtacgtgtacctccagaaaattctgtttactagccagagtagtttgtgcgcgcgctatccttggccatttctcaatgaaaggttttgttttctatgtgccatatataggtatgatgaaacaaatgagatcatggacgaaactttccattgggagtgcagtagtgcacagtcttattttgttgtggttttataggcaacatgcatgcaatacatggaacttatttcatgtccctcataataagtaggctgtcatgtcacaatattttctgatttgtcacattattcaatgagaatgatacttacactgaaaatgacctcgtggcatatattggcatccgatatctggccgtccggattttagggtttgagtcagttttttttttttttgttcctgacagcgaatggtgcgcctacgcatgcatgcgcgcagcataccacgcactcgatcgcgcccttgcatgcgtgtcctgccacgtatatactcgcaaataatagcgctgagataaaaaaacacccgcccacgtcgtgaaatgtgaatcgtgtgatcccgaagcgcgcgcagctagctagcgttgtagtagtagcacagtggagtactgctgtgcatgaccaccactccctcctccttttcactgaactggcctatagatagatgggagcatgcattgcatatttgcattgcgaatcgatcgccatcatcagcgtaggtttcgcttttgtctttggaaaggtgcgcgcgcggctgcatatatgcaaacgcatggaccggcggcctcctccctccgctagtctagtccgctccgcatgtcaacgttggactacactctacgccgcactcgcaggccagacatggccgcatgggtagtggaaactggcaaaaggctccatccttttccccttctcatgtgacgttggggcccggtcccgtgaactcatcaaatcagaagtcgcagcaggcactagtagtacgcgtcgtactgtacagatgtgtgcatgacaggtggtgtggcgtggcacgggatgatcatcg

SEQ ID NO: 530 - DNA, 1579 bp, Zea mays
  misc_feature (1)..(100): optimal_loci_61011_G1, chr2:52325215..52326793, Cluster 3
gaaagcgaataaacgagaccacataaccccaaggagggccccaaatcctcaacaccggggactagccattcgtcgtggcccaataggccacgcctaacgagagtttggaggtgcccctagtccaccaaggatcgacgccaataggccataaggggagctaggtgaaagcttgaaggcaggaagggggcaatgaggaaggcaagaggataatagaaaaattagaagggtagcctcaataaataaaggccccctttagctcctcaacacaatagcccagacatggtagcctgtcagacaaaagcacatgactggcccaccatcgggtcataatcagaccaacatgcaccaaaccacccctagaagcatacctaagggaaagcaagagcaaccctccgtgtaatggtaattcctttcaaaaggaaagacacaaaagggggcacattaattaaaagccctatgttgtgaggacctttacacatggggttcccgtgtaaccccatattacaagcctggactaaggggctcgacccgacgtcatagggagaagaagataaaaaagagggttacaagcgcaatgggggagcaggcccatacaagatttggtgaccttttccttgattaccggtatacaaaatcgggggaacaagagctcgatcacagaaggcagatgtctgttggagaatctctaaggagcccagcgtgcagcggatcaggttctccaaggacactaaacccatgattcctctagacgcctcatcataccccttgatcaagctctccaaggcccccgatgacgcgccttggggaagatccataggggtgcgaaggtcagccctagtgatggcagaggcaatggtagcgccacaatgaacaccatgctccacaacattccgaacgtggtccgggacgtcgagcaggtgctgcacctgagtcaccctacgaacatggatgcttcaagttacttcattgacttgctgacaaatctccctcaactccgcttcctggcctgataggaaaccaggataaggccttggaaacccatgtgacaaaagtgtgagatagcgagtgtcgcagcttactagaaacacgggcctccgcggcagaaagacgagcctacatacccacgaggtgaacatcggcaatcctcaaagtcatctaagaggaggccagacacatctgaagctctgcagttgtcagaagcagaagggtctgaggcctaggaccaccgatcggtgcaggaccggtagaacgggaagaggcaacgaccctaccacaaagaacagtataggaaggaaaggccctgattcggtctgaactgtagctagtgaaggtagcagctgcctaggattgaagtgtcatcaacactcctttgaggtgcaagcccaagggcaccaactcagaggctagcccttgaccccttggctggagagaccgcgaaagatagagacaaggagataacctctccttaaacagtcgagacagccgacctaatgtaaaacaacaccgaaaggatgaagatgatgtagaaaatcaaaagggttcaaaagccacttatctttcttcaaaagaacgccttttg

SEQ ID NO: 531 - DNA, 1912 bp, Zea mays
  misc_feature (1)..(100): optimal_loci_6242_G1, chr1:31849968..31851879, Cluster 3
taattgctcacttgctcctatccacgaacgaatgatcgtctaatgattgaccgctgcagagaagaaatgtaaatacaacatccaacgaattgatcccaagctctgaactgtctgaattatgtactaatcattgacaaacggagcagatagatacatccgcagacatttttttttgggtccagagctttctcgttgtgatgcggataattccatgaaccaccaatagctggcaaaaagggtttatctgaagcagttgggcagtcacatttctttccttttctcctttaatctatattttctattttctcttccccaactgtaaattgcatgcgtattagcatatacgtgttgtgtatacgcaacaaacctagctaccagtgtaacagtagcagcgtggcaagtaactgagctgacggtgaccctaggtctgcttctgctagtgatgtaccagtaaccaaaacgacagctacagtatgaagatactggatttgaacgctagctgcaagaaagttttgcccagtggagaggaaaaagctttttttcttttctttgagcgaaataggtttggattaagggcgacactcagggcccttgagaaaataataaaaagatcatttgttaagcaaccaaatcaaatgattggggctgcgattgtagcctctgaactgcagctgattggttcggatcggaggcatcccaattacaccaataatgaaggctttccttgagcttatcatggatggaacaggggggaaatttgggcagaatgcagaggcgagttgttgagaacaaatttgtagccagatcaacctcccaatgatggggatttggtgcaggatcctttcgaggtcgacgttgccttgccctacacttcatctgcagcactgcatgcagccatacttcgataggacataggagacatacacgccatttgtttcttcttccttttgcagtaaccaattttggtggtggcaaaccctgccccagcatggaagaaaagatacggaaagtaagattgtatttatatttatatactgacagtcatttttgttagaaaggaaagtaagagtgtatttatatactgatcaacgacaccccatattaatttatcattggagtgcaattaattagttctatattttgtcgatgtgctagtactgtccaggcaaccaaagtatggaagcgtgcatatcagcacatacgtttgtcctttcattccttgtccccagtgcaactaccatgaagattacacaaatcataacaaagcctcagtgcatgcagaacagatcttagtacgtcaaaagaatggggatttcgtggactcattcgccacaaatataattgaagtgccgactttaaatgtgtagtggttagttgcatgtaaagacaacaatattaaaaagaacacttggctccaaaagaaagaaaggaaatataagaatagcatgcatgaaataagcatgtgctcctgctcctgcttcagtgttcagtacttgcatactcctgcatcgggtttctgaatgtctctgacgatctagttgcgtttgtttgaccaaacaaggaggcaatggcgtagcactgctccggagatgtcactgcgatagaaatggcatggcaccaactcatgagatagtcctttggggggttttggcagagaccccacctctccgctgtagccacacatgacacgtaccattcagtgcttgtttcgctgatgaagaaaaggggcatatagaaaaagaagatgagaaatttgcaagagaaaacaaaaaagatcttaagatgcttcaacttattgtacgaatgttggagagcaatggatgattatgtgtgcagtgcagaaaaactgtgtatatattgggaacattgaaggcaagacctagcagtagtagctctagttgtctttagccca

SEQ ID NO: 532 - DNA, 1662 bp, Zea mays
  misc_feature (1)..(100): optimal_loci_6666_G1, chr1:34294127..34295788, Cluster 3
cgtagccctgactaagtgaggggcacaacactaaatgacattataaagaagtatccaaatgggataactcctcaactattaaaaggcatggtggccttccgtgttgcctaagcattatgaggccagacacctctagtgtcatggacctccaagggtgaaatattctgtcaatgagacaccttgtgtcatggggcactaattagacaatatgtacttatggcacgctatgccctagggcacccacaagactaagtgtttggggtgtctcatgacccttgtcgcttgaaagcataagtcctcaagccactcacatcctgaggaacttatgatcctaggtccttgggggtccctcgtatctctatgcactcataagtgtaagtccttagtgggctctagtttcctatggcacttataagtataggtcccttggacccatcatatgtcgaggcacttgtaaatataggctctcaggaccctcatgcctcaagacaataagaagtttgcaaacacgcatagcagtatgtcccccaaacattaccacaattagccactcagggtacaccattggccttaggttccttagagaatcctcgaccttatattttgagggtagctgagactcagactctttgaggcatagggtcttcgaggagcttagaattaggatagttaacctcatgatagaaggatgtgttgggcccattgaggatagtacgatttcgagagacgcccccacatctaagctcccaatgataagttcatagtgaaaccttaatggataagtctcaaggacaacacattaatgtgtgatcggtgacaaaacgggtctgtcagatgttttgttaccacgacttaggttgtagggcactcaagatcactagattgtgcgtgcatcgatcttatagacacatgtgtgcacacaatatgtactacaaagtacaaccaattgcaaaggctacactagctaccaacacatcgtgccaagtgatataatccttagtgtttgtagacacaacttatcatactcgcccctatcgctagtatgatagtcaccctgagaaggaacaactgcaaatgaagagaaaaaataaggctctaaggaccacattaaatgcgacaaatgaccttatagtcaagccttcaccctaaaatgctcctaaggggcaggtgtagtcactgttactataaagatgttccatcgtgtttaagactatacttaatctagcaatcatgctcgttactagggatgaaaaatcactataaccatgactaggtagtacgattgtactttcatgtattaaaagcactaggaactgtaataggctcctatcaagacatactgacaccataaaggcacatgtccttcactttgagcataacatcaagaggtcacctccacacaaaggattaagactggcgcatgcactagcataaactagatgactacgagctacaagatctgaggtggtatagatacaagaccatgataggatggggcagtaggcttgatgacaggtagagcccacaagtagaacatgcatgtgagctctatccccttgatctataaaaagggagggggtgagcaacatttaaggaggtcggtctaggaaccactctagggcattcattctatgtccaacatcccatttccaacataataca

SEQ ID NO: 533 - DNA, 3146 bp, Zea mays
  misc_feature (1)..(100): optimal_loci_7478_G1, chr1:39013266..39016411, Cluster 3
gtccaacagtgccgctgcatcagtttcaaatgtagtaatgaaatgggcaagaattactatgttgcatgctctaaatccacttggggatattattctggcactcgcgcgcagtggcatgcatgtggcacaccgtatcgtatatagtcatgacgtgggccgttgagaaatttttatggatcaaaactattgaagttttagtatctttaattgtatatgcatgagcttcatttcagttgtaggttaataccagagacatgtgataattttgtcagggactacttccttaaaaaaaacaagttcgcgggttgctactccatgtgactagtgacaagacactaaaaagaatatgacaagtgactacacgtactaatcgtgcttcacgcacaggcacagcacatagtagacaggaacaaaaaaaaatatgtggatttagtatctattctttgctccgcttttggtctttgatgaggtgattttgctttgccttttgtgcacgtactttttacatgtcgatccgacgacgacggagccgccgtataatcgcaacaccatttcgtttctcttttctttcgctcctgtggtggagatctttatttcggaaacatcctttaatccgatttttttatttaatattagttttattataatccgaaacggagcacgcacagcggtggacgtcgtaataaataaataaataataaattaaataaataaatacgatgcttgcgcgagatattatccagcaatccaaagctacatccgtgcaggagcgctgcgcgacacacctcgttgccaaagctgcatccgtgcagtgcagtgcaggacaggacctcctttgtttaggacgcgatgctgctggtgcgagatcggcacgacacttgcgtgcgcagagcgcctgctcggctagctgccgtgccgcgtcatccatgtgtgctctggcgtccagccagccagccagctccccccgtaatttcgccggcaggtttgactgcgtatctgagcagcatccgtccatctccattcactggttctgccaaatgcctgcagaagaggccgtggccccatggacgaatttttcttctcttctcgataggcagattaaaaacgaacgaagctagcctggttagcaacgtgccggccgctaagctacaaaagaacgcgtcacgggaaagagataagggccgcgaaacacggccacgaggggtggcgaagaaagggcgcgtcgaaatgattgggggagggaatcttgttccggctccgacgcgaattggtgagaagggcccagctttccgtcctggcctgtcgcggaatctcatggagatcgatcgtcgtcggacggccgccgccgagaccaccctatgcctgctggactggacgctgtccacacggctccgaagaaccggcgaaaaaaggaaaaaggagagcaacaaacgctagaaaccattttattagtacaagcgctagtggttagtgaagccggcgcggcctgtgccgggtcgctttgggcaaagacgggtggtgggtgtgttcgccacgatcccatcagcggctttggaagaatccaaaggcgagcgagcggccggccgggggggcaagaaaagaatcggcgccaaatgggtaccggccaggggcaaggaaacgcgggggaaggcacttcacttcagcgcacttgggatgatttttttttttttttttgccggttctcacgacacctcgctcgtgcggcgcggagggcatggcgccgtgtccgctgtcgggcacgggcaagaaagtggccattggccagccggggggtcgttcttaaaatcttgatgtgaatgcgatacgtactgtgatcggttgttgactctgccatctcttggcgttgttttttttttctactgctcgcccagtcttgccgatcctcatctttggacagctatcaattgccacaggctctactatagctcgtggtatcgtacgtacgtactgaaggccccggcggggttcacggtttcacaccgactcgctcgacccctctcatcagcaaagtcagcagcggcgtgggtgcactgccggattctgaccactcgtaggctcgtggcatagcgtcactgttcaggcacttgtacgtcgcaacaggacagacaggctccgtccgttttccgtgatcactcttgcattgcatccacaaatcagcccaggccttaacctggcaccaaaccaccaggttgcttgggccagaccagccgtgcggatctcccagggtatcgtcggcccgactcggttggttgcggcccgggccttcaaccagcccatgaaaccgcacaacgttgcggaatatgaggcgagcgggtttggcgtttggctcccaagagtccaagacccgatgggcgcggtgccttccacttcgatgcgaccttatttcaaaaatcaacattgcactttacacatttgtttcccaacgattacactctttcactgtttcacataccacctgactgattggctcccaaatacggcgatctatggcgtacaagcgaatgcaggcacataacctcaaaaaaatggcactgagacacacaatctagttgatgtcgctcgtaatctggtcagtggagtcatatccaagctggagttacacatttgccccttcctccactcacgctcgagttctctctgtctttgccgacgaccgccatctgtgctcctcttctcctccattctcggcgccactcatgccctcgccggcagtgcggtcctcagccgccggagtgcgacgtcaaaggtaccgccgtcgaggtcgaagatgaggacatgctgctcgatttcctgtcgagcccgcaagtgatggcggcagtggtgggctcgttgacgatgcgcatgacggtgaggccatagatgacggcgacgtccttggtagttctcagttacagatgtttctaggtttgtcggtatgatacatgcagtagattgactctggatgttcctatagatagtttactatttatctagccctaaatttggttaacaacgcgggtaataacaatggtcctatggcccgttgctctcttcttggccatgcatgtagcatgcatcactatagagtaaacaatcatctcaaacatgctttatacgggtttactttctgatttactccgacatga

SEQ ID NO: 534 - DNA, 1425 bp, Zea mays
  misc_feature (1)..(100): optimal_loci_80271_G1, chr2:173369340..173370764, Cluster 3
ggcgtacctcaagacctcaaatagttagcgttgcttgtttgatgagtatttttcgtcctagattgttacaccttttctacattgaagaaaatgaaaaaacaacattgttgtggtactatgtattttttaaagaagccgcttttactatttgttacatttctattttctattcttgaatgcagatcaaggccttatctaccctctctatactctttggacaaaagccttgtgaggaagttgtgcatattgttccataatggatatatttttttgattctttatttttattgcattttcatcctgatcttatagtgttatggtcattatcagagtacaactagcaactttcttatatgttgtactttgtactattttcatatcgtttcatctatctctttcgaatttgttgtcgacctgtgtcttaggcaagcaaggagttttcgtctggttctgcccaaggaaggaagaaagaaattggggactttatgtgcacacatcttaactactacttttctcctttatgcccaagaaggcttggagcaaatgcttgtgctttgactgtatatttgaaatagttgatgcttcttttatgaaatgtgaacctttgcaagaaggatagtccatagaggaccttgtcacttccaaaaagcacacatcatctctgcttgacctttctctttcactaattaaccgtgaattggtacaggcgcgtgtgttgcaattttttgtgattgtcactaattaatttttagttgcagatgtagctatagcttccacctctcaattgcaggagttcctgcctgctcctggtgataatggaggagggtatcgaccactaggtggccttgcaggtaattaatgttgatgccaatggtcaccacattcaacagtattttgtttgagtattgaatttatctaaccatggatgcacaattgcacacgttcaccgtaccattgttttctgtcaattcctaaatttttatatgtaccatgaattcaatccttctatcacacattcatgcaataaaagagagtagttgtgctgtcaagtatgaggtttcatcattatctttcagaggagatgctacagtttccaaataacttttgtttgtcctaccattttcttcctagaatgttataccttttctgcattgaagaaaatgaaaaaatatctataacatcgttgtagtactatgtctttttttaaagaagtcactttactatgtgttacctttctctttttttcattcttgaatgcagatcaaggccttatctactctctgtatactctttggacaatacccttgtgaggaagttgtgcatattgttccaaaatgggtgtttttcttgattctcgatttctctattgcattttcatcctaatcttatattgtcttggtccttatcagagtacaattggcaact

SEQ ID NO: 535 - DNA, 1713 bp, Zea mays
  misc_feature (1)..(100): optimal_loci_81871_G1, chr2:181126011..181127723, Cluster 3
gcagttgacgtgcggccgctgccttgtcaatcggtaacaaaaacaaaaaaacagtaaaattcatttcctgcggacctctgcaaacggatctggcagcactccaccatgcgtccaatcagcccccatgccttaacactccaccacaggacagggcacattaaccccggtcacgttgcgcttgcacacgggacagcgtggcgtggcgtgcgtgctgtcagccgcgataactagccccggtgctgtgatggcatggcagtcaggctaggccagctcgaggcgccggtgtcaacctgacaaaaaaccgtggcccggtcggcgccccgcgtctggtaccgcacacgtcctgattcccctggcatttgcaaatctaaaccgcaaaaagggggcaggaacctcctgcatcttttttacactacatacatgtactacgctcgaataaataaaatcgtggagcattcgatcagatattcaaaattaaatagcaaaatactttgttcttcatgaatctcctctggtcaccatttcttcacacggggtcgtggtttccttgccacggccctaccgccaacccgacagatcgtcaccgctgctgtccatgtcatgcgcggccggtcccaaccacaataaccacacggcaaaacaaaccacccttccagttctgaagtaacctccccatccgccgccagggagcccccccatgggtggcggcttgcagagcgcagaagcagcccgcagcaggcactcaggcagccgggcgctaggcctgctccccgcctcgccggctcgtgcccactgcccatttccgactgcggcgctgcccccgcgcgcgcaacagcctccgctgtgcgcgtgttgggttgttggcaactggcaagcaacgtcagtccaggagaacggccgtgatctgcaccaccgactgccaccgtcccggtggtgcctgtgcctccctcctccggttgttgcatgcgtactggaccagaacattctgagcccgtcctatcctgtcccacgcctcaaacggacacggaggaggtctactacttgctccttgtattgtatattcaagttcctctacaaaaggatacactgtaaatagctcctgagaaccgccccgtgtaccgtaggtgcgcatggtgtgccaccggccgctagcttgtccggccatcacgtcatgcaaaaacaaagcgctcgtaactacagatcgttcgcactgttctttcgatccccacctgtgcgcaccacaaaggcagcacttgccaaacggtgctgccctcctaataacatttgctcatttacttcacccagcgccatcaggaaggggccgcgtccgacggccggggtatgttcatggggatcagtgtcaccgcatgcacctaaaccgcttgtcctctctgccatccaacgaccgcaccatcagggagtaagtggccatcaccggcggcggcggcggcggctgacctctttcgcgcggagcggaggccgggagctaccttctatgtatacccctattatatataaccaatcagttaaaatatcactaagtatacacaacaaattaccactaactaaatcccaccattaaaaccaacactccagaccgcttcattcgcttcatccctcttaatacatcgtatccaacgtcactgttttttttgtcatccctcacccgcctctagcctccctagcctcaccaacgttccagcccccgcgatt

SEQ ID NO: 536 - DNA, 1861 bp, Zea mays
  misc_feature (1)..(100): optimal_loci_82253_G1, chr2:183189649..183191509, Cluster 3
gacctccgcctccacgtatcaaccctcaattcacaaccaacgacgtcgatttgccatgatcttgttatggcaatatgatctaccctctttctcttggattagtatcctgtttcctatttggaagtgtctgtctatgcgtggatgaagttttatatttaaaggtcccatgatttcattatggatagtttgtttcagtttgtcatattaccaccactttagacagtcagaaacgtacggatctagcactgagatagaatagaatcaaaattcctgcactaatgctactccaaagtatagagctcctctcccgacacctataatatatgccctattttggaatcgctacggctccacaaaatttggtgaaaaaggttaataagtgctctacaaaatcgtggagctagagttataaactattaaaaatatttagataagtcgttttatttatcatttagattaaaaagtatttttaaaactatttaaatttacattataaactatagttctacactgtaagctggaatctagaaagaatcgtggagttcgaaacaactacttataaatttaagagaggagcgacctagaggtaaaaaaaaataatgaaaggagctctcaagctactttgctggattcgccaccgtagtccatagacagtggtcctaccggcgatggtgacctgcgtccaagaagatgctctcgagtaactcattggtagtaactccatctggtaacaagcgggataccagatagggttaaagaatggtaaagccgctgcctgctatgcattgtcgtcagtcgtcagatcttatctaaacgtcatccttgacctttgcaggctagctgctcttgctcacacggatgtatgcatgaccaatattattaaattgacacggcacatggctagcggtgcgacgacgtagcgccagaatatagagtgtttaaattaaataccttaaaaacgagtttggatgtagatattcaatactggaatagggaattggaatcaagaattctgaattccgctgtttggctagctaaaaaattcagagctgaaattaaaactcaattctttggaattggactctctcacgattcagagccaagatcgatctaggtattagatggaattgcaattctagatacatccaaacaataaatttgttttgaaacctatttccaacactagatatatttaatattggatctaatttaattccaacagaagtgtaatgcaacgaggaatcgaggatgcaaaatcagtcaaccaggaggagttcgagtaccgcagcaatcatggagccttttgatccatcgccactactgtactgtgcatgctatataagtaccgctcatacgtcgcgtcgatcggcttgtcagccggacccatgcacgtttcgattattgcatgtgtgtgtgtactgcaggagtgcaggtatgtgctgccaacggtttcggtcctcatcgtcaaacagtgtgctactgttactacatgtacacgcacacgctggagcgacagcgatgtgtgatacgtacgaaaccccagatcgtgtccaggtccgtctgtctcgtggtacgaccagatttgattgatgctagggagtggtacccaccagatttctgggcagggcaggcgtaagcgtaacgtaacgtaacgtaacgtaacgtaacgtaacgtgtgtagattagattcgatgattttcgctccagccttcgctagctctggactgtcatcgttgggatgcttactgggcctggatgctactgggcctgggggccctgactgagcccggtggatccagtggtcgtcactcgtcataatcagaataaacaaattacagtgtagatctctctcggtacacgt

SEQ ID NO: 537 - DNA, 1517 bp, Zea mays
  misc_feature (1)..(100): optimal_loci_82404_G1, chr2:183980245..183981761, Cluster 3
cgcgtgtacgattcgtgtggaagaaacgcaggcagaaccgacgacgtttctagcaggataacgagccatgtgtgggaatccgcgtgtaggttgcagaggcagcagaaggagccaggaatggaggacaggacgctggattctctcgtataatgatgaatatcataccatattacgtcagttcgttcggttggagctgaaacgatccatttctttttcgagaaagagctagctctcgcacaaataagtcatttatagttaggcacccaaaatattccatcgcaggtcgtcggttgccgtgacactgcacgcggctgaaacatgcacaagccaacggctctagaagtctagcagagcgtgctgccttcgcggactgatgcacctgcaatacataaacataaaatactgtaaaagtcgcagccgaattaaagccatagcaaaccgcaacgaacaataactctgtattttaaaccataatttcaccaatatcacattatttctaaggtctaaaaaaactttggtctaaatccaagtttttctttagcgcatggttacagtctcgctctttctcctaaggagaaaaaaacaatgtgactataaacatatgttgaattagactgatgcaaaatatattatgattatatatcataatattaggtaaactatggttttagaaaacagtgttttcaaacagtctctggaagggtggaacgtataccttggcaacttttgctgctcttttgtttgaccccctacctcacggttaatttgtctcatcggcggatcatcatgtatggatccctgctcagccatttgggttgcctgtgaaatgtgatgtttccaatctcctcgaatcaaaacacaaggagcttattctctcgtataatgatgttttgtgtcgttgttttcgtctagacagcacaccgagcgaagaaatctcgatcggtgtagggccgggtctccctggcggcagttttaaattcacgtcattttccgtgtgatttccgtgtgatcggatgagatgactgctttcgtgcagctctggcttcgcgcgcgcgagcctgtcccagtaaacacgtagccttccacgcatatccaccgacctaagggcttgtttggaagaaagagtattgaaaaggatccaaagggttataatcccttgctattcaaaattaaataacaagggattatagtcccctcaatcccctccaatactcttgtttccaaacatgccctaaagccgttagctgcacctctgcatacacgcctgtccacctacatctacatgtgggcaactgaacacaatggcggacgcattaccaaaatttatgggaaactaaaaaaccatattataaaatcaaacaaggtggtaaaaactattgttgcataaaattcaagttccatatgtattatacaacatacaagttcgaagaaaaaaattatatgaaaaaagaagtaaacatacaactaagtttttcttgatcgaataaaagtcgtgtgtaaattgtcgaatgtcgatc

SEQ ID NO: 538 - DNA, 2475 bp, Zea mays
  misc_feature (1)..(100): optimal_loci_83175_G1, chr2:188396975..188399449, Cluster 3
gctaaaagacgtcgtcgcccatctaagaacatgggccggtttctagactcgtagaacagatgagtaggtttttttttaacttcatcgtaatcctagccttcacttttaggggagtcgtacatagatctgattcagaaagtaattacagaacatattggttgcttccgctgagagaattgctgaagtctagaacggtacgtacgcagggtggtagattggttggctgccacagaaaaaagacgagggacctccggtgtcaacaaaaccttgacaccactaagattaggccaaaacaacggatggattaaagttgggtcacctggctctgaaagaggtgatgcaaacaaacttgggcacgcacgcatccactttgaattgattaattatcactagggtgtggacgcactagcagtaatgtggatgacgatgtcaatggcaaggcaggccattaataagcaggcggacagtgccgaagtgtggaaccaaactctaacactttatacaagactgttatcgtgagttgtctctacgagaatggcatgctgcatgtatgcattgacagagattcattgcagaactggcctctaatactcgatttcctggttgttgttttttttgttgttgttgttgtcacgctcgtcgctgtgtcccagacgcgacaggtaactaaaatcgactggaggcagcgcagcactagctagaatatactagtaataataatatcaagaaacagagggccccgggaacaacgggataccaacccaactactacgatgctctctgcctctctctaatggtgattagaaaacaaccgccgcgtcgtcggcgtcggcgtcgccatcccgtgtggcgttcgctgtcaagctgacgcggggctgtcagcgtcgcgggggccggacggcgacgcagcctttttgcagttttgcactccggcgcgtgacgccggcgcgcacggcacgacgctttcaggtgtcgcgcaacgaggcgaggcgactcttgttccggccgcctttttcgcgtgggcttggactggttttctccccaattctcgccgccgcgaatgcgaggccttgcgtgctacgcccactaatttatgtttattattattatgcgcgcgttgccctgatttgcctgagtggcacggataatgtacggtgtcaaacacaggtgcacgacgagaaataaagcagactagcggagcatcgttcagaaggtacgctatgtttaaaagagactgaaatgaaaccgatacacccattgaccatcatgctactctattgagctgtttgagagttcttacatacagtgattttaaagccagaatctatcctagataatattttataatgaaatggttctctagaatacacaggtaagagtttttaaaaaacattgtttatcataaatttatttacttctcacgtgaaaccaccttttatctacagttgttagagaaacactcctccgaggaggagctacgctacgcatttcatctctctatactactagacgctcaggcaagatttaggcctcaagaaattagcatgggcctgaacggcccgcccacttccacctcatcccgtgcgctacgtgggccacgtcgcggcggggcacggcggcctcctcgtcccgtaccagccgctctggactctcttgccggctcggctcagaccaatgccgcttgccgccccctactgtccctttcttcctcacctccaccacgcttgccaccctcgcgaagaaactgcagccgcaatcgccgccacgccacgcgcaagcccaggcctcgatggcgtctgcttcgtacgccgcaacgcatgcggctccacccgcacctcgctctccgcctgttcgaccacctgctccgctcgggcgcgccgacccggacctcccggcctacgagctcgctttcgcgtcctgcgcgcgcggaaggggccttggcacgggcgctgcaggttcgtccacgtctacgccgtatgccgatgctccccacgcgcgcagagtgttcgacggcgggacccacaacgacatggtcgcctggcacgcctactatggtagtaaataacatccggatctgcggacattgtcataatgccatacagtaacttctaagcaagatttctgggaggtgcataattgttagggatgaaaatcggtttcgtcatttcagaaaagggtcttgttcttgcggggattactggtaatatttttgatagcaacggtttccttcgttttacttatttgcatacactaaaatgtgtatattatatgagacaactgttattattgtccggagacatgaagctcctgactttattgcacgtctattgaatactatatggcacccttgaaccaacaacatgattgacatctcttgtgtctcatcaacttgaaacctaattattgtccttttcagtcaacatgattcaaaactgcacatgatcctgagatgtatgtcctacgcaaaagtgtcat

SEQ ID NO: 539 - DNA, 1951 bp, Zea mays
  misc_feature (1)..(100): optimal_loci_83701_G1, chr2:191122014..191123964, Cluster 3
taaataaatatcttaataaatatttatatgatacatgaaaaacatagcaaaacgttgaaaaacggtaatccggtagcctagcccgttcctgacagagtgacagataataggaccgacgacgtgccctacactgcaaatttgcagggcatctttctttccgttcgctgttgctgtcgataggagaaacctaaaagggggtttcagtgtcctcctgtgcgtctgcgtgatgcacacatgcatgcatgacgaccacctcgccatgcatgcatatgtacagtggcctgcacacacgctgctgctccggcagcccacatatcctcggtcatcgcacggcgcataactctcgcaacacccttcagttcatccgacgtgccggcgtaccacggccgcacaattattgacgacgtacgcggccgcggccgcggggaccggccgccgtccaccgatcccgccggaccacaccggaagggaagaagacaatcgatcgggtgcgtggcgtggccccatgtcgtcagaggtggtcgtcaggcgacaggcggtgtgtgtgtctgtgggtgggctctgccactgcatgattcgagatccaaagtcgaaacgacgtggacgtgcgatcggatggatgaccggagtcggaggggaggtgcctctgcagagcgcagagcgcagaggctgcgcgcggagacaatcgacaggaacaggatcacctgggggggaaaaggcgagttttgcagctacctgtttctcctttttccccggcatggctagcttgcactgtaggagtactgtaactgtaactgtactgcatgcatgcacgcacgcagaggcactgcatggacagcatggttttggcgcagcgggggacgatcgagatcggtcggccgcgaccgcgattgggatttgcagcgcgggaaagcgaggggtttgtcaggccgctgcctgccatgttccgttccgttccgctgcgagaaatggagcagctagacctagagctgaggctgtggatcctcgaccggccgatccatctctagctcgatcaatggcctccggtcccgactccgatctcgcgtgatcacgcgctggtgcagtgtaggtgagacgcggcaggtagctgcaaataatctgcgggcaaagcaagcctagttacagagctagatgagctcctttctctgatcaggattcagagctagacagaaataacctgtcgattattagagctgcttggattattgcagttaaactttcgtttggctttgcgagtgggagcttgagttcggtttgtttggtcttgagtacagtaaggttgtactacttctacatgcgtgtatgtaagaccaacccaattttttttaaaaaaccactttttatttttttagctaggagaaaccagatctatggtttttaaaaaactgagaatataatttatataaactgagtcataaactggtatgtttagaaccaactcaatttctataaaccagtttattaaaaactggatgcattcaaacatgacctaaattcctctcgaaagaagtagagttcggaagcttttatgagttggtgttccacattccgacggcgagacagagatgttgcgggttcgctttcgttccggtttcatgctttccagcggaaagcgagtgagcgagagaacaggattggactgctctgggcttttcgctccccagccagaccaggccccaatcactctaaagaaaggccaccgagcctgttacctggttgggcccgattacatgacttttaactgcaacactagctagctagtagtacttgccagggaggcttgtcaagcccggctcgaactcgaagcaccaaacagtgctcgtgagtgtttagaaagtattgcttgagaatgaatctctgatctctgtattccattaacataaataatatatacatagtgaacagacggcttcacgcccgcacgtccgtt

SEQ ID NO: 540 - DNA, 1601 bp, Zea mays
  misc_feature (1)..(100): optimal_loci_84721_G1, chr2:197212941..197214541, Cluster 3
cttcatataattgagcaaattctattagttatttatacgcagcatttaagaaatatgttgacatatgaaatagtgagattgaactctattgagagagggtgtttcgttcatccataaaattgaggtggtatttttgaaaataggaacatgaaatcctcattgtgattagcctaaacggcacaaaaactataacggcgattattcttctagagtttgcttggttaattaacaatgcatgtcctaaatgcatccgcccagtcgcgtggtatgcatgctgctgtgcgctgttgctgtgcgggcatcgtctcctcctgacctgagggccagtttgggatccgcgcggaatgcaatgcatcgcatgcatgccatcaggcagcggcagcagcaggtgcgatgaagtgtagtatccgtgccatgtgcgcccgaccgccatcgtcgcgagactgtacgtacgtacgtgcgtgcgcacagcagcgcgcggtcgatgccttttcgtttcacgggctaaaactccactgttccgttccatccatctctgtctctgtctgtctgcacgtacgggcgtacgtacgtacgtactactccagtacgtacgcgagctactaggctagccaagctttctagatgtgtgtagtgtagctgcgccggtgcaggcgtgcagacagccgagtaggtatggtatgggcatgggccgcatatggccgtctggctagccaggggttcacgcgcgcgcgcattgcatgcatgcgcgcagatggatggccagcccagccccggccgtgtgcgcgcctcgggaccaagcatgcgtgcgcacacggcacatcctgccagtgccagtggagtcggcggcaagtccgcccccatcctcgccggccggaagccgcgacaatgttgggcttgggcgcacaagaagaagacaaagcacacatcctgtgcgcgttaggcattaggcattacctgtacgtactgcagcagtgtttgtaaatctacgtacgtcccccgccgccttgcaggagctagctagcaataaaagccggcctgtgaagccctggacacagaagcaacacgggcgacgagacgacgccaagctaggcacctagctacccttattagctccaggcgaagcagggggcacacgcgtacgtggcgttctccagtacagtacagcacgggagggaggggggcggcgagcgaagtggtgaccatttatttgcatacgagtatctcatacccgatccctagccgtggaaaaaaaacgacctttccagtttccactccaggggaacagaaaaggccggcacggcggtgcaccgcttcagcctacagcagcacgagcgtggcagagtagcacacgtacaccctgccttttttttttttgcaattattggtccttcttctctgttcgtcaaccaagttgcgtgaacgtgccagcatagttgtcatgtacttgctgcgcatggcaaaaacggccaacaaaaacggtcgacgacgtgcgtgcgctgttatgttcatcggcacatgtacaggccccgcggggagaggaagcggcggatgccgcagcaacgagagcagagcaaccaaaggaaggtttaccacacgtt

SEQ ID NO: 541 - DNA, 2376 bp, Zea mays
  misc_feature (1)..(100): optimal_loci_84952_G1, chr2:198707027..198709402, Cluster 3
gaactaacatttattctagtgttgtatttaagataggttaattccacatccaattttgagcatgattgacacccataacaaaggatggtgttaaccacaaagaatgatcaggtgctcgatatagaaagaggaagaagaaaaacaaatacaaagacttaaagcaaagatatagctaggatattttattttgccaatcaaaacaatagagtgggtaatcgaatttaggataagtagtggcagtataaagagtggaactcaaagtttaaaattattacttaagtgccactaggtgaattaagtccatgcatgagcattaaacctactgaagtcttgaaactccaacttagacatatttgtgaaaatgtaaactcatatgcataagtttaaaggacatgttggagttagaacatgggcgaaatatagacaaaaaaggttaaagggcgcctctaataatcgtcaaccttaacataggtagacttggagtcagtctgatggttagccttattctcttgtaaaacaagacctctgaatcataagcattgctctcatgatggagtagcccccactgttaggcgcatgagaaacttcaaacagtaccctaatctatagtccaacgaggatcgtcagtctagtatgcctcaatcactttctataggcatcgaatcctagccatcattggttcgatggttatcgaactgtagtcattagactatacgatattatagttgttagagcggcaatgctaactttcaaatgtaaacaattcgggtgtatcatttggtctttacttattcttatcgtctatgtttacttttaggcctcgttcggaagctacgatgttgggcgcccggtcaaggcctgaccggtgggacagtacttgcacgttcctgtcctatgtctttgctgcccggtggggtggatagacgcggttgctatttgggagcatctcagggcatacttctgggacaactgacgttgtcttcttccttagaggcggtggcaagacaggtggtgacgacggcgaccccatgagtgaggggcggtggcagttggatctagaggaggaggcgaggcagagagtggaggctcgggcgctcaacggctagatccaaaggagaaggcgatggtagcgacaagtgagagatgaggtggcaactgcggtgaccgtgtcaggcggtggaggcggaagaagcgtcgggtaggcggtggcgacatcgtgctattgaggacgagagcgagagaagcgagtggagcagaattccgaccttcaggagttagggtttccagacccgtcgatacctactgttaactgggccacgcatacccaggtattgggtttccaaatgtctctgaaaaaacacaagactgaggtaccgggctaaacacgggaaaactgacggttttttgcgcttccaaatgagcccttaggtgaatcgccctggactacttgttcttttgtttttggttgcgggtatagacgtatagtaaggaacgaaatcattgcgtgcctattaacctttggtaccgagtagaatcggttccatagtgttttttgttcatttaaaatttcatgctaccttgttgaaatatatgggcccgaaccagaaattttggtcccgacgtccgttgcaagtttttttcgaaacatttgttcgtttctgtctatacgacatgtcgattctttcacaagatcaacatctagattgtatggaccggtagctgttcatggggtgattggctacgagctgggctggatgaacatgaagcaaggctatccgttcacacaccgcttgattggatggttgtatgttggcgcccacgctcgcacggccatggccggcgagtactacggatttgatcattcgggcagatgcagccaaaccgtcttaaatggattgttttgcacgcgctcatgcggcatgtatttaccatatatgcaactaaacacaagttaagataaagttaacgcatatgtatatggtggcgtaagacaagatagtgcgagcaaccaatcggacagacagtgaatcgatgagagacaaaaaagatgggaccaatcaagggccaaggtaggtgccatggtacaccacgacgacataactttttatttcaaatacttcgattaaatacataaaataaaaatgattctcaaacttggtacgctatgttattcgaatccttaaaacaagatagacacgctctcaaacttagttggccatccaaaacaggatgctgacgtggcatcgccaatttgaagccacttgtgcctctaaacctaacatgttgtgtcatttgggtccccgaatttgatattatgtgtcacctgggtctccaaactttcattattgtgctacaacatggcattgtctccgggct

SEQ ID NO: 542 - DNA, 1609 bp, Zea mays
  misc_feature (1)..(100): optimal_loci_95264_G1, chr3:16654825..16656433, Cluster 3
tgaaatagacaaaattaggatggcaaaccttaggtccagtttttatttctgaagtactttgctgccatgtcaacaacaaaaacaatctgttgctgattgattcacatcctgcaggaaaggaattgtgagccttgtgttggagaagtcggagactgagagtatatggcgactccattggtgtccatgtcaacgtctggagtgttctagagcaactcggggttgtcgcagagctcagggagacttgccaaccttgtcaccacgtaagtttctatctctgcaaatttttctctgcttgaaaatcaacatgttttgatgcgataaacaaagcagactgatagtttcaacatgttggtctgctttggttattcaaaaaaaaacatgtctgctttggttattcaaaaaaagagtgcaggtaagtttgcttcagaccgaattagtgttagctatcagtctactgtttgttaaggttaactgggtcaccatatatatcaccacaatggtgtcttcacattattagtgggaactactacctcacacactacgacaatattgtgtagtttcctgtcagtctaaatttgttcaataaccaacttcaaaacaaaagctgctaagaattctgccagtagggtatgatgccttcattttggaaatgggtaacaatcgagttgaagataactttgcatcacgtttggttttgcaactaattttgttaaataggttaagctgcacctttttctctgttcagtgtacaacacatcgggggaagatgtgattctgctttcatggcaatcagagtcagatttgtattgtggtgggtgcaaaattaaggatatatgtacagcgccttccctccgtactccctcccaaggccgaaggcgcaaaaaaaaaagtggcagcagagatccagatgccacgaggagaggagatcgaccacatcgtccataggatcctgcgtgcatgcatcagccttttgttttttccaatccgcgtcgcgtcggtgccggggggggggggggggggggtctttatggatggatcatgctcgtctagtagtacatgtctgatcgagcgacacgacgccaaaagtgtggtgtggcagatctagaagcagccggatctctacgacaccaacaggccggggtgggggacccgcccccatgtgtgccacactgccagcccccaggcccctttccaatctggcaatcttccatgcattgccttattctctttattaccatacaaaagacacacacacacaccaccggagccggccgatccgccgagcaacaagcagctggggcatcatcagtgtggtagcctggtaggtacggtactctctctctctctccttgtccaagagacgaagaagactgacctgctgtactactgtgctgctgcttctgcacgacaagatacgacgcggcgcctactctttacccgagtttaatagctcgtccagttacagctcctcgtgctactgcttgcttcacaatgtgcgctatcatggggaaacaaaagaggggtaggtgacggtggtgtgtcctcaagcgtgtcatcgaatgcctttttttttctgttggtcctctcgtcttgcaaccgaagcaactct

SEQ ID NO: 543 - DNA, 2424 bp, Zea mays
  misc_feature (1)..(100): optimal_loci_7507_G1, chr1:39334848..39337271, Cluster 4
aatctaccttctcgccgatgatactctctcctgtcattaataatatacatgatgttaccacaagtaagtaaactagtatctaatttagctgtgtgctaacgttgtatctgaatgattggatggagtgtttgctttgttgcgtctatggctctatttcacacaccctggtgttcctcgccgccatgcaccgtgagcataagtggtcgatatcatttgacatgtgtgttaagctacataagtcataaatatccatatacgtgattggccaacaagtagcggatagaaaaatccataggacgagtcggtcgagttgcatggtgttggatagatagatgcggcgaaggttaactagggcagggattattcatcaaaaaatgttgtgatagattttatacatgagtagggagagaattgtgaggggttcgataaaaggagtgagcatactgaatacagacgaaaaaaaatgtcagaaacccatgtattactccgatttgtttatgcaagacatgcatggtcggtgacccaacccgtgttgtttctgatttgaatatgggatgggggtacgagaagaaaatctggggggaacaagaacaagtactggcaggcaggcgcagtatgcaaaagaattgacctagctagcgttaatttcaaaaaaaagtacaacgaccaacagtgctgtagtacaactgaacttaacattttttttgtgatgctcccaaccccggatcaggcaaagaaagaaagaaagaaagggaaaaaaaaggaggagaagccgagcaggcaaattcgcgggccagcaagattccagccgctccgaatcaaacgttgcgttcctgtctgcctcaaggaaaaagccccgtcccgtcaagagctttcttcggcaccagaccactgctcgctcaattcgttccctcccccttttcccaaatcagctcactcggagcggaccggaccggacagggagaaatgctcatcacggagctgtagcagctaggcagctagctagctggattgcctgtcagcgcccccggcgatggacttggtgtcttggtagtaattaattaaagctaatgggtgggtcatgggtgggggcgcatggaggcaggagagacgtcgacacggcggcactgtgccctggcccccaccggacactagccaggccgggcgacgtgaaacgaaatgaagtgatgggtgtgggagtggggtgcgcgtgtccgtgcctgtctacgtgttggaaacccacacgggatcgttcctgttcttcgcccatctttggatgcccggagaacatgccatatatgtccatccaccgtctgctctgctctgctctcacggcatctctcgcactagagtagactggtgggttttcgtgaaggcaaggcatatcccgtttacccaactctcagagctgtctggcgctccaaaggggggtggtggggtagggtgggtgcgactccggcatggtagggacgggcgggcggtgtgtctgatttgatttccgaagtgtgatccaagttggcgatgccctgtcccgtcttgttgagaaggaagcagctagctagaggtggttgggcggcccttcgcagtgcagccattcacgtcggacctgactgacgttgttccgcacgggcacggcggcccctccacgactgtgcgcgcgcgtcccgctttgcctatagcccgtttgaggaattaaagtaaacccccccccacccccccccccaccccccccggctcgcccccggattaactaccgatttgacttcaccaccttcacctcggaccaccacgcgctccgcgacgcatgcgcgactgcagcacggcacgggcgtcagggaccccaatcgcggggccgccgccttgggccattccgagccaaccgttgcctagcggggcgacggcgccacgtacccggcaccgcgacctgccgactaccgtagagggcatgctggcacggggagggggaggggacgcgacgaggggccggggccgggggccggcatagcccaaccgcccccacgtgggagcagtcgcgctcgcaccggacgcagatgaattcgtcagaagagaaaatgcgacccatgcgccacgcaggcagttacctactgatcagactaccgagtcgcacggggcccaagccagcttaaaaactactaatgcacactttatcaaacacaaagtaaagcataaatttaaggtgatgtttgattcacatatttgtaacgtgaacggtaaccgataacattaaaccatgtttgtttaagtccaatcctaatcagataccacactagaaactggtaccgccctattcaaacttgttaccactgataatcaaatgtgaatcattagcgttgctatttacgttatatttcgtaaaccaaacgacacctaaaagtaaatacataacaaatttgatatagatat

SEQ ID NO: 544 - DNA, 2033 bp, Zea mays
  misc_feature (1)..(100): optimal_loci_1079_G1, chr1:5533900..5535932, Cluster 4
tactatatgagtaagctactaactcgtggatcattactccgccagcacttgatccaacaatccaactgcagttagctcaaggatccacgagttgattaaaaatggctgccagaaacccatggtggcttgtgtttcggtgccgtatcggtttccaaccctgatgacgtcagtccgcgcccgccgggcaggccggcaggcactttgggtttggggcccctcgcttctcccgtccagtgccatgtgccaatgccagcgccagccattccccgtcaaatttgtttcggtgcgggtgactcggatgaccccgacgtctccacgccgggcgccgccccgtgacgacagccggtctctcacggcggcaccggcagccgcctgggtcgcttattgcttattgcttctccgccggcacaagcactgggccataccagccattaatgccggtcatggatggatggctgcggtgcgtgaggcgacggacggaccgggagctctcggctctggttccgtgacgcccttggtgttctgttctccttcctgcacgatttcctgatcctgcataagaaaaaggaatccgtcttcctcgcgtccggtacgcttccagtccgggtggtcagaaacagaacagtggagagcccggtgaaactggcctgacctccgcgcgcacgcgtgcggtgcccccggtggccggtggcgacggcgacgggtaggatcgccgtcgccattcgccaatggtggggttaaataaaaacaactccaccgcagctacctgctgctgcggtctttatcatccacgcgagagcccactctcgctgtcgcgccgatacgtggggggtgggatgcacaccagcacacgcacttagccgagcccgagcaggcgtacgcggtgaaacttctctggttggctctggctcgtccaaaatccgcgtcgccggacaaacgctggcgtccggaactgaacggccggcagcagacagacactgatgcgccccgccaccttcgaggctaaaagatgatggagttttcacggaggtttcttcgtcggaaaacggtgcagtgcatgggttccgatgactctctacttcgtactgaccagtgagccagtgaccagtcaccacgagttacctacctacggaagatgccactgttcttgctactactacttttgtactgagaccacccgctccacgcctttcagatcgctgtcattgcactctacccatctgcgacgcgaatgtccccatccatgcagcgtcggattcgatgcgactcgcacatcattttagagggcagctacagctagcgtcgtcgtagcgagtgcaagagcttcgcaggggaaaacagtagtatatacagtaacaacagtatttcgattacaattttttttacaaacctgtgagctctagctaataagggtctgtttatatctattagaactaatataattgctagcgtctaaaattagtagtgacgatctaacaaattaatagactgcctaactaactattatagaaactagacatacaaaagtggatatagatgctaatatgtgctactgctactataataatgtatcaaaccaccgcattagtaggtggatctaaacactccctagtgatagtaagctagatatacagtagctagcactcgttattagctaatggccagctctaacttttggcatcagtagaactaaacataagtctacgcaaaggtaaagatgtaaatcataaatacatattcgaattaattacctcacatagttcgtctggaaaaaaatattcaaaagtgaagagcaacgcgcctttcgaaagccagagtcgcaataccaatgtagcatggtcaaaattagaaatggagatgatggagaccgatagctttgttcagctatttcattataaggttatctctagcaacttaatcatctactaggtacatgcccatgcgtttcaacggaatacacttgtacatatataggtcattgtttagtaatgttatcaagaatcaactcaataatcataacaaatgtcgaagtc

SEQ ID NO: 545 - DNA, 1506 bp, Zea mays
  misc_feature (1)..(100): optimal_loci_115045_G1, chr3:142727508..142729013, Cluster 4
acggtgaatgttgtcgctaatatgcacggtgattgttgtaaaaagattgtgaaacaggaaaaagatggaagagatcgtgaaactggaaaaagatatgggaggagagataaggaaaaagatacgggaggagagataaatagatgcgaagggttacaacgtgtaaacagtggaatggtgggtaatttttctataacttcacgaggaagtataaaaagttgtttttgaagcaccattcgaggagcttcgaaaatttcatgaaattggcctccagtttcaattttttttaatctagagctcgtgaagttggacctgtttggatagaagaatctactataaacctgaaatttttgaaacgaagctctcccaaacaggtcctaagtatagtagagatttatctatcggaaaaaaaatcatatttacatcttcattaacattaagaaaaaaacttttatatcctcgtcccaacagaaaattctccacgggaatcggagatcgggcgatatgatatatccgacacaatactgaagtaggaggtggcggtacgctctctatcaaagaagtccggaaggccagcatgcagtctgggctcaaattacatctgacgcaatggaattgatgtggccgggcttggttggtttccacacggaccggaagatagttttgctccgcggagcactgctgctcatcagcctgctgtttgctagtatagatttgttggggaggaaggaacgttgttcgttagaacaaacgatggagctgtttcatttgcacttgcaccgacgttcgccccattttttctctctctcgatgtcgatgtatatgggatgctgcatggcaccaccaccacgacgcgcgggatcggagaattggtcagcatgcacatcgatcgattagccggggagaatggcagcatgacacgtgggtgtctcgatcgaccaggaaaaagagacaccgagataaatcttattgcgtgctgctgtaaaactcgcatatggccgagccggcccgcagctggtggttagttacgttgatccagtctataaggtgtccttttttttccccatatatatgcagaaaagaaactgacacctgaagaaagttacaacggatgcccagtcatgccggatagggaaattcaaccaaatttcactaccaagtaccaaataggttgaagtatttggaaaccaacgtcattagacaaacaattaagctgaagatggaactgaattaaaagatgtacatatataggacgaacaaagtacagcccaataataaaaccccacaaatcaaagagtcatactagaactcatatcatatcccaatgtttggttgtaccactttaatgataatgctttccatcttccatttttcttcatttccctccctaaggctatctctagctagaagtgtttcttgttctaccttctattttaaactccaccctgcaaacaaatactgtctatagtgcaaaacagtacgaaacattgttatacacggatatatgca

SEQ ID NO: 546 - DNA, 1414 bp, Zea mays
  misc_feature (1)..(100): optimal_loci_117607_G1, chr3:158505659..158507072, Cluster 4
tcttttgtgtcatcacaacgcacgtgcaatacactattgagtctagatccatgggttactagacaatcatctcataagataaaaaaatattatatatttaggtagaaggggcatggtatagtcaacaagttcggtgccacttgattggtcttcgtaatgtattagaattgatgtaccaattttgtcaaatggtggagcatagacaggaacaagaaagccaataataaagaaatgttagatatgttctcggacccgatcaagtgagtgactgagcctggaatggcccacgggctctaattggggtgcatacctcttgtggttatggccttcggtcatagaaactatattaacctaggcttggatcaacacagaagtcaacgctttcgtgctttgctaaaactagcctccacatgctagaaagggcctcatctcctatgtagtgtctagtaacaaaaaatggtccaatcgctccataacacccatagactataatagtccattggccactcatgctctacttaaaggtccaaacacgcaaggggaaggacgaggaggagaaacgagtcaacatagatgcgcacaacttctagagttatctacgatccagactgccaccacgactctccacctcggtatggctttgcatactctctctggtgcataagtcatgagtctataatctattcgtaattaagctagctagcgacatttgatgtcatctgattatgtttttcttaagggctgatttgatgatcatggactctcagagaatttatagagagtaatctccttgttattcaaatttgagtagcaagaggatttatctctatagatcctatcggaatcactgatcactaaatcagccctaaatttgttcagattttggttgcatggagatcgtgggttacgtgccacaacattcagcacgcgtgcattgatcgatgacctcgacgactagtaaacaattccatcatccatcgttatcatcctttaattcataggagaacgtatatacatcatctactttgttctcactcagctcagcctcaggcacgtactcatcctcatccatatgctacatgcacggcgtcaaacactgcacgtccctgtcgagggtatctgacgtgtgcggatttagctcgggcaaacaacaacatgctacgtacttgcttcacgtcttgttcggctgcttgaaaagccgctgcagctgcagatacagtagctgttcggcttccatccggccctgtaggggctgcagatacagtagctgttcggctttcatccgtgggaaaacttagcgtgttgttgccgtagcaggccagccgaacggctgcagcccaccagccgaacggctgggcctttttgattccagccgaagaagccgaagtagaccagccgaacacgctgtcaatta

SEQ ID NO: 547 - DNA, 1532 bp, Zea mays
  misc_feature (1)..(100): optimal_loci_122036_G1, chr3:184608166..184609697, Cluster 4
tcgcaccaaaactgttgaacggtcgcctactctatcatgaaagaatttgcttgagatgtgccgttatttattattcatgagatttcatatttttcatcggtccacttgtcggttctcctgcgaagaagggaagaccacataccattctttcgtgttccctccatccagagtctggaatcaattacatatgcatgcatgcatgcatgtgtctagacttgaggcttcaaatctcaagagtgaccaaacaatccttctgagctgcaccgcggatggtgcagaaacagaaacgcgatggcttcggccgccgtaccaaacaggcaagcagtgaagattaatccggggattggagccgacttcgtcgtttcaaacttggcatcgatcgggttattccggccagtcagcagcaagtcgagcctgttgaccccaagccccccaacacgcccaaggactaggatttggaccttggaccacggtttcccattcgtacttatcttcgccttatcttatcagtcttcgcggacactgaacgccgtgaaagtgagactcgcccacctgtcagaaccggatgcaaaatggatcactgctactgccatcggtctactactacagtgctacacgtcaaataaagaacgccgccacggccggagaggaaccagaggtgcgtgacacacataccactgcgtagaccgaagaagccgccatggacagtgaccttgttctaggaatagtgctggactaccagcaggaggaggcagaggatgctgtcataactcatgcgtccaggtccagccatcgttctcttcgcgagcattccggtccgaagccgagagcccccgttgccacaggaacggttcagcgggctagctagtagtagcgtctgcgtcactgtgaggctccagtggcctggcgccgccgccgctgctagaaaagaacctcttcgctccgagtgcgggcggctgccgatcgacctatgccacatgccagcaccaccacatacggacgtgagcagagagcgacgaccgcacgagacttggtggccacacctccgaaaccggctccttgttcctgtcgcctgccatcggcgacggatgcaaccagacgccagcgggatgctagctagagcgcgcgccaccactgtttccgtcccgctcagggccgtgacttgactgagcctctgacgcacacgcacccagtcgaaccgcgatgccttcgcgcgcctgcgcctccagtaccaggagcgcaaagaaaaaccacgtgcaaagatcggtttcctcggacggcggcgagtggcgccgagccgtggggttggggaccggagggagaggatcggagtgaatccaagcatatgggcgatcgggcgggccgggcgggcgtgcgccacggggacggtgagacggcgacgctcgtgaggtcattgacaccacactgaacggtccggccccggcggtgccaccaccgcacgaaccaactgcccctaaacgcggatggataaatacacgtgttagttgagtaagactttgaccatcttaaac

SEQ ID NO: 548 - DNA, 1607 bp, Zea mays
  misc_feature (1)..(100): optimal_loci_122603_G1, chr3:187428812..187430418, Cluster 4
gaaggaagacacgagaaggctcagatttgtgggactttggaatccggtgagcgatccctacctaccggtatgggcacacgtagcgaaacacatcagcgcgtggggacgacgagatccaaggcgagacacggatgacgaggggcactcaccgagacttacgacgacgtgtaggccgccacgcgcgcgccgtctctggtcggagcgttttgacgaagatctgaccgccacgcacgcgccgccgtccccaatccgagacgtctaaacggcggcacgacggacggaacagagtcttagcgacgacagccacgtccgagtgtcccacgcagcgcgcagatgccaatgtgtggatatcgggaggcgtgtcgcgggcggcaatttccacgagagcatggacagcagtacaggacggtgcgtgctgagacggcccacacacacacattgagcagcatccatacgggcccacacgtcagagcagaccacacgcgtcggcttgcaagaggccgagcgcgcgtgaatcgctcagaagccaccgttaccgtgtatgttttaactagaagtaattcatattaacaagtgaagagcttttttttctaatgcatttttgaattctcaaaatgtcttggttgttcgtcgataaaaaaaagaaatcatatccatcccaaaatgctatgtccatagggtgataatgaatcacgagccaaatatttcttcacaattcgtttaaaacttaagtaatttagtttaaaagtgaatggaaacagagtcgggttctaatggtgagtacaagcttgtttacttaggtctggcgatgagagctccaatcagagagctagtagcgccggttggataatgcggagacgcgacgaggcagggcccatggacaacgtcgccgtatgggcttggtcgaggaatgacatcgataggggccagatggggcgcccggggctgctcggatcgccggccgcacttgacgctgcggcctgcggacagcggtacagtaccgctcgctcgcagtggggcggcgacgacacgcgtaggcgaaaaggacggcgcctcccggctcaccgatgtgccgcccagcgccagcggtggatcagtgaagaaacgaacgtatcagcctggaacgcgtgttccttgctactactagctatcaagtcgaagagcggagcatgcgattccgtcatcggcaatgggcaatcagtgtgcgtctgtgatgagcaggcaggcaggcacgtcaaaatcaaagagtacagcgggcacgcagctacccacggcctagccccaaatgacacccagctggccgcctttttagcagcccaggtgcaatgcatattagagggtatttactggaggagaccaggagagtgagtgcccgatccagttccaactttccagcaccaaccgttgggtctccccgtacgtccccgggaggcggtggcggtggcacgacagcgagtagccacagccgcgcaccggcgacctgggagaccgcaggtaggtccgccgattgatttgacgtcgcgccttaccagagcactcgtgcgccgcactgggctgtgggctggggtagggtccgctggggtcgatcgatggatcaacacggcacg

SEQ ID NO: 549 - DNA, 1627 bp, Zea mays
  misc_feature (1)..(100): optimal_loci_122801_G1, chr3:188665448..188667074, Cluster 4
cagagagagtgctgctacctatgtacatgaaacgagcatatatgttgaaaccaaggtggtacaaagataatatataattattaaaaacagctatatatatatttatatagatgcatcgttataaagattcactgattagatgtggttatagaaaatgtgctatatacatgattgtggctgctcttagaggacgttttacagtcgcttggactgtgggcctacccgagtaccgtggcaacaagcaaagcgtgtcggtagcggctgtttgcccgatcatgcgtgtgcgtacccgccaccactaaattctcacccctacggctacggccccgcccacctccctcgagcctggtcctccagcctccagccttgacaaatccgcgccgagatcggcggttcaacgacctcgccaccaatttaccaacccgtacgtttccgccccacgcgcagcagcggcatgcgccctcggcggtcggcgcgggctgcccccccacacacacacaaaaaaaaggaggcgttatctacatctacatgcatgcatggccattactttatggcgccgcgcagcgccaaacgtggcgtagcggcgggaggacaggagacccagcgaggacgtccccggctccggcagtgtccccacttgcgacgacgcacgcccacgcccacgccccccaccgcgaccgcctggcgtggcccgggccgcggtttctctgcgctcgcctttcccgtagcttccggtgcggtttcctggcgttgcttggatccaaagctacgtactggggccacgcagggggatgaaagccgcacactgcgccacagggagcggggcagggcagagcagagcgcgcgcccttttccgtgtccgcgctgctccgccacgccatcggccgctactccgcccaaccagcagtcgtacgagctagcctattgcatgcgatgggcacgacctgccatcaacgccgatcggtgccccccctccgtgcacgcacgtctcagtcaatgcccccacactccccaccgcaccgcacctcccctccccttcctcacacgtccacatcccgccgcgccattgctttcctccgcacgcccgccgcgctgctgattgattccaattttgccctctgctgtgggttccctccctgccgtagtgccgtccagtaaagaaaatggcacattattggtacacagtgcacagcacaggcaccctcaaaagataggtccaagtagtacttgcgcggtactagtgattttaaaatattttgctaatccgttaattctaaactgtactcgtcgacatatttgatattttattctatttattttttttataaataataaaataaatataatataactaaagtgtatataatacgtaataaaatacataatacttattattattttttaaatagttaaataagatatataaaaaataaaacatcgcatattttagaacaaagggagcatcttcttatgcctgcagctactattgtcattttaaaagaaatccttacatcttgaaaccccagctgccgtttccaaaataatcgtcataattgatgtaaaatgaaattatagattcaccgtaagctaccacacagcttaaaacgttgagattgttattggtgcc

SEQ ID NO: 550 - DNA, 1499 bp, Zea mays
  misc_feature (1)..(100): optimal_loci_122804_G1, chr3:188672619..188674117, Cluster 4
taatccaagacaggtttccttgtgtttatttttgcgtgacaaagttaatagatctactctatgcatggtacaaagagcggcatgtatgatgaacagttttttttatataataagtttatctaataagtcgagttaaatatattgagtcgatagaagaagaaccagccgatccggcaatctcctgtgaatgcgacggacgagcttccagtgctagtacttttcagcacagctactgctcgtacgtacatgctccttcagcctcgtgaggtgaggtcatccaatcctagatggacgagacgcgcgcgggagaggtcaggtcatcggtcatccaagggaaaacagccggacggccgccgagtcgcgcgcgggcgcggcatatcaatcaagatcacatgaggggcgtggacggacggacggacgagcccggcgagcgcgaaaaggggccgcgccgcgggtgggcacccaccaccaaaatgtcggcatcagccggcccgcggacgtgttgcttggatcgcgacgcggggggggggggggggggggggcggggcacccaccaccagccacaggcggccgccggtcctcttttcttatttttcgggccgctggccgtagaccgacagtcagtacagtacagacgcgcgcccaccacggcaggcaccggcacgcgccggttgcccgcgtatcgcgtgatgccgcgccgcttccaccacacgcttgccgcaggcagcggcggcactgccactttcctgatggcccggcgaattgctggacgtacgaccgacccgtgtaccaggcgccgctgccgtccatttatgccttgccttggagaggaccaaggagcacggacggttggctggcacctccttgccgacgcggattttcggaacggtgctaccttaacttcagggagggagtatacaatgttgcacatatatagtcattaacagcactatagtaatactgaagtacgtacagtacagtatattagaccgaacataaaaccattttgaaacggaactacgcttccttagaccaaatttttaatctatctaaacaaattatttacatctatacgttggacatctcaggcctcatttcaatcaaaggataatttaccgaatactgcgttttctatgtgcttttgaattaaatcctatgaaatcactatatcatttctataaaattcctgcgtttttaaaggacttctcaatcttgttttctatggggtgccgtgactcgagcacttgacacatacgagaggagtcaatcaaataatattctttttctctagtcgaggtctttgtttttttctagtgaaatgtcaaaacatggccaaaatctaacaataaataaaagcatatataaattagaattgtcgttgtttctaacctacactccgataagtaaatttgtgtgtgcgcgttctgtggtctagatcatatgttcggtgcgtgcaagatttatattggtttgggaagaacgtccatacatttattctt

SEQ ID NO: 551 - DNA, 1687 bp, Zea mays
  misc_feature (1)..(100): optimal_loci_123251_G1, chr3:190931326..190933012, Cluster 4
gtcaggagtgccctaaggcctcagggtcctcaatttttaggtcgtccttgtggatgacagtggccgaaagaactcttgctttggaggggctcaagatcagtgccctagggatggcatgaccctactttaaccaaagctaaggtaggtttctaaggcatagggccctaaaagcatgagtttggtagtagccgagcatccgatagtttactaggatccttgaaggtgtcatggcagcattcaaaggtatacctttccctaggcactaacaaaggcccctgagtccactgaactgaggtcttataggcaggcccatatttctcacaagatgcctaaacaaaatggattcatcctatgcctagcacttactacgaatctcattgatggggccaccgataggtgacatggaaactaggtccatagggtgagcgagagcgcaaggggagcatgaatcaggatagaaaaagcaacacatcatagtagagtggattcataccatgatttagctattactagggttccatctctaggccttgttgttgtacctgcatagggctagttgttagccatcgttagcttctcattggaagccgaagcgactgtaagagtcacattttgtgtatgctccccttctaatgagttgtgtagtgccttgagcccgcgactcaatccttaagtgagaaaaggtaatataaccagtattttcgttagaaaattaaccataaatataatcggattttaagtagggcatgtttcccaagtaagtatgatgcaaccatcttgtcatgtacgatgagaatcttgcatgcattaaatacggtgactagccattaccctctatgtaattgtcatattgcatgacatgtttgtcatgcgggttgtgtgatgcttcaggttcttcacccaagaatagggagagagggagaaaaggccttaagtatgggtgtgcagttttaccttttctgtttcctcataaagcctgcaaccatttttcctttaccttcttcctctagccatcttctttcgtggtggcaactttccttgtccatccatttgattgccatgtacgcaaccttcaccattgaccagttgtcttgtaggagtgttgaacaaggagggcctagacaaggcacaaaaactcttagtataggctgtgccacctgctttcaataatgtttactcgctttcaaaaactcttagtataggttgtgtggactcctagtgaggagacatgatattatatcactttttattctagcatgatggtagggttgagcttcccactatcatgatttcttcttcgaatccttgacaccatggcctctaggtttggcatctcatgcccaatgctattctctcgctttcaacattcgcatacctatgcaaagtgtttgttgggggtgaggccatgtgtagagatttttgacatttctttgtcctccgagcgtcaagcgaccaaaatccgttcaacaaattctacttctatccactctagactttgatatgggactctatatgtggccatcaacttcaccgagaagtgggagtattggtagacttcatatatctatgccacagtccaataaaatgtgtgccttgagatgctggtaggggagcttgtgctggaccgtgcctggtgagaagatcttatgtagttagacgaggcatgggagctaaccattaggagaat

SEQ ID NO: 552 - DNA, 2086 bp, Zea mays
  misc_feature (1)..(100): optimal_loci_124513_G1, chr3:197954727..197956812, Cluster 4
actggttggagggaaacgcgtcggacgggctcgaccgcgtggaggggctggctcaaggtgtggggctgtgggctgttgtgtgcggtctggttcactgctgctctgagcgctctccgtgctccgttcacaaaaatgcttcaggatggagctccattccctcttttcctaattttgatatgatgtgttctatttcagagaaaggacacaaggtgacaagggtacaaggggagggacgtgaggtgcagaactagaggcttcattttgcatttgttttgatcttgttcgaatgcatgtgaattgagttctaatttgcaactgtacttgtgtggtcgccatgtttgcaattttaaatgcaactttaaattcaaagccatggattaaccaaaaccatgcaatggaaatattttgtctctaaagagatgttggattaaactaatgtaaaatatatcatggttgtgtcatagcatttggtaaactgtagtattataaattgtttccaaacaggccctttatctgttcctgggagccaatcgtcttccccgcggcaatgacatagtggtggggtatgtgagttgggcgtctggttgcaagaaaaacgtgtcacgtacaataactgcaacgacgcgtggctcgtgtgacgtcagctgtgacgagtaaggagtgaccctcggccacgtcctctgctctatccatctcccccgtgtcgttacctttgtcgcccgaattatcaaatctatgttcacacaagaatacggaattacggagtggtcgttttagtgtttgctttgctcttgttattttcaccccaagaaaagctacgtatcgctggattttgtacatagtgttttcagccagccaagcaggtgcggcgagccaactttgtgacgctgctgaatagaacaggaagacgtcgatgtaatctggaggtaatccaagtaattgacctgtgcacaccgcttaacgaagaagtccagaccaagcttgtttgtttatttctccgaaccgatgctgccaaaagacccctgcctcgcgaggcggaggcacgtcgtccagcaaaagagcacgagttggcgcaggcgagggcgcggtcagctagctggtcgttgccggacgccaactcggagctgactggtccacgagacggcaactcgatccatcgccgactcgccgtacgtgttgatcgggcgaggaccggagcccggaccacgactggctggccagcaacagttgattagttgaacttgaatcacgtttcacgtggtggtgggtggaccaggtggtggctgtgccgtggcaggtgtcgggtcggcatttccctgcggggcggggcggagcgagccccgcccgacccgcgcgcgtgaaggctgctgtgggagcggtcgcgctagctgcgtccgcgtagacgtcgagtcagccacccttcctccttgtgcatttttaggcgtacaagttattacatgcaaaaaaaaaggcattgcacaactgtcttatcctattctctgcgtggattccaggtcggacccagccagcgcggcggcgacggccggtctccgtgcgcaaagctgttctttttaggccaaaaagaaacaatagacgacaggcagtcaccgctacttgcacggacatgtactgatatacagacgtcattttagggtgccgttgcagctgatctgcatcttgttccgtcagatggcgatcaggagagtccatgcggctgcctgcctgcctgtccacacaaaagtaagttgcacgccaacttttctaaaaggaggcaagtctctctctttttttaccaaaaaaaacacacacgttctagttcttattttaatcaattttaggttctactccgtttgatttgacttttttaagaccgtaaacttaaaaacaattcaatgagacaactgttgagctcacctgcctggaaggatacaatgtgtactacccaaatgttctcaatttgactcccatcaaattaatcgaagaatatactacatgcgtgtatcccaatgttcccatcactttgactacaatcaaattagttatctcaaactactttaacagtacgaacaacaaagataaaatagat

SEQ ID NO: 553 - DNA, 1840 bp, Zea mays
  misc_feature (1)..(100): optimal_loci_124720_G1, chr3:199108510..199110349, Cluster 4
gtgtaaaccgcccctccctcccttagtttttaccttgccctccatcaccgtacacacaaacttagtccatctccacctctccgatatctcatctcctatctcaatctccagtgtaatctataatgcaaataccgtattttagataggtagttctagacttctagtgcatgtgtaagcatcaaggcaaagccaggttttttttagcatttgcaattttgaagctcatctttcctgttaaataattcacactacaatgtctgcctcccacatgaatagcagcataggtcatccatgctctacggcttgcacatgatcacgttatcggcactcaggaatccatttatagcatcagagactcactttccacaatctaaaagtagcatctgcatagcacaacacgaactgtatgttcacagtacctccaaaagcatcctcatatggatttctcttccacacagtgctccagaaaggaacctggatgcttggtttgattagtacactccattgcttttttggcacattgtgttagtaggtttctgttctcaccagactcactcactcacctagagagagcaccaacttggccaattgtttctccattcaaaatttacttacaaatcagaaatttccctctttcattgaatcaggtgcaccgagagttaggttttggatgaggagatacataacctgtggtcactaaaaacaccaacaaaacgttcataaagcctttgagatgcactgcgcgtagtgagcaggcacagcatgatcttctgcagttcagcaaccaactcaatggaagtcacacttccatattctgaagctatatgcgctagagatcagatgcaagtgagtagccaatgccgttttctggtaataccattttagcaagttaatccaaacatgatacatagaaacgagcactgaagcttaaccgccaggagcgacctttttcgtcctagtactagaaaataaagatcgcgcggtgttagccgtcatgctccctgtagattggtttaattggtgtccctctcgtaccaaccgattccatcctagcgacatcatatcggtagggagcggaagaggacggcgtgggtaccgaccaatcaagagaggagagaacgacacgttgattccccgatagcatcctccctgtccggatgagcgcgccggtgcgatctccccgcgcggcgcgacgtgaatcggagcccagccgcaggtttcgcatcgggggatgccgaacgggtaaggggcgaaaacgatggcgaaaggcgcgcgggaaaaagggcggcgggagctcaaagcgacctaggatgtgctaacatacgtttgtttagcctaattcttttttttttctactgtagatcgatttttttacttagattgagtcatatatatattttatcataatctatatcaacttagaaattttatttatgtactcgatcatataggattgaaccatgtatataaatatcagaaatgctataggtctgtttggttgctgcacggtaatatcctggtccgtacgtgaggagtcatgttctttgtatacaggctagatccatacacatgtttgtgtttggttgtttgtattagtgcatttagatcaaacatagctcgtgtttggttgtctgtatcagaacatgcattagataagattgtataaaaaaatctttaaatattatacaacatgtgtgatctagttttgtttaaaaaatatagaaacacaaatataaaatcagtactgtgattaaatattctaattaagagatatagcaaaaaaaaaaaagctaaaactcttctcattttacgtgctgttgcatgagctcggcctacacga

SEQ ID NO: 554 - DNA, 2671 bp, Zea mays
  misc_feature (1)..(100): optimal_loci_124795_G1, chr3:199644085..199646755, Cluster 4
acggcggcccaactcttgcctgcctgcctgctaccagttccaatcccaacctccgtctcccagctgccgccggtcggccgcccgccacctgctgcatccaatccaatccaatccaaatcgatccgctccatctgcccaactgaatcgatatctgccgccgactggcggatggccgtgctcattggctgcggaacggccagtccgaccggtccggtaaggtcacgctacagagagtacagttgcctgtcggattgggcccgtcgtcggatgaagccgccgccgccaccacttgcctgcgacgctgaacgtttccgcaggagagatcaggagctagctagctagctagttgtaccttttagccgcgtggcgtggactctggactcgagctgcgtcgcgatctgtccatacgttgcttggattggatgatccgttcgctactgagcagcagagggaggagagaggtcgagtccgcgacgtctcttcgtacgtgtcgcgtaggttcggacatgccgtgaaggcagggctcaggaacagaagggggcggctctggctctgactgtgtcgtctgtcgtccgccgccgccgggcgcgggaagctactccgtatctaaggacgactcacttggcatccgaaaaccaccacagcgtgtcggagtacttaggagctcccacgacagtgacgctgaaaatgagagcccatatgctagagccattgcacaggtcatccgacgacatagggctatagctatgccgaacgtttggatgcagtcttgtcacccaaatcccgatcagcgttgtcataaaacgacttgttgtaaccctggattttgcttcgtcactgcacgcgccactccctcgtgagacggcaggtagcaggtgtcccgactccccccccccccccccaggccccaggcatgggttcttcgaggcgcatccatgatctatcgtctatcttttttttcctggcaggatgcgcgcggtgaggcgccgaaacactatccccaggacagcgacgcgcgcgacgcggtcggcggcgatctgtgcgtggacgatcctggccggggttcacatgactggctggacgctggcgcctggcgggcaggccccgcctctccatggcatgctgcccgcgcctggggggaacagctagtccacgcgtggtccacaggcgcgtcgcacatggttttcccggggcgccggtcgctgtcgtcgtatcgcccgcacgattcggccggaacattcttatcctcgtccctcttatcggcgcatgcatggtttaggttatacgaggaccacgcgagcgcggcggtgctgcgtgcctccaactccaagagtcgttttctgtgggtggtggattaattggacgataggtttggaaggggcggtagtgttccacgttccacgcacgagctagattggtcgtcgtcgacctcggtatccagacgtgtttgaatggttcgggaaaggaccaactggactataggaaataaagacctaacaacctttattaaaacatggtttgctactgttagagcaccgagatttgtttagccgaaacgcgacgaagaaccaactggactatataggacgcgtggttcgctgggacaggaaacgggaagacacattgaacagacatggccatatgggtttctcatttctgcgtcggcgcggggcttgcaaaaaataaaaaatgaaaatgaaaccacgtcctgaaacaccgttcgcacgcaaccaagcgggcagcacgcatgttgcgaacacgagggggctgtcgccggttttgttgttcaggcggttcagaccacacaaaaaaaaatgtctcgatattcctcgcgcgcgcgccattggtagtattcaatcaatgcaacattatctatagcatacattttcatgcatgtgcgctttcatggaaaataatctgtagttgtaggtgaagctacgacttaaaatttgagccagcaggcatatatatactcatgctgcttttcaccccctttttttttcttctcttctctactctctcttgcattcagtagaagccaaggatcgaaggaacgaatgaacaacaacaatgtatcgtgcaaataaaaacagagatgcgatcgatgcgcgcgcaaataaccatacacgtgttcaatcacctacttcgggtagggccgatgggtttccacttctgctcttgtattgtattgcccgagacggcattgagagaaagggcaaccaaaaacgtccaggaccaggaccacggcacttgcaagccaagtcgactgtgctgtggcttacggagcacgtaaaaaaatttgcatattgcagccagccagcctctcacagtctcactcacacctgctgtgccgaaacccagcaacagcacgccgcgtgtcctttctcggctccgtcccgctcccgcataaacaagcaacacgatgctggggctggggcgcgtcgtctccacgccaacactcacggcccgcatgtcagccagcccagccccacgtacgcccgacctgacagagacagaagagagatcgacatgcgaacaatcccgcccggtcacattcagcaacaagctagctagtactgtacaagataagatcagaccagctgcagaatctgcgcaaaggcatgtgcgagtggccaacagcctttcgcactcgtccgtatatatctagtgc

SEQ ID NO: 555 - DNA, 1463 bp, Zea mays
  misc_feature (1)..(100): optimal_loci_126156_G1, chr3:206204897..206206359, Cluster 4
aaagtctaataaagcgaattatattttgggacaaaaaaagtacattattcctacatactaaaaaattgaaatcgatcaacaggtgacgatagctcctaataaaactaaaggctttaaatataaagctgaagattcatggatatgcatggaactcatggtaatccaagagatcttgtctagacttgaaccccctcccccaccccaccaccaccacacacacacaacaaagttttgattcacactaaaaattgatcatactagaacatggggctcccacagaatgtgcccaacttaaaaatgttacctaaaatgcacagaagtggaatgcaccaatatatatcagcaacacgagatgaagttcactggagtttactatttgagtgttgtggcaactaaaagagtcatcattcgaagcaagaaatcagtgaactcctaaatttaagttccaaaccttgactatattttttttgtaaaagtaaaaaatgactattgaattcagaacattcctgtaaaagtaaaaaaagatgatgtatcttgggcttggtcattttgtttaattgaaatccacaacatacttcatccatttaagcatatgtcatttttaggatttttttgtgctcaaacctttgtggctttgaccataataaacacatatgtgtgtgtaaattgagcacatctgtgccattgcaattgtagcgatgtctaaaaatgttaaacaacaaacatgatactcaacacaaaacccttaagagcatagtcagttaaacaataaacgtataaacattattaagaacccttagagaatctagttgtgtatttttcagcttgcagtgggttgcagcaagatttgcaatcacccatagcttagtttgataaaaataattgggtccacaggattaactttatatggaacatgagtcgtgttagaagatcactcgtcgagcttacatggatcttggaagaagtttttgggtcaaggaaccccttaacattgttctagatcagcttaaacccactgcctgcattcacgacatacatcatatgtagcatctgcaaattcaaattcaattagaaaggttgttcaaccaaaacaagatgtcacaacacattcattcaaatgcacattgcacatgtacctcagtatagtagtcattgtctactctatgcatacattggacaatctcccttgcagtctttgagaaattctcgaacccctgaaacaacagtgagaaactgagtcgacgacaatctactagaattggcaacatagacatgaaaattgaatgcttcagcccaatcactgggccattagcatactgatgtgcctcttagctgccattgtgcaggtagggaacctctccctgaaggccctctcaaactcctgcacatggtatttggtagtgatccagcacagtgatctgcatgagcttgttcagattaactttgcgagtctctcaatgtac

SEQ ID NO: 556 - DNA, 4213 bp, Zea mays
  misc_feature (1)..(100): optimal_loci_126864_G1, chr3:209659367..209663579, Cluster 4
aaatatattgttattttggtcgactttatttctcgataattatcagacatattaaattgaatatatatcaatgtattttgtgtatgttttttgcaagtaaaattaacacatattatttttatataaaaaatatacaatataaaaggtctatcataatgaccccaaaatcataggaccaaggctcgttactatgttgtagtttcagcatccttagtggtcaccaatttctagatccgccacaaattctatataggcccgtcgatgggcaagtgcgagctatatgcttctgcatagagctaattgctaatagttaaaaacagtgatagtcagaccaaactccctagctaagtagctaataatgtaactaattgcttaggattagctacctagcgaataaactattgttagcttaggtgatttcctctattagggctagcagctaaggatcaatactgatggatggatctagacaaggtctaaaaatgcaagaggtgggtgctgctggcctccatccagtaccgcaatacagaatcacctttacacgtacgtcaagcaagcccttggtaggttgagaagaaattcattcgtttgtttatttaaggcggggacggacgccaccagatggaaagccaaaggccgccaatgtggcaatgtcccaactcgcaagcccgtacgctagctcgagacatattgggccgctggccccagaaaagagagagagcccagggagacgatgtctcgcacatggctgcaactgcaagagctaggggggtgagcccaaccgaagaacatgggggagtcccaaatccaatgtcacagctgcaggccaacggacccacgataccttccttggcaggcagtcacgactcacgcatccttgggcgttgaacggaacgaacgccagcttctaaacacggtgtctggctctggctcctcacgagcgtcacgaggaccagggaagccccgtcggtgtgtgtgaggtacgctcaagtactgcacgcactcgactcaccgacgcatgcttcgtatcgttaagatcaggggaggtacgccacagttggcagcaccgccaatggccgattcgtcctttttgtgatcgcaatctgcaatgagatatagtatatggttggtgttgcgaattaaagctaggagacttggcaacttgcaagccggggttcttctacggtggtcagtgggcagtggcagtggcagtggtggcccggggttcttctacaagctagggagcatctagagccgcggtggtcgtggtcctagcccgagaagctgaattctttcggttcttgaatatttatagttggttcgtttatttttaaaaaagaacggatgggctagttggtatcgtactcgatcggatcatgtgcaacatacccggatcgcgagctagccccgcgagtccgcgacgcaccatctgccgccacgtccaaaaggaaagggcaccgtagggggctaggggcggcgaccgcgcgcacgtgatctcgagtggcggccggcgccccgggcacgcagcgcgtccaccctttccacctcagcgcacaccgacaggtgagtttccatgatccaccccgcgcgcactccacctgcgcccttccgcgtcagtccgcacgtgacaagggtgagtaagcagaacgaaagcgagggaatccagcgattggtcatcatgactcacaggggagaaaggaagaaaagcttgagggggaggggaggagacaggtgagtggataatatggatggcgtatgcgtatgggtccgtcggatgcgggatgcacccgtgtgctcgctcgctgctttgctttctggcccatctcatcgtctactatacactaccacgtcgtcatcacacgccgggggcaaagttggcagcaacaacgccgcgcccgccgcctcctgcctcccgtcccgcgaggcgggcttcgacgctcgacacgacgccatgcatgcatggccccggctgaattgctttggattctgacggtgtctggactccgtgggcaggcgaggggcgagctcgatcgaatcgatcgtctccctcccagcctccctgtccgtccggccgtgaatgatggctgcaggacgcatgtgaggcgcgcgcgacgcgtctgcagatcaagctaggctgttacagataaacacatgtacgtagcataatacactggacacgcagatgtactatatatgctgctaccctgttacagagaaacatgtactatatatgctgctaccctgttacagtaagtaattatcacattcattcaaccgatataatgcacgagcgactgtataatacactggacacgcagcgcacaacgacagaaacatacgttgatgtagaaagtggtcgtacgtccttacttacgtaccgccaacaacggtagcatgttttgcatcaaaaacaacaatagcatgtttcgttgctgatagatgaagagcatgttaattttactcatgctcaccaatttcgttgttgatcaataactcaacaacaacaacacgccgccgcccgttgtgctagcaccacgtgtgtagcgagagaaacaacggcaatgtcttaaacacctgcaattgttggaagagagacgacggtgagatggttacgatgattctctccagcatactaattcttggaatcgggacttttactaattctctcttgtatatgctagtctatgtgtacggtagagttttactaatttcaaaaggctactatagtttttagattattattatggtggcttcttagacatatattcttttatttgaccatatatttaatatactagttgggtagtagactagtaacagtgccatgcatctttcttgtcaacaaagtgctgcgtgtgggggggcgatgctgcgtcagtacttttaaccgtgaagaggagacggtaaaggagtgttgcgtggtactgtgtggatgctgactatttgcatgctttggtggagtaggcacgaccactcccacatcgggccaaaagactcatgcatctcgtgcatgaccccgcgcgcgcgccaaatgtttgtgtgtggatctggcttaagccgagctagctaggcggagaccatcgccagtcgccaccgacaaagaggaatcgtatataggatcatgtaaactcgtgtggctgtgttggatccggcttagggcttgtttgttcgtgccgaaattcacttaaaagttgttccaactgatcaaattaagcttatataaattaaccaagtaattcatctagaaatcgttccaagtgaccattctctagaaaccaaacaagctattaaggattatgggcttgttaattaaaggcaattattctttttctaataaccttgtcacctacggtgtggttgtcatcggtccatcaacatgcatcgactttatgctaaccatgcctttttaccactagtagtggaagtgtatgtgcgacacacgcgtgacaagaaaatattacatacaggatatttagtatctagcactgcaagtagcagagtctgttagttgatcgatagtactaatgttcaatagtattcggaaggtaaccatcatggcagaagttgaatggtagctgatgacagccacaacacgcaccagcaaggttagggtctgcgtgcggaacagggtgaattggctcacgcgggcatggagcatggactcgacgacgtgcagggagtcgtgcttgtcgatctagttgaactcgttctctaggccatcgacgcgcgcccgtggacgccgctgtgctagccaggatcggaaagaagaagaacgtattctgtctcgtagagttcctgcgtttctgccgtacgattccaataaaatactgaatctaatggttatgatgaacaaaagaaaattatatcttttatataatctctactactctataagatacaaaagggggcgttcacaccttcaccatgtcccagccccgcgccccctcatgttgtcaggccgcccccgccgcgcacgttcgagacaacaccgtgattccctcccccagccgccactgtcacctccccgtgatttgtgccctatcctctgatgcagagctccgccaccaacccgaccagcctcgcttcctccctctgcctctccctcccaactctcgccgctgaagcgcgcagctccgccggccccgacgcggctctgccggccaccgcggcgtccctccgcaggctcccacgcgcacctcctcgattgcgcgaa

SEQ ID NO: 557 - DNA, 1421 bp, Zea mays
  misc_feature (1)..(100): optimal_loci_127008_G1, chr3:210526308..210527728, Cluster 4
agagttaaaaaaagaagcagggagaagaaacttggtatgctgtctcgtatggcagaggatttgcagagatgatacgtggcccaagtaaacaagtcaaaggcacccaatcatatatggtcgaccgcacgttgctgacggccgggatcaacgacatgggggcagcgcagtagagcacacaggagcgcgcgcgcacgcgccgctgacgaggcgctgtcggcgatgaagcggacacgctgcggcagcggctactgccctaacaacaacgccgatgatcgacaagcagtataccaccacgcggtgtccgccgcgacgatggacacaagctcgcccgacagagtcgtttttatttagcttcacgcgccgcccaggactcacaccatgacttaaaagctttttccgaaggagggtcgaatttttttttttcaaaggcgggcattaatcatcatttttttacagacggtcgctgcgttcgtttgcagaaatagaaatgagaaacccaagtgaggaacgctcttgtgctgcctcaggcttatttagcgagacggtcggtcttcaaaagtgaactccattgtttttgttttgaggtagagctattatgaggctcgtctctgtaattaaactttttattaagtaaacgtatttttcgagacagaccatctctgtaaataaataagatgtccgtgttctgttttatttaaaaaatatatattttaggaggcggtcgaattttataaccgtttattaatgattattatgatttgtctggcgaaatgatttgtgtagtagtgtcggccgccgatgcctcgtttctgccacatcattcgcggctcccgctccgacaagcagcgtgcatcgtcgccctcgcgtcgcgtcgcgtgtgcggggtctgtttatgcgttgcggtccaatggatctgcacgctgatccgcgcatcttctgaggcttctgattggcctgtctccttccctgtccctgtccgtcctgcgtccgaagggacggacacggactagacgccatccacacgcgacgttcgttcactgaacccatgcatagaactcatgtagggcggactgtgctgccttgcacacatgacagatactagattactagtgcgcatgatgtccggtcgaatgtgattcccgttgtgccacgtagcatgaacgcccacatgggcagccgcagcccccagcagcggcttgtatattaagctcctcttcagctaacttagcatacaagcttaggtttccaacgacaacaacccgtaaatggtcctgtaccttaaatatagcgtttctcttgcacctttttgcttccagcagagaacgctaaatgattatcagctagatgattatcatgatgtgattcgtcactggagacgtcatgataagctcaggttaagtcattcaagccatactaaagag

SEQ ID NO: 558 - DNA, 1908 bp, Zea mays
  misc_feature (1)..(100): optimal_loci_127574_G1, chr3:213394588..213396495, Cluster 4
ccgcagtataataataataataataatggtgctagaataatacgtgcaccgaacaacgaacaagggatggattaatggatataataatttttgcgtttttggttgccgggcagcaggtattggtcgaggcccaggtgggggtgtctggttgcggttgcggttgcggtctgctgcgcattgggaattctgttacaagagacacaccagagctagcctcgaggacgcgctgggacagtgatggctcagactcggagtggatcgtgcctgtgtactactaacctggaaagaaggatcggagcagagtagccttcaggctcatcagtggtagatctacataagccagttgctgtgaggcagtctaataatgtgaacatatgtggttagtctcggtcttatgtgactcatacctttgttttgttaaataatagtgccatccatgttatgcttctttactcatagttttatctgtggttctcgtagctagggaatcgaatgcctacgatgcatacaaatagttttcagtagcagtattcaactcgtacttccccaagagaacatgattctagcgagagagcgagagggagagagagaaaactgaaaaaggggatgccattccaagcacatcagcgatcatcatcaaccgttattttcgtctcaccccccctgctgctggtgctgctgccgcctaacccgaaacatgccgactaggggtcgcggtcgccgttctcgatcgtcaaagaaacccaagctctgggtcgtagtctgtgtggtgggtttcacttgatgatggcctagcttccggtttgcttttcgcactccgatccggattttgcttcagcgctagctactttttttccagctagctagcgcgcgcgcgctcctttcttcagccgatcctcttcacactgtgatagtcagtcaccggggaaaggacgttaacgatgaaggcatgaacgaagccccgtcattcagaaacaagcaacgaatgagagcctaatctgcgggccggcttttacgtgcgattagccgataggcctgcgaacggtgcgcgtacctgataccctccctctggcgtcgacgacgatgagcgctggagcgagagcgacttctcttcaagggctagctagctagagcgctagctccaccaatcaccaatgtcctcaatatgcccaaaataaataacgatcatgagatcatcggatatatactgacgtatccatcatgcaataatgcagcagctatagcgtaggatctaccaacaaaactcaagggaaatccgtgaattctaatgtttttctccctcccttttgcagatccgcatctcaactgatataattaccagcaggacagtgaataattcttggattctaagtaaagctggcgggacactacactactagtagtgcttgtggtttaagtgaagggatcgtcggcaagtgaggttttcaaaaaatgggcgccaaaagccgccaagccagcctgcaactgacagcattggctaacctaactaccactggattcttattgggagagtcttgctacctatacacagatccaagtttctgcgccatgtgtgcgcgcgcatgcatgaattaatgctatccattaacgaatgaatctgcgcgcgttctttttctcgtaatcttttttttgtgagtttgaaaagatagaaataaaatgctgggtgcagttatgcaacggtttcggttttcacatgttggcagtgcaccctatatataatgcatgcacaccccactattgttgcctgccaaattttggctctaccttacacaagttagaaccttttgcgagtagtaattttggctgctgagagtctaaagatgtccgatatatagcgcatgtgtatctagttgtccacgctccctaaaacatctatacacgactata

SEQ ID NO: 559 - DNA, 1432 bp, Zea mays
  misc_feature (1)..(100): optimal_loci_127626_G1, chr3:213595645..213597076, Cluster 4
ctgttccttcagcaggattaagtagtgtatggttttatctgcactacattgctatgtttttggtgtcacatccttcggttgtcattggtttgaaccctcttccctctgcctcccgttccttgtcaaaatcctggtattttcctgaagtttcttcactcttgtcttgtcttatgagaaccagtccatgtgtgtgcgcaataaactcatggtttcgctgggttgtgtacataattttgccaccttatggtccttaatacatatgtacgtgtaccttcattccttgttgattttgtttgctgtttgaaaatgtttttttgaagcggcaaagagtgtgtaccatctgcactgtttcgctccacttatcgttgtgcttgacatgttgcttatcctttctttttcttttttcattaaccgtacctgtattaaatttccaccacagggatttttcggtttgtcggaccataaggggcttgaagggagtaaggtttgtgatcatttgccctcaacccccaagacgaaaggacgaacctaactagccctgaggaatcttaacctttcgattgaggatcgacttcagttcatcggccgtatacggtatagctacgtcaagttagatgggccgaatctccacaaagattttgggggaggggtaggggggctgatttcctgaagtaggctgctgctgtggctgctacggcccactctcacaggctttatttttttagatataaccgctaccctgaatcagggtaccaatcagcaatcaacacttctctagcgtacacactcaggagtccattaacactgatgaaaaccaagattaactcgcatagttactgcagttcaaacatgacatgacagctactctgcccttcgctgtttaaggacgacctcagcgcttagcttcatgggtcatgcttctctcatagtgcagtgcaggcacgcctacgctggcttcctgacgcttgtcagctgcttccttcagctttctcccaagtgcataggcaagaggcggggggggggggggggggggggggcacagcattgccaatctgccggtgcttgttctggatgttgcccgcaaactcatagctgtctggagaggccctgtgaggctgtgaccgagcacattcccggacggtgatgtcctgatcagggtggaagcacatgccattggcttgggggatcagtgagagatgtggggaagttgccttcccagtccagcctcccgtactacagccctttccactgagcctgtgttgggcaggcaccaaggtatcaggtcagccatctgcccatttgacagcttaacctcctcatccggaagaaggtcacaacctgtacaaacagctggtgctgctgctgtaaaactgtgcagccgagcactaccgaacattgcatgatctgaaacacaaatgtccttgcagtatca

SEQ ID NO: 560 - DNA, 3047 bp, Zea mays
  misc_feature (1)..(100): optimal_loci_128078_G1, chr3:215482594..215485640, Cluster 4
acatattatagtctaaaatgcaaaattatattttgcgcaaccatacaattagtgtagatcgatactagcagtttacatatggtaacattcgttgtttatgtaaactctaatccaagagtattgagcgtgagcttatgccgtggcagagtaagcaaggtaacgccgcgcacacgacacatgtacccaatgcaacacgtagatccgacaccacataggcacgttacttgatcacttggaccgtgcgttcgtaggggaaactcggccggtaattgtcgaacttgatcttgtcatcaatcgacgtgatcggcgattgatgagaattgagatccgagtttattgtgacagagtaggaagcctgcaaggcgacgcagtccaaagagaaccactgcacgtagtcttgtctgctaatcaagacattggacgatcgcttgtgttgtgcctgtccaaatcacatggacgattgctctctagaacggagttattttccttatcacgtggactctctgttccggattactcgcaagtgagaagtggtcgactcgacggtgccatctttttccacagagtcgctactcgtaacgatcgcgccgtcgtaaataatgaagaaaaaaaatactacgtacgtacatggactacttccagattgcctccatctccatacctgcactgggtggctatggcctgtttggcactttttttttaaaaaaaaacagcttatgaaatagcatcctctacttattatcgattttagttaattctgacaagcatctaatgctgtaaaagtatcttatttagtataacttctacttaaacccatgaaaaagatgtggaatgagttgtatctacctgtcgatccgtccaaacaggctagacagctagacaaactacaatcttgtgggttgacctgcactgcagcttgagaaggccggaggaaggaaagcttcgatcggtcagagatcctcatcaagcgggtcaacggagcggctaagcactagcaggcaggccttgacctactgaccggtcccacatggagcccccagcgtgggttcccctcgcctattgttcctcgactgattgttctttgaccctcaagcactccctactccaagcaacctattcctcccttctagatgaagacggacgggagaacagaccggcttggaggccaagcagcacgaagcttctgacgtgggagggttgccgtacgtcgccggcctcgatcgagttccttagctttgcggcttctgttgacgggctccagctaagcttcagcggtagcgcaggtgcaaatacaataatattattcttataaaaataacatgtcatatgattttgccagattgaaaagagttcttcataaaatcggttgatgacaatcatactttgattcgttaataattttcgcagaaaatcagattttggacaaagaccgatcgtgactttgctctggaaaagttccaaagtccagtgggcggtgtgctgtgctagctgtgcagtccccctatgtcctggaccagtagaccttccagcttcggggatcctatttctccatggatcatacatggttctcggacgttgatctgctactgatgagatggggtcttagtgaatttccttttacttgtgttgtgacattttcacattagagacgcctatttcttaacatgaaaaaaggaggtatcggatggcattctagattgattagcaccgttgacgcaaaaggcaaaccacatggatgttgctgagagcacgtgatgtagtatgcaggatggtatttatcacaagcatcccagatatgtaacacccctaaatatcattttggataatatagggaaattttatcccgagcttcgaataattatgttttgaaacaggagattaaacaaaaagatccgaatatgaataaaaaaccccttagtaaattatatagaattaattaaatgatctcttaatatagattacacttggaaaatattttctatcaaaacaaaggaatatgaacttttaaatatacctttaatgtgactacacacctaaaataatatcatattgaaataaatgacgtgtgtgtatttcatgttgaaaacattgcctaaataaaataataacaataaataaagtaactaaaaataaatataacttgtatctcatgctggaatttatttttgggcatttatgattgagtttgaaattcaaaacaaatttgaattagtaatttgaaatgatttaaaagaaaaaggaaacacaaacctgaactttggcccgatctaaggaaactggcccatctccgcgcggcccaaccaagcgtgtatcatcactcgtgctcaccgccaggcgggcccacactgtcggccattgtgccgcgcacgcctctacacgagcgccgatcggtgggccacatgcatcagcgaccccttcgcccgacgcgcgctctgtcgcactcaccgagttgtggggcccgctgctcagcccccgtcgcacgcacacacgcatgtgtcacctacacgtgggacctagcactcaagactcttccctcccaaatcgagctcaacagccaacgcaatcccgaggaacctcctccccaaccgaacgcgacccaaccgggctccacgccgagcataaaagcaagccctacgtccgtcccctcctcggccaccccaaaaattgagagcacgtgaaccgagggcgtcgatgagatcatggagcgtcgtgaagaaaacactgccgccgcggaggcaactccgtttcgccagcgcaagcacttcgggaggtggccagaaagctttacagggcgactctgttggtgatcgtggccccggcgcaatgagaagaccaccagaagccctacaatacctcgtcggagttctgaaacagggccgcactgccttgtgtcgtggccgacccttgcaccatcgccattgtctggtgagacctgtctattgttcgccatggtctagtcctctagtggcgcatgacagggtgagggttggagaattggggcgcagtattgtataacgtcggcggtgccccaccgtggcctctgtgca

SEQ ID NO: 561 - DNA, 1821 bp, Zea mays
  misc_feature (1)..(100): optimal_loci_128484_G1, chr3:217557146..217558966, Cluster 4
gaaattctgaatacattggatatctaaatgtgtagcaagagttatatataaaaacgcttaaatatcttgtaatctagaatatttgaagtattagatggaagagagtgctgaacgtgtaatattagctagtatacttacgatatctatgagattgagcgtgtaatgttattttatgataaatttaattatagatatcaacggtaacattgttttttgtataataattaaatctaaaattaattgactgcatccgcgttgttggatggcaattggcacagcagtggaccgacaacctaaccgactccctacgcgagagaggatcacacacatacgcgcgcgccacacgaactagatgccgcgtgtggaagtgattaatgatgacggtcacggatggtggctgctgtcgcgacggtgccgatctgtttttcatgattggacgttggcagctgcacgcatttgattgatcttggtgggcttccagtcttccactgcgtgtgctccgctcattcatgcgtccggtgggggaatcgttgaagacacgtacggacgggatgggagatgtcaccatgtgtgtgtgtgtgtgttgttatccgacaaattcgtgcgagcgacgggctgtgtgcacgtcagatcagatggatcacgctaataacgcctgcgtagcgtctacggaggccaaaggaagcgccgcgccggtaatgatgatgatgactgagatagtcagtccaacgagccgtccaaatcaaatcagagcgctttgcagcacacgccgctgaacaccccaccccactggaccttgtccggacttgtaaccaagcaaacgccgtttcaggagaagcatacacacacacacacaccccattgtcagagcttgcattgcacgagtcatcacttacgcagtatgattaatttggcacacagagtcgtggccttcgacaagatccagatctattgtcaaaagccagcagacaggacgtgtagttggaggagcagatggtgctgcatgcgagttgggtgactgacaagggtgttcgaaacgggttgatgcgaagttgcgaacacaacttttaggatctactacttctttcatcctaaaataaaaccttcatctcacatcttaatgagccaaacaatctctattttatataaatacatactaaaaacactaatgttcatactatttttttaaaaacttcttaaatgtaaattaaagactcgttttagaacgaaagtgcttcactgagaaaacatttcacgaaggcaaaaactttcatactggcaggcaattccgcaagcgttagggctgaaccaaaactcgaaaattcatacaacacgggacccatgagcagcaagagcggacctgcaggttctctacctcccctaagggcatgtacaatttagagatcttggaactatttttataaatgtagttaagagataataagtatagaaagtcgtgaagagataaactattaacgaataattcgcctcttcacttttttcacttagagcaagtataataaggtgatttaggcgggctgtaaacacgccacatcagatttatgatgatgtggaagagagagaaaaaacagagagaagagaaaagttaattgctcactaataaccagtcgaaagcaagttactcacaatccaacacaatttgtaagaagaagagataagtcaaacattaaatatatagcctgcattgttatataactagacttttagttggctacaaggttatacagcccgttgtgggctatattgttaaatttgctcttaaccttctaaagattttttaaaagacgcctcaatcaatta

SEQ ID NO: 562 - DNA, 1901 bp, Zea mays
  misc_feature (1)..(100): optimal_loci_129984_G1, chr3:225335819..225337719, Cluster 4
ctttcaagaattttaagtttattttagcttcttttatcccaacaggtctagctccacaagctctagcttttaaaaaaactaaaataaagatcagtttattgaaattttcgaagcttctcagaggatgcttcacaaacactattttataccttctcatgaagttgcactaaaattatccaccataccattggttacatgacctaccgattcatgtccctttctccaccggctaatcatcaaaggtaattaataactcacacaaattaattgtattatagaagttgtagtgtacgtgcaagccaaacactcttgagtcactccttaccaatctgttgaagctgttttatggtgaagctggaaaatcgaaactataaattttgaagtgaagctctcctaaacagaaccatagccttttaactataatttataatttggaggcttagagttgtagtatcaatgcagtctcttgcatggttacctcttataattaaaaaaccgattcaagggttcagacttgtatgcgcttaattagtttgccatttgtgtggtgtgtgccttttttttatcgcttgcattgcacaaatgacctatcacctatgatgcagacttcttttcacacgagttaatttgtttgaccaaacaaatcccccggccgtagcaacatgcacacgaagagatggtgcgagttcaattttgcattgtgctctcccagtactgagtaactggctagcaatagtagcttacgatttatgtagacgcacaagacatgcagcaggtactgcgactaatttctctggtgcactttgtctacccgaatttgtagaaaagttcaagaatccagtactatgtgttgtcgtgcaagcggaaaaagtgcatgccaggtactgctctgccgatgtgccaagtcagctacgacggcgacgacgttctatcgccagaaggaaaacgtggtcacacaacgaatactacgacgcagcagcagcgcaacaccatatgctaataatggttgcactttttcagcaacgagtcctctctgtatgttcatttttttcccagttgaaaagatggtcattaggccgcagaaggtacttggtggccatagacgcttgtaggttgttcatatgcttttgaagatgatgcatggtctgttaagagtttataacttttggtggcacttatgttgtcgttgtagatctatttctcttacatggcacagtaaacactcatgctgaaatggagaaggcacactagggtacctatttcggccccctcctgtctgccctttgttcttccagttgtcttcactaattaaatctcatttgtttttagtaccactcacctatgcatgtcgtaatatatttactgtcaattgtagcttcataattgaataatctcatggcccacttctttaaatgcgttattttaattgacctaatctgattatgcagagaggcattgaactccttgaagctatctcgtgccacaacaaattaaagctctcagaattgtcccttgcccagaagaatattatgcaagacaaggtctgcctgtcgtccagcccagcatacaataaaataaccacaaatttcactgcatcatcagctgtgctctgaacattattactaccaagtttcttctttgtatttttttttttgataatggattgatttcattaaggttattatgaaatgacccggtctctacaaagtatttgacccataacagacaaccattcagataaacaccaaagctagagaacagaatagactcatagttctagcctattgctaaacttccagccattttttggcaaacacctccattgcaataatctccggtcttgagcatacagcctttagccgcctttggttctcctctgtctgaagggcagcccagttcct

SEQ ID NO: 563 - DNA, 1452 bp, Zea mays
  misc_feature (1)..(100): optimal_loci_130011_G1, chr3:225456020..225457471, Cluster 4
tgcatttccatgggccacccggtgggcttgtggctggtgcctggtggcccatgcacggagacggcgtggggctcgctgggtttgggctttgttcatcggctgatagtgctacctcctttgcattggtacctcgcagccgctttgtactattggccactgctcacaaacatcacatcacatgagtagttagttaggcatgtaaaagagacacttgcttctctgattgatatcacgaaagcaggaaagagaagaactgggggctacgcaaagcaagaagcaagtgacgaacgaacgggatgttgtcaatgtgaagcaggcaggcactgctagctctcgtgtcttgtgatgtgaggtcgtcacctttcagataagatctaccagaaacacacaagccctgtcaggcagtcacacatgtgatgtgaagcacaagacaccaaggccggccgtagttggcacgagagctcgcaaaagccttcagctttctttgcattggttggttggacttggaggcttagcttggagagatgagagatcatgcatgtgcaagcccaaggccgagagagatagaatctgcccctgcgctgtgcagacataaaggaaagcttatgtttccccatgatggatgaggctgagatgctctgtctctctctctctctctcgtctctagctagctgtgtgacgccatggcccctacctgaaaagttgcaacaagggcgtctctctgtctacggcctgtgtgcgcgcgcgccgctcgaccctttttataaaaaggacgcagcctttttttttttgttgcccacccagatgaagtggagatggaggagcgcgtcatggtacagaactacagatacgtacagctgctcagtcattaacaacagatagttaggccggggcagggaattaatgtgcaattgtcagtctttgagatcagaggagcaaattgagagcgccgcccggccggtagtacaaggaaaacccgggcatgttttgcttgctctaatccttttttgtccctatgacaaggttcttttctggttatgagcctcaatgaggtttagctccacccccacccccacgctttctgtctgaccagccgcccctctttttgggtactgtctttatttgaacctgtaaagttaatagatcttatttccgagagactcgatgaattgaagttgcatcagtttgacttagggtagaatcaaattgaagcatatataatttggaacggatagagtagccagctctccattccatgcctaacaaaaccatgtttcttctgactgagcatagagataggtctcccttcagcgtcacgcacacacaaaaaataactgagctgttgcttgcattcgactacaggccctgcacatctcaaggcaaattaagacccagatcaaaacaaaagataaacaaactaatgctacaacaacaacaacaaaataaagatgt

SEQ ID NO: 564 - DNA, 1654 bp, Zea mays
  misc_feature (1)..(100): optimal_loci_132052_G1, chr4:3470633..3472286, Cluster 4
acctcttatcatattctctattaaggctgatttgataaccataaaattagagagggagtccataaggagagaaatcttttgctataatgtttggagtccaacatcctagtagcacggcacggcacagcgcctttggcccaagatgggatggcccacgtggtggggaggcgacatggcccatgagtgtacaagttttgtgtacttcctcccctcccaacttttcgttatttctttttatttttgcaggacctggtttattcttttttgggtccttatgattactaatacactgaatcattacataaatacaacactttaaaattaatattcagaagaagaaaaaaagagtccaaattgctccatccaagtttcatactatctgtccacagataacctcttaaactaatatttggttcaacttagtcctctcaactgaaaggctggacaaaaagcttgcagctcgatatgatgatacctgtattatgatgattttcttgagtgttcgtaataacgtcttatatatactttaaacagtctggtatatatatatatatatgatatgtgatcttacatacatgtaatcatcgttttcagcgcagtctagctagttcggactctgaaacttaatttgaaggccggcgatgaatagatgctgaagcgccaggaaaaagtgaagaccgccgtggccgactacaccggcggcggccatgaaagtcgatgaatatctgcgcactgtccagctcatcgtgctctcgatcggtcgatccttatcgtcggaacctgtcgattcaattccgtcgctgagctgattcagggatgagatgcgatgccgcgcgcgcgcgcggcctgccggcgcagccaaagatggatgtcgatccatccatccgatcgtatcgctgtgatcttcctcccggctccgatgcgatgccagccagctgctgctcttgagcatcgtatcgtcgtcctctttcgatctatcttcatcctgaaaacacatgcatgcatatatgctggtggtggcttccggcctgtagatgattctttgcatcgttttcatctcttcctctcctacgtgtttccatctctctctctcgagagagagagaaacaaaaagagaataatgctgggagctttacctagttcgcatcttctgattcctgacttcttgctgcggatttttgggcgtgcatgcgtacaaacatgtctgtttcgtccacagtttttcagctttgactcctcgccttctcataggccgggcaccgtaccccccaccccacccactgtttctttcaagaggcgattcgttcattgtacggcgatcgacagtgcacctgcagcaggcagctatggtaggtaactcaactggttacaaattctcttgtctccatgcacgatgcatgcatgctgttctccctctcgattcggttcgatccatccggagacaggaggtaatgcagcaggaaggtccaagttccgaatcatcttgtattgctagagtaacgctggatcttatatgtctaccttaagttattaagaaaatagtgaagatgccacaataagctatgatatccactatcctcggtaatcgatggtattcaaatatctcttcacaatttgtttaagcccttaactaattttagttagaaatgaatag

SEQ ID NO: 565 - DNA, 1430 bp, Zea mays
  misc_feature (1)..(100): optimal_loci_132478_G1, chr4:4999251..5000680, Cluster 4
gtatcggactaggtagagcccacctaaatagttgtcgggctaaacagagctcacctaaacaactcttgttggcaagaccacacaaacctacacaactagtaattaatcaatcaaggagctcctacacatactactgagaaaaaacacacaaatcctaagcacactagcactactcaactagcaaagctatacaaaataaagtagagaggtaaataacttaactacacaaattaagtaaatatactaagatacacaagcttattagcacaagagaaaaactaatttattgcacaagtaaagtagttacaagaacaacattaagcactactgccttgcaatttgaccacccagtgccactcaatgcaaccgctcaatgcaacacactagaaatcactctcatgtgctcgggtatgttctcagtcaatcatacataagtatagagccaaggctaagcacaaaactcgagaaacacatcactaaggtgctctcatacctcaaatggttggccacctctcaacttattggaatgagaccattattgttttagtttaagaggacttctaaaatagacttaatatatttgctgcaagaagttattttgaaaaaaaaaatgcaattacaaccgataaacagcatcatggaccatgtggtatttccttagcagttaagcaacaaaggaacatgttttttaccatggtctagccatccacgtgggattattgcgggaacactcaaatctggccagttcggcagttcccagctcgatccccatcactatgatccaaaacctgcagttctgcgtcactgctggtgtagctcagctgtaggccctaccaagtgcagtgtctgactactgaatagtgaccatgtcattttttttcctgcgttcatatctatagctgtttcatgcagaaagaatactatggagaacaaatagatcctctcaagttctagagtagagagagagagactggggctctgggaggggataagcatctggattttggagaatgctgtcaccagatcacaaaggaaacagcctctcctgctaggtgggcctaccccccagcttgtcctgccatctagggaacactggtgagatggttctggtgatattctctggtgcttttgctggtacacatctttcctgttacactattttttttattttatttgagatgttcaggtacaattaatggaaacagtgagtgagtgtcagtacatgcaaaagattaggatgaaggcaacatttgaatggagggatcaaagtagaaatttagggatgaagaacccacaattcaagccaagctgtgtctactgccatgaactgtctgtcagtcactaacagagaatctgcccctgaatgccttgttgtgttttgattttgatttgttgaaacagtatcgccactgtagtcagagcgcaaaggg

SEQ ID NO: 566 - DNA, 1740 bp, Zea mays
  misc_feature (1)..(100): optimal_loci_154805_G1, chr4:145617467..145619206, Cluster 4
attccattaaccaaacagactgttatgttatgacacgattattaataatgtcagcatcagtttgcttataaacgtcgagcgcgcgtgactgagtagacgaggagaaaaccctagagacggagagcacgataccaactaccaagtgtcaagtctcgtcaggttcggggtgttgcccggcatgctcgatgccgtctggccaaaagcgtggcgatcaatcgattagcgcggttagctggacgagttgctcgtgcggttcatgttttcctacgcgccatgctttctgcttatgcatctaattctgtgattttctaaataaacatcaagcggggatagctcagttgggagagcgtcagactgaagatctgaaggtcgcgtgttcgatccacgctcaccgcatttttttaatatattcgttctgtcgttcttcctactcggctactccaccccaattcgatcttacaatgcagaatgcctggcactgtttctcatttgattttgcaagcgagggcaaggttttttaatttagctgctagctgtatcaaacaccgtctggtccgcaggaaccgattattttcctgcttatgaaccgaatggaaccttcgagtactgagttgaaccatacatatggcagggaacagtgattagcttaattatttaagtaccattttttatgagtgcaaaaacccatttaggtctcgtttgtatgatgacgttattatggtctcgatgctttgtttttgatccacagctgcagttacggagacaatagctgctcgggtgaggcagaaactgcagcctgtgcctcgttggagggcagcgagacgcactccaacatcatggcttcacgccatcttgtgaagagcgtcacaggatggcgtacgatcttctgggggacgagctcagctcaggtctccacgccgccgcgaagaccacgaaagagctaggatcttgactgcccgcctgcgtataataacgacgtcgaacaagcgcttgtcccgtgcttcaaaataggtctgccggccatagtagtatcgtggaaccgtgaactggttgccagaacaatggcattggcgtgctgctcctttgatggcctggtattcggaatagactggagtggataatttatcgcaattatatcgtgtatgtcgggcttagagttttttccttcttattctttgtggttattaatggaatccgttgtttctttgttagccatgtgatcatctggaaagaattctgtgttgctggcagcatctgtcgacctggctgaataatccgtgttcgcttcagattaaagactgaactgatgcagcggcaatctatatagacaaaataatatagaagcggcaatcctttaaagttcagcactgcggaaacatgtgcgaatacaatagtacggatttctttctcgtggaatctcaatctcctaatgctgacaacggtgttgctgcgtcaccgatcctgtcgccgcgctcatgattcccagacgactgctgctactgttgttcggtccactgggcgccttttctcagcggcggggggaaatgcatggcatgaacgcaggttttttttttcacaaggctgcgaaactgacggaaacagttgctttacgatttgctgttgtgctgctagaggagaaagaaccatgggcacgagcagggttgcagatttgcggtatggtggtgatgctgatcatgatgccacagctgccctgcccccatgccacagatttgcagtatg

SEQ ID NO: 567 - DNA, 2626 bp, Zea mays
  misc_feature (1)..(100): optimal_loci_157857_G1, chr4:161913489..161916114, Cluster 4
ctgcaaatcaagcttaatttaagatactcatttgtttatgcgctgaaacctctatgattatgttatccacgggagtttatatatgattttattggtgctctatcagctgagatagaggatgcatgcatatgggtcaattccatcggctagctacaccccttgatgtgatgtgacgcgcgcgcctgcctctggcgtgtggcgacaaattatacatgcctttaattccgtccattccatgccatggcctaataattctccttgctgtacgtacagtacagttggtagtgctgttggcattgtatacgcgcggttcatgtttttttgctttgggtaagttctttccctgcttattcattaggtcaagtagaaaacaactcaacaacaacaacaacaacatgtgtgtacgtacgcatgggctataggattattacaacagcagatgccgtgtgaacagttcaagctggcatgcatgtgccaaaggtgacaccgtacctttaattataagagctgctgatgcagtagccgtgcagctaattattaactggtgacgtgcttaataattttggtctacgcgggtgtcgacctcgcctgcagtttgttcaaaacacagggccacaccagtttctttctcctggcgaatgattgcttttgcgctgctttatcaaggtcacaattaatctatctatctatgcatcatgcgtatggcatggccgaacagctagctagctatctccaaatctgcagtttgcattgcacagttcgttacacacatgtgtatataaaaacttcgttgctggtggatgaaatagatcgaataatctgaagtgcgtatatattaataacgacactagctatttctggggatcgatcaggttctagctagtttagacaataatccgcattccaagttcagatttggcatatactactatcttactactacgtacgtgtgcgtacatgcacagacgacggttatagtttagataacctctgcattccataactgggatgttgcccagttaggtcatgccgatgtatatatatatatatgattacgacgacctcaatctcagggaaaaagctcattctttacagactgtctgtgcctcgccggcgtcgctaataataaagcagcgctagctactgatcgagtaatactaatctcgataataatgcatggagacatcaagaaagccagccagcccagaaagtgatcactatagaagctagcagctttgtgatgcggaacaataatcttcggatcggaaaggcgaaactcatatctttctcttctgtgtataagttctgtcgtgttttttttttttctcccggccggcaccagattccgcctcttgaatctgtgccagatgtgcaattggaaatgctttggtttactatggacactaactaaaataatgacaataatatgacatcaccgacgacggataaacattaattaattaattactcctatatttcgcaaacaaaaaaaaaagaaccgcaagctttgtttgatgcgacgacacgagaggcgcattgtgtgtgtgcgttcatatactactgtgcacattggcctctcgggtcgaaggaacaggccagcaaagtgattattactattatcatagtgctagtttcagtactactactactaataataattaactacagcttggccgcgcgctgattgatgagtacgtacggtacagtgaagcaaagcatccgatggccggccggctaatttaaaaccggtggcgggctaataaagacggattaaagtagccattgctcgcatcatgtgcaggttggcgcaggcgattactatattagattagctggggattaagataacccccgagcggcgcgctgtctcttcgccgtgcatgtgctcgtcccccgcgcttgtcgcgttgcatgcgatctcagctccatcgaccgacggcgacgggcgacgggcgacgggcgggctcatcgatcagctccggctctggccgccggccgcctccgcccggcaggcctcgctcgcgcgtcgatgtgatagccagccaggataagcttttctttctcgagggtacgtgtttgactttgacgattatgatagtgtaattatttgattataaatgacccacagccgtaattagctagctagcaggcggcgtccgtccgttgctttatcggatgggactccatcgcgaaaggagatgacatgacgcgctcgcctagctactactagttgtctgccgccgggcatgcagctggtggtcttaatctgcggcgacctaatcggggctagctagctagttgcatgcacgcaataatcagaggccgcatatcatcgatctcgcaacttgctgcgattattagtggtagtgctttggcatttgtctagcagcccatttgcagcctctttcaggggcgtacgtttcataaagtatagtatgctgttaatttgttataagagctttctccgcctcaactgtcaatgttaatgtagcgtcacattgtacaactgtatattgcttgttgaagacttgggcttttatttattgcagactatagtccatatatgtatatatgcacgcataaactgtgtaccgcctaaattaaatcgagggtacctcgggcaccc

SEQ ID NO: 568 - DNA, 1965 bp, Zea mays
  misc_feature (1)..(100): optimal_loci_15895_G1, chr1:88323757..88325721, Cluster 4
gttatagatagaaccatgcatgagctgggcatgagatggttttcatgttggcaaaaaaaaaacaaagttgagattcagatatttaatactcatgactactgcacagctccggtcagcctctggttatcctagaacggagatcaccgaaggaatttcagcaaagggatcaagaggagcgaaaggaaaaaagaaaaaaacagaacaatctttatttcttgacaggttgattattcaagtagcaagtacaaagacacgttaaggcagacccattcatcagctattgaagaggctaacccacagcccaacttctgaaaccagtttcgcatgaatactactccagatctgttgattcttcgtcatgactccaactgtctcatcatcgcatatcctaatcccacatgcactgcctatcgaaatgacaccaaggcgagaggatgaagggcgagctgtatgtgcgaggcctcctccgcctgctgcgctgctagctcttgttgctgctgctcgacgggattttgaagccagaaggaaggcaaacatggcgttttctttcagtaacaatccactccacctggtccatcgtggtggctccgttatcactaatgggccgactcgtgcttcggcctgactttttataataaccttcggcctgtttttgcatgtgaaacaatcctggaaatgggccaatcgaaacaagggaagtgatggctcaagactcacgaggcccattaaccacaggatcagcgatgccgtccgcgcgcttcggccccgctctcccaacttcattcgcctgctgaaagcggcgtccgaaggttccggcggtggcgtgacgccattccgggcatccatccgtctcgccggccgggtcggtcaccgtcgaatgaattgaatcccagcccagtcgacgacgggcaaaaaaccaaaacgcccagtccaacacgccaccgatttcatcaacctcgccgtgcgcccgacggggaaggaaaggaaacataaccgatttacccctggcttggccggccgcgggaacgcgtcgcgtcgcattcgccagttccgcatgcgcaacagcgccggggccccgcgggggacaggataaggttttgttccttgattgctcacatggaccaatgggcctggatagataagctactttatttttcactattatttgcccaggcagcgctgcggcaggtttagcgcagaagtttcacgatcgcgtgctcttgcatgggccactagattaattgtcctgcttaatcaaatccgtcggtcaccaccacttgcccataactttagtctgtgtgtctggttggacttttaaggctgtttctacttctcaaggatcgtggttggccctcgacgtcgatgatggcagctcatccggccttgtcacgtcctagtcatcgttccgtcacgatacggccattcgggggcatgcgtgcgtgatactcgtttttgtgttatatggagttgtttacggactagctactcctgcgatgatcgggcccgcctagacaaaaagggcagccatcgtctcggcgctagcagtagcagcactcacggtcacaggcgagcctctggtctggtgtgatgtgacgcccgggcgctcctgcgccgtcattttggagcgggggctgtggtggggcgcgcatgcctgtcagggccagggtggcccgccggtaccacttgatgagatcggtcaagcagcaatgcaatgcagcggcagtttaaactctctcgattatagttatttaagttgattttgtcttaataactggatttctaaaactgtggtttgctgacctagaatccactctagttttgaacttcgaacatcgatatagatatacatcgtctatcttgtactaatattcgtcatataattttctaaattgacactgatggcttttgttatagttattttttccctgataactaacaaggacaaaaaagtatggatagtggagg

SEQ ID NO: 569 - DNA, 1574 bp, Zea mays
  misc_feature (1)..(100): optimal_loci_159988_G1, chr4:175126299..175127872, Cluster 4
ccacataacgctggaccggttttacaccttgacagtctcgtcccgctggtcgtctatataaggttttgttcggttacatggaataaaatcttatcacggatttaatccggatctaaattgaatgaatccatacctcacactcaatcccataatgagattaaatccatcatttaatttatgttttgcatagtttaattttttttccaaaccattgggttataatccataatagatttaaccgaataaaaaagttagagtagccttagtttattttggaatatatattgtgacataaatttagtttcaaaccgtgttaatccagagttggattgtgtgtgtaaaagaacaagacctgcctggtgctcctgaacgctagtgacttttcagagctagctagcgcgcgatctctttcctccgcgcaaccgcaacgcgtcaacggcgccggccacgtcaacaccgtgtcgtcgtcaacaccgtgtcgtgtccatcgcacgagaaaatcaacctcggccggcgtttcaacagctcgaccgcgccgcgcgcttgtcctctcctcgtggatgccctgggcctggggaaaccgccgggcgggacgccgccgtgtgcgcgtgcagtggccgcgcgcagccatcgcgatgccgtgggcgtgtcccgcccggccaagccgagaagtcagcggcacgcacgggacgacgagacacgggagtgcgggttttccgtttgagaacgcgctcggaccacgaggaaacttggtgcgcgggcggggcggccttggacgggtggccatggccatgccggttgcccggcgcgcgcgcgcggcctgtggttgggactgatggatggattaacaggataagggcggctgttggaacggcgctcatgaccgatgcacgggcagcggcgaaccacgcacgtcagcgaatcggatgcagcgaacgagcaagcgagcgagcgacacgaggggccctccctccgccggacacgttaattagaaaatggatggcacttccatgtgtcgagaccaaacacactttttttccgccagcactcgaatgtgcaggactgtcacaaaggccaggtgtctcctctctcgtggaacggtgtcaacgaacgaacgcgcatcagagcgtcgcacctcagtgtgctgtgcgccgaaaagctcgaccgatctgcactgcactgcactcatccaccactgcatgtcctgcacaccctcccgtggttcctcccaggacaggagacacagcaacgactcgacgcggccggcccgccggtgcgtgcacgcgccgccactgcgttctccgagtccgagcaccagcaggcagcagcgcggcggcttgcagctaggcgctagcccactccgtcgatgcatgcatgcatgcatgattcaggccgggcaaggtggcggcacgctcgtgctcggagttctgattctggacccccggccggacgcgcgccccgggccgggcatgcatatgcatgcacgcgtgacgcgccggtggcggtgctttcccccgcggcccgcccgccgaaatgcttgacgcgctcggcgtccaatgcatcgcctatggccg

SEQ ID NO: 570 - DNA, 2995 bp, Zea mays
  misc_feature (1)..(100): optimal_loci_160307_G1, chr4:177057038..177060032, Cluster 4
attcattcaaccagtggtcgtcacactgcccgtctgtctgtccctcaccctgccctgcaggctgcagtctttctgaccgccccttccggctcagccgctgcatgtgctgctgggcagggtcgccatgccgcagacagcgctacaaagcgagaggcaggcaggcagggggcagtgcgatggggaacgagaacgactcgagaaagaccgccgacgccgtggcccgtgaccgtgctaccccaccttgtgtgagactcctgacgagcgcgagctgcgcctggaaaggcgctgccctgcctgcctgcccgacacgactgcctcctgatgctactgccgcagcgcggctcgctcccatcccaccggccagacgtcgccctggcgagcccggcggaaggcgacgaagaccgcggatcctctgcggtagggggtgtcagctgtggcctgtggtgggcatacaccggcacgcacgtatggccgcgcacggcgcattacgccgcaccaaccagtgtcgcggccggccgttgcgaaccagctgcttagattgcatgtagaatctagatcacggtctttctctacgtgcgtccagagacgatgggacaatgggtgcctcgtggtcctcgggcataggtcctggacatcaaacccgccggagcggccaatggctgaatgccgctgatacggcgagtcatcagacgatgcatgcaccctgctcctggggtgccgacaggcccccacactgacactatcgtcgtccccccctcgctcgtgctcgagctgcgccgcgccaactcatccgccaccgatctctcggttgcattgcattgcattgcatgcgcgttccagtgtttccaaagacgcttgtgaacgcatgtaataaaagtggtttgggtcgctatacgctccccactagcccaacaccagcaggcagcagccaaccaaccaaccaaccacggcatctccatttacaacaaacaggccacaggcacggcagcaagcaaaagtgggagggggtataatgggagcgtctgcgtctcctcctcctccccgacgcgctgtggcagcgtccgtgcatgacaacttgacaagcagcacgcttgcactgcatgcccactggctgacggctgaccggaccagccggagcccggaagcgtagcgtgcagactgcagtgaaaggcatgcatgcgcgctgcaggaggcagcggcagcaagtgaccggtcctgatgcctgatccgtgccagagggggggggggagagggagaggtgactggcagtcacagcctgaccagccagccagcgggcgcggcaggtgcaggtgcaggtgcaggcgtcagcgtctcagcgaggcgaacgctggctgggagcctgctgctgcctgggttaggggaggacgtccggaccgggcgacgacatggggcgcaggcgtgcagtcactgaacgtatgccatgcatcagttctgcgaaacagccaggtgggtaggcctgcgcgccatcgcatctgactgaccgcttctttgactcgtcatggaagggagagagagagagagaaagaggactgctgctgcagaggagagtaggagacgccgcgaggcaaggcaacagccaacagtgacagccaacagtgacagtcatgtttgcgttgccgctccagctgggagtgggacctggggtgatgcggtttctctctactcgcttcccggtcccttcccttgctcgtttccattccatttcatctggcgtagcgtagcaagcagagcccagaccagacagagggaagggaaaccgaggtcaaaatgaggtagctgcagggtttggagccgcacgtactcacggtggatgtggatcctgttcgcggttggctagttgctctctctctctctctctgggtgttttcgttggccgtagcaggaatgggtaacgactagtagtggcccttttcgcctgcatgcatgatgcatgccgggcatgcttgaatcatgtgcttccaagtttcatctgaagagagagagagagagagagagaaacgtgggcttctaagaacagttccaaagcctcatacctgtgattacgcagtggatcgctagcggcgtgcatgcctttgcctgccctcatctgtcacggccaaaagaacgccctcctactctcctagtggcctcccttccctgttccctccagctccacgctgcccgctgaggcgcatgtgtgcattggacaacgcattattttttacgtattgtggatgccagtcttatttctattatgttcagccaaaaaaaatttctctctaaaaaactaacccgtcaaaacgtgagatataccactaacatgcatcatttattatgtttactttaaattctctgtaaaacgaccctacgatttatttattttttggacggaggggggcagcacagtaagtatatatctctgttttcccttggctgacgggtcaaggcacatcatcattgtattggcagagtttcgctatgtggtgctgtctatctgtctgtctgtctgagccaatgcatgatgatcgctcgcacggcctcgccgggacagcggtcggattatctcatctgagccctaaaagtggcccacggttgcaggcccgtcgttggtgtcagtgagagcagacgagcatcgcgttgcccttgccgcccctggcccccttttctgccaactttgaccagtccccgtacgggttgtgatttgtgaagcctccccctctatgcaaaaaagagatagagacgtatcgttgaagttttttatgtttaatcagatttataaaaacattaatggtgttacatttgtaactaaattcaatacagtatatagttagggatttaatgtctttcttctcattacaaaaactgagggagcattaaaacacccaaccatgccgtgcgggtgcgggaggggaaaaaaaaggctcaatgatgatgctaaaaccgctcgctgtcggtagaacgtgaaccttttctcctgtaataattaatgtcgtgc

SEQ ID NO: 571 - DNA, 1972 bp, Zea mays
  misc_feature (1)..(100): optimal_loci_160718_G1, chr4:179628988..179630959, Cluster 4
tggatcgcagttatatatgtatgcttcatttgaaaagaaaagaaaagaaaaaaaaagaagtgcgtggaagttatgttcccgaatccactttaattaaacatttttcctttattggttgattgacagtacgatcatttcataattcttaattcatacctgagagaactgtctattgcagaatgtccgttccaaatgtactgtttccttttatatgcattagagagagaaaaaatataatcatataaattgctaaaggcaagtagtatatatagcacatgctttaatcatgttctgcaacgaggcaaaaataccttctgtgaacccagaccgagtctgtgcctcccggggcactggtcgagcgagcctgcaacttgcgagccacatgatcattgatcaatcgaaggagccagccagaagaaggcacgcacggcgcattcccagcgatctgcgtctgctcagtggctggagtagcctaccatgattccgttatcggctcgatggaagcgcatgatgatgaggatgagcccgtcgtcctcgtcctcgtcgtcctccacagttcgtggacctcgcatcgcattgccggcaccggcaggcaaggggagtgcctccgtgggcgtggctgggctgggctggacctggacctcctcattcggcgctcccatgcctgcttcctaccacctgcatgaattcgcttgtcgcccctaccaaagccaatcgagcgctgcacatctacttgtcgccctggatctcgatcggtcgcccccgcctgcccagcagcagctcgatcatgctgctcccactcctcgttggcacgcaccgcttggccagcagttggcccccccccctactgcgctgctttgacagcaccttcagagatgggttcggagactcagcgctgaaaccacccgcgtagtccgtactccgtagtgtaacactaacacctgacctgctgctgcctctgcctgcagtgcactgcactgcagtcagtccatggaaaatgggcatgatctgcatcatcagatgagaccaactaggtgagtggtggtgacttcagttcggtgttgacactacactgctgtgccgtctctctccccctgtagcggacggcttgtctaaacagtgaatttgttgctgcctgctggtgaccacaaccacaccacgccattggcaggtccgccggccggcccggtacacatgaagccaactgaattcaatggtgtgttcggccggcgtacgcacgggccgtcgggccccccggcatcctcctgccggtgcagtacaaacccctgccatgcgtcacaagcgctcggcgtcgctgacggcgtgccctcggaatcctgtcagttctcgtttcacggattcatctcagaagagcgtgttacttctggtaacactttctcgcgactaacacagggaagagcgcagcgcaggcgtgccaacgcatctatcaattaggggaaaagacagatctggagctgttcggagcgaggaggcagggcgtccggcccggtcggcgacaacgccggcgcaggcaccaccaccgtaccgtacccacctcaaaatcccatggaagagctcagctcagttcgttttcaactgcgcgccgtacgtgtctacgtgacgggataacgtgcacgcgggcggatccggagaggccgccgcgatctgatctgccgtgtgctgcctccttcgaaatctggattccgcgccgcggattcgcgggtttctgcgagcgaaacggcagtgccactgctctgtgcgcgggaaagcgggcacgcacgcacgagggactccagactcactccactcatctctaattcgcgcctcggtggaccaggtttcgcttctagcttcaccttcaccccgctgcaatactattatataccacctctaattctctatgaatgcatccaaaaggataggccggtagatgttggaattaatgaagttgacatagctgttttgctaacta

SEQ ID NO: 572 - DNA, 1528 bp, Zea mays
  misc_feature (1)..(100): optimal_loci_160953_G1, chr4:181061694..181063221, Cluster 4
cggaagggaaggggaggaggggacgggaaaatcgtccgcgcggcgcacgcgtggttgcggccgggaagccacgccttggcgagagtgcgccggcgggggacgctgcgtttccggcaagcgaaccgaaccgctttcgtcggccacgcctttgatggatagatatagatagaataggcaccacgcactagaaaactgcgtcatcgtctcatcagacccatacccttgcgtgctgcgacgccgatatgcttgttaattctggatgagctaatcgagctctgcaatttattagaaacgggtggccaccggagctcccaacaactgcagccgttgttggcaaagcttcagctagctcttggcgcatccaactttactgtgcgctataacggtgacatcaatcgccttgtgacttgagaggccagcgaaacaccggcagcttgaatgcaatcaaacagttgggcgtcgcatcagtgatcaggcggtggtgatttggggcgaggtgtgcaagtgggtgggccggggcggcaggtggggagcggatgagaccagaaatggataggaatagatgatttgtactactcctttcccatccacgcaccgcaaccgcaactggtggaggcatggaccctggagtgtctggatggaggagcgccggccctcgatcgcatgaagaagcagaagggacgtactccagtatgctttttggttgctcgtgcttcaagttcacggaagccaatacgtagtgatgtggctttttggcattgcaagtcaaaaaggcccatcccagtcgcgcactcgatcgatacgggtaaagtggacgctggctgtgcagtgctgcccgtgatcgccgccgacgcaatcaatataaagcggcttcttctgttaaaaaaaaaaagacatttgcattgtgttctattaccatctatctactcgagacgttcgaatggctccgtccgctgatgtggtctcgtcactggattgtttgccgtctccagaatggagtggttctcttctcgtatagcgagtgagactccgatcaggcatatctggcaggtgcctgtgtcgccgactcgccgtccgagcgcagcgcacccgtctcatcttttctgacggggtgcctgccatcgccgtcctggagtggatgcacaaagagcacgccaccaacctcacccccgtaggacaccacaccacgaccacagtttgtgtggaggtaggtggtggacatgcactcctgtctgcctctcgttcaaacttcgttccagggaccacagtctctccccggtgtcctttgttcaaacatccgcgcggcgggaactcatgtgccaccctgctgcttcatgagagggaccgaaaaccgcagctgctccctgctcgttacaggtagggataaaaacggaaaacggtaattttcggataccggaattcgttttcgaagttttaccgaaatttagacttaaacggaaacgaaaacggttaacgaaaatacggaaacagaatcgatagaaaaactcggaatcgtaactggagtaac

SEQ ID NO: 573 - DNA, 3473 bp, Zea mays
  misc_feature (1)..(100): optimal_loci_168286_G1, chr4:219987223..219990695, Cluster 4
gtgcgctagctgtaacaccttaggtgtttacctcaagctaagcagcaagtttggacctatgaaattatgtccatacgaatcattatatccatatcatatttgtctccatctattaagagtattcaaaagatttcacgaagtttgaaccaaataatcgcatgaaatgacaaatcatatgcttgtttaaaacttctcgattaaataaatgtgaatttagaagttcaaccaagctttgacatgttacccaaacaactctatatgaactctacaccaaaagttattaagggtccatgttgagcaaatgccaagaaaataccacttttggcctaaaacatccatattgaacttgataacaacactactttgaccaaactcgaattttagtttctaagcacaatatgaggtttgacctttaatccaatttgcagaacaagttataaacaacaaatgttatatttaaaccaagtcatgattcaatctctaaatgtctgaaacagtgccctcaagttggaccaaaaaactgattttaggattaaaaatcttctaagtctgaaaacaatgtcgatcggatcaacttctggcattctctaagttttgttaagcaactcgagttggaccaactataaaatttgttagtaactattagaggcacaacataccaaaagttggtatcaatcgaaccccacttgacatattttgacaaccagattccattgaatttttaaacatccacaaacctattttcgtgagtcaataactctctaaccaacactcaaattatcctaagacctgtgtgagatttgtagaatatagagcaaggaaaatatcgtctatactaactgagatgcaaatccaaataaaaaatgccatttttgctacccaaagtagcaacttcaacgtccgccatgtgtttgcttgtttgcctcaatgaggaacacttgggcaacgtgcccaactcagtagccactttaaatcttctagtcgtactcctttatcccccatgccatctcctccactggtcgatggcctcagccccatggtcgtagctagctgttcccccatgagcctctgctcctcacctcccaagcgaccatgtcggtgcctaggcgtccctcctgccacctcccagcgcccctacctaatgtgtggccatccagatcgcggttgtcgcgctcctggcctctgatcccgaccaccgccctcatctagggtttatgctgcagtgacgccgtgtgccctctccctccagtcgcgctcggccatcgtcctggacgtgtgcctcctcaccgtcgtcggccgtcgttcaccgcaccatcgtctggccatgtctcctctttgacggttgcgccactcctcggtcctgctggctgcacctccgggccctagcaccagtgcacgcgctcccccagggcatattcctggccgcacccttcttccatggataccggtctacagctccgagtcgcacctccctcgccaaccttgccctgctcaacctcagcaaccatcattctgttgcgccctcgctctgtcatcaatgcatgctaggctgtgtgccatcgcctccaacctagtcgtgtcggccgacttcaccctctccgtcgtcttcttgatttggatagcaagcactgtcatcgtccagcctcttcctcaaccctcccttgatgatccttcgcctctgcgtgccctcgacgctttgtcccaggttttgtgcaaacccaaccacgtcgttgtattcgtgtttggaccactccggtgccaacgtcatatacctcctagtcgtcggcgtcgcgttcacgtcatgcttctcccatctatcgtcgatgacttcacccttgcgtgtgcgtgccttcgctctctatcctaatgccatgcgcgctagagctttcccccatgtaccgtgactgctgctgtgctgccccgtctcgtgctcactattccacgccttgacgctcgtgctcaatgccactgcatgcactgttctgccaagtgtcgtggacgcgcatcaagtgctcgatgaaatacccatgccaaaaataatcatcgatctcatgtcgccatgctccctttgagcctgtgaattggtcgatgatgtgcatgcgagtgtggatcgaagatttcaatggagaagaaagcaagtgaaaaagggtgagatgttttttgatgttttttcggctcttgttaggtgttatattgtgatgtgtatgaagtgttgacgaaatttctcatttgcacgcaatggcgtgaactcgtatgtgattcggagaaacgggcgcgttgtgtttgtttgatgtgatgagtaggtttgaaaatgtcagttatgtaaaggataaattgatggatgtgtgtgcgccatagtgtattgtgttagtgctgtgatagataagtgtagcatttcaaatgaagtagccgataggttttgtatgtgtcacttgcgatgaattgttactatggtgaagttttatttggattgcgagtcatgtggggtgtggcgaaattagtggtgcaaaggataagtttagtattttaaacggttagtggacaggttcggtcaatatggttaaaattgattttgcttatgtggtgaagtgatgatatgtcgtagtagtcatctcgtcatctgattattgacttggctgatggtcgtgagaaatgattattgctactgttttcctttggaattttagaaattcataatgaaagatgcgcataagtgctagtcttgggtgtacaagtttgtagtctcgtggagctctagaatatttggttagaatctactcgttggtttgaacgaaatgtgatgttttatttagttggcgtgctacacaaattaacctagaaaagtggtttagaaaagctaaataacttacttctatctatatttgaattctagcgtccaataatggtgggtttagtttgtggtcttctagtgtcgtgctttagctaccaaaatgtacgaccgcatattgtttagtgttttcttgcatattaactaaatcgtgtaagtaggaaaaatgtaactattgtgcttgctttttgctgccactctttgctcatgtccagagaacaacctttctgccttggcctccttaattaggaggaggctgtagagtacatcatcctctaccctcacctcgtggtcaaagtttaatttgaactttctcgttttctctactgtattttttaaaattatagtgtctagcttgggcaccttacacctaatattctcccatccacattcgtctatctctgtgatgcctttgttagggcaaggccatgaatgaccccattctaccatttttggtgcgaacgtcaagtgacaacaacccctttaggaaggtttatttctagctccacactaggctctggtgctaatcctcatacatttccacagatctattagggatatggaagccttgaaggacattttggatgtacatctcggtgtgctagagcacatatctcattgaaac

SEQ ID NO: 574 - DNA, 1801 bp, Zea mays
  misc_feature (1)..(100): optimal_loci_171379_G1, chr4:235327728..235329528, Cluster 4
agtaaattatttttctctctcttgtacttgtaagcttgttaatgtttgagatctagcatgacacctttgttgtttatgtaagatatttataagttgtatcaataaatattgaggtacagtattgatgggatatatataaaccatggtaatacacggacatgactagccactccaaaaaaatcttacattttagtacgtgctattttttttggagctactcgagaggctcttcctcacgcatcggcgtcacgttactttgttgccgaaaagaccagaggttcctgttggtacagagctgtggctcacatcaaactttgtagtgaggtcagggtccagtaatgaaaagaacgctccgccatttgcacaccgctgacaaacatgtcgccatgtctgtccctcgcgaccagccatcacatgcatgaacaaggacagaaccacagaacgcaaagcaaaataaacatggggaattagagctgatttttttatgtgcgttttcttctctctctctctctctacaacgcgtagtaggagtaaaggtgcaccgtgcacacacatgcatagcacacacactgtcacaccagcaccatgcatttcctagccaaattaaactgacagtagtataagccccagaggcccacacagacactgcctagtcatcatcatctaccgcgcggcgggcgtgggcgtgggcgtgggcgtgcggcgcgacgacccgaagtgccagaaggacggcgtccaggtccagaacggcggcgagcggttccggcgctccggcgcgctgggcggcccggcgtccaggcccagcatgccccacatcacctcgacgtcgtggtacccgcaggtctgcacgtccctgtggaggtccacgatccctgctcgctctgcatcgcagccgacgagccaagacgcggcccgttgcaacgggggaacagttagtgttatactccgcgtagatagcaaactggtggtacaaacagtctgtcttcagaccacgtcacgatgcgcatcactgttcatcatgtggatcggagtcggagatgtggaggtgtgattattggaacttttgttgctacggacggcagtacaggagaatgccggccatatgcctcttgtatgccagtgtaaaaggatgttgacacaattattaaaaaaaacagagagattagagataatttggctaataagccaggtcaatctgtatccaaacaggccgttgaaagcaaagggtgtaggagcacaaggcggcgtggtagtgtccgcccctgtgaatttcctcccaatcgtgaacctagctgtcgacacgatctgtgtgcctctggggttcatcagattactgtaactgagaagctagctagatcatatacttggagtctatgcagcattggaaatccctgtacaaagtaaacggatgcttaccggtgcggcggcgcacgcgcgcggcgacgacggccgccgggcacggctccctagccgcgccgtggctccggactagggctgagcttgctagtagggtgttgaacgaaccaccgtacgtgccctctctcgcgctgctctccccgcttctcaccgactgctaatgccaaagtagtaatggggcatcggatcctgaccctgtggtagtagtggtggtggtggtgtgtgcgggtgtagcggccgggcgtttaaaactcgcacggctccaatcaatgccgctgtcgcctcttcgtttcgcgcaaaatacgcacgcacgcacgcgctaccagccggggctgcggttcgttggcgagcgatttgatgcgatcccggccaggtcggcgtgcac

SEQ ID NO: 575 - DNA, 1938 bp, Zea mays
  misc_feature (1)..(100): optimal_loci_172938_G1, chr5:3208227..3210164, Cluster 4
ggagctcacgggttccgcgagggcggatggtttgggaagaaaaaaaaagatcgggcgatcgtcacggcggtcgctgtgcttgcgatgggacgggatttatggaagaaaatgagaccgccgcgtatttatttcatgtatatcaagtcattagcaacgcaattttgagacgatttaataaacaaatatatatacagtttgttgtctttttttttgagtcgtctaaggtaactcatattttttttttcaaaaagaaatacatataaaataagaagaatctatgggttactatgtaagataacatacttgctcaaggtatagagtttgtttcaattgttcacttcaattttgtcacaaggcttgcttctttattcttgacgaaatctacagaaaagtccaccgatatctatagcatcattagatcgttactagtttcacctttttctgtgacatatgctttgaaaagattttttttggggagagggagtaggtgacgatatattccattgtagctagtttggaaaccatgaaaatgagattttagtctttttattctgattttgtggatctcaaattagcccctcaataatatggtggttgcagatcgtgaggaaaaaaaaaaggggcggaggggattattcatatcataaacattgcacgtacggtacgggaactcgggaagaggtggttgtgggcgtgaggctcctcgatgggccgatgatcccggcctgggcgcaaaatcaaactgggaatcaaactgggaggccagtttgcaggacttaggctcattaggatatctccatcagtctctatattatcatttctattttactctttattttaaactatattctataacagtatatctatagtacaaaacaaggtgtaaatgtagaatttcccatagggtttccacaacccatactcatcctcgtaaagcgatatccatactcatccacatacccatatccatcatgagtataagatttataccatacacatccctatttatatatcaggtctccaatggatcccatcccctacaagaaaatattattacattatattttatatgacattaacagccacaaaacacccaacaaaaatacatcaccaataaatttaacatgtaacaagaaaaacaatgtttaaccatacaaaacaacaaaaacaaagtgacacatggactggtgggcgggacgaccgatggttgacctcctaggttgggtggatgggtgtttaaaagggttgggagatgtagtgttagttgttgcgcttattgtctattaggctttctcgttacatcttggccagtaatcagccttgtagtttttggccacgttgttgcctgcagtctagcgaagagtggacatatattgtcggtgaaattgaaagccttaaaggtgtcgctttgtggggtctgcctaacttcgtcaaaactgctcattctcatatggccatgtgaagggtgtgttgagtcttgggcatgcaggtgttggatttcttgcttgagggcttgaaggtgttctttctcttgcttaataggcgacacaccctggtttgagcctcgctgcgcggttgcttggccgcgagggcatctcttttcttctgaagtttggagttgcgcgtgcgaaggcttttgagcagcatttggtcctcagaattgatgccgaggtctgggttggcctgtaagtcttcctcgtcattttccgatggcatcccgaatgggtggcgagggcctcccatggcggcgaagcctggtgtcgggagcaggttccttgtcatgtctggctttttgggttgggcagagggtctcttgagtcctctgagctagtggtatggacttcgcttgcttgctcgttggagaatgttgtctgcttttgttttgcgaggaggtcctcgccctgtgggtcggtagtggccttcgggctaggtggtggg

SEQ ID NO: 576 - DNA, 2325 bp, Zea mays
  misc_feature (1)..(100): optimal_loci_174086_G1, chr5:10209042..10211366, Cluster 4
tcgaccaattacctgcagtttgatcgatgcgtattgtcaaggtaagttgttgatcaaatctaaattgaccatgctacacaccactaacttttccaaacgggtcgacgaaaagtgcgacctagccaacctcagatccgccaactctacgttaaaggttagtcgcaacaggccctagccaaatatcagtctctccacataagctaaaacaatttcaccatatatcttgcgctatcaagaatcaacggtggattagaagtggtgattgaagtgacatatgagatttacactaccctatataattaggcatgcacgacccactgaattcaaatactaaggagggtgtttgtttgggattataatccgtctagattaggcggattataatcccaaacaaacactccctaatcatggaatccaatatttgcgtgtggttgaacataatcactatttctagttatccagtgcagataatgaagtgaagctataacagcatctcatctcagcgccggccctcgtccttccctactcacgtaaagataagtggcaccttatcctgcctgggccgtgggccctggcgcctagcggcttgccatgtgtttggttccctgtagctgctcaacacttgtagccgcggagtctcaaagcatgccgtgtttggttaggtgtctgaaacaagcaggttctacgcatgcaagcaatgcttgccagccaggctggtctgatacgcgcttgattagcgtatctagggatgcaggttgtgtgcatgcacctgaagcttgggcacgcatttctagatcatcttttattttgttttttatcatagatctcacttgaaatattcatcgctaagccaatttcaaatctatgttcttagcatttttacgaacaaaactagattacacctgctatataaattttagagatttatttatttattgtatcggatttttaatctgatgctgacaaccaaacaaaagttgtatttagcctgaatgcactaatacaaataaccaaacaaaagtctattgcatgatcttagcctgaccaaatgagcctgaatcctcaagtgctggctaagttggaccaggctgctactgcacggcaaccaatcacgcggttggtgaatcggcctcagctttgccgccgccgtccagagtcaagacattccctagaggatccccatccgttccctggccgcgaaatccatgggccgaaactctacagggcaaaaaaataaataaatcatgcgaaacgcaaacgatggtcgtcgtcacaggacctcccattccgaaatgttgtggcggggatcggcggtgttcattccagctgctccgacggccagcagggcgaccgcgtcggagcaggagcaggagggcatcagccggcaggcagtagtgggcaaacgggccaggccagtgagaatcgaggatggcacgcacggcagcctgtgttccacgccacggccggcccacgcggaaccgaaagcacacttgccgcggtagtacgcaccactgcacccggttgcagccacacccgatctctctctctctctttttattactctgtactattattatatactccgtcccgctcccgcggtacgcagcaggagcactgttccggcgtgagcgcacgtcgcgccaagcgcggggggagcgaatccgccgtaccgatcgcactgcgcgtgtcccggcatgggaacatgacgggacgcgacgaaaatggaatcaaaggggagccgagacggaccgccgggacgccacgccacagccaaacacgcccgccacgaccgcgaccgcgctggacgagcccggggatcgtgtaacggacggaagcatgaggcgcgcggcacggcggcgccgccggaggtaccgtaccgtacgtgcttactagtggcaccgcctcctgtgaccctgtctcggtgactcctgacaccatcgtgcatgctggcgcggcgatggcgcgtagcagccaggcggtagcgcggcggtatcagtggcagcaggtccgtggccgtggcacgagccggctttcgcagcgctgcatcgctgctggctctggctgctgctgctgctacggcctcgtgtcaatatatgtgtcaagcacgcctgcagttttttttttctctccctgcggcgacgcagttatctttagcctggacgttgactcttggggtacgtgtgtgtacctgtcggctgtcgcgtggacgtggagggtcccaaggatcggagctgcagggatccgcgtccatttcgacccggccggatcctgattcctgactgcgaggtgggctcgctcatccgtgacttgcgagtatgttgttga

SEQ ID NO: 577 - DNA, 1610 bp, Zea mays
  misc_feature (1)..(100): optimal_loci_174088_G1, chr5:10220074..10221683, Cluster 4
caaagggtagggagggcatcggacgcgcgcgcgacatggaggaggcagatcttcctcgcgccactcacatgcacgacgccacgaccctggtccctggcgaccccggcgccgcgtgcacgagcccctcacgagaccctctcgactcccctgcgcggcaccggtggaaacgacccggaactcccgtgtgccgcgcgcccacggcagacgcggcgccacagagcccacaatctgtcgcgaggtgcgctgcattcggcggccgtgttttattattagacgggtagcggcagaaacggattatttgagagctggaaaaaaagatgctcaactgccactgcgagttgtcttcccctccggatcgcagactttttagcacaaatgttgcggctgttaactcgaacgtgcacttactacttctcttttcaaagaaataaaaaaaaggaaattgtctcggtaagctacattttttttatataaaaaatttgactccagcgatcaccctcacacgcctctgccgggcaccgccgagtggtgttcacgacgccgcggacgggaggcggcacacctacaacaaccgcttcggcgtgctcttgcggtagcgcgacacgtattcggtcccgtacgcaggttgctacaccgtaggacctatttttggttgggtgtgagtgtgaccacgtggacagtgacgaatctatgggctatttgtttggggtcataattttatctagattatactatataacttattttgaaaacaaggttacgggggtgtttgtttgaactaagtattaattaaaaatttgttggattatttaattttatcagattataatctcaaacaaacatcctctgtacaatctaaacagattataaatccaaacaaacatgcctctaatcgagaacatcatcaggattgattgacctcgacaaaaccctctaaatccgcccgtgcatgtggaccatgtgggagtgttctgggatgctgtgaacaagattttgcatggctgctccatccctgtgctgtaaggatggacggcggcgattccatttctgcttctgcttaagattgattcaactgtatggaaaaaaaaaagaacatacagttgccgtcatttacatgtacaggattggcaaattatattcttcgatgaatatgacagcaataactgtaggcgatcctgggactactatccaaatccgtaatttttttaaagggaaagaattctacagtagtattaaatccttcgacctcttgttgaatatgggcttctaatatgtgttcatcgagtgggctcagcaccacatatcggcccataacctcgagaggcccaagggacctctgattgttttccgtctgggctccgcgtggtttgagtggagaatgggcctatgcacgaaacagactagagacgtataaaagttgtagatgaagatctcgttttccttctcaatactcaggagtcaagaacaacatataaaaacacacagcggaagacaaatatatgaggagagccatctcttcatccgttgttatagttgtgcatgtagtctcttgatattagccttaaagacatatatggacatatgcatatggtagcctccctggcgaatat

SEQ ID NO: 578 - DNA, 1802 bp, Zea mays
  misc_feature (1)..(100): optimal_loci_174335_G1, chr5:11786955..11788756, Cluster 4
ccattattttgctgcgtacagtggccggcgaggccccgccccacgcgctttgcgagtggcgcaccggatccggtttcgcctgccccacccccatccagccatccatcctcgacgaggcacagtttcatgaggcggccggacggcaggccccaatcctcgtcacggcgcgagcgagcccgctcctgccacgtgccaggcaccgccatgtgctgctccctgggagatcacagtgaagcccgagtctctgtggaccagagctgctgccgcccggcctccactgaggccggctgggatcggtccaccgtgcaccgagtggtacgactccaaaaggtcagagatgagaccgccttgcgcccttgcggccttgcctagtgctgttgtgcatgactgtacgcgcagagtcgctacgcccacacgttctggtgcagaggacaggagcaccggatcggagcacgctgtgaaatgtgcgtgcctcggttcacgacgcctgcccttgagatgcaagcggccaccggatccggatctgccttttggggacgtatatgtatcaggccatactcagattaatgaaatgtgaggttcttgtgcgccaatagtatagactttcgtatggttgttgaggtatttctttcggaaaacgaatcgcagacatgatttgggtagtcataaccaccataacaatgatccctggtgtgttcgggaatctaaatgaccttttctcaatcttatttattcactatataatacgacctcgttaggctatttatttaaggtcagcaaagttgctgagttttttttttttttgcctctctctctaggctagattatttgggaatgaatcattagaaaccctgatcctgtatgtataatacagcaatgaagccacacgagctgagtgacgcgtccctcttttgcaaccgcgagcttgtcccacgaagacgttgtttatgtttccccgacacatccgttagcatatcgccttacatattaaggcaagctgtttcttgtcgtacttcgtagggtaccaacacccgcaacacgcacccgagagctctcatctgttaccttctcaaacatcatttagggtttaggacatcgatcatcaacaactcgtaatcatgtttagttggaaataaaaactcatcgtagttcaacacacaggtgtaagaagcgcagtgcacgtcacgtaggactcaggtgtcccaactcccgtgcacaggataaaggacccgacggcgacgggcgggacgtggccccgtctttccccggccggccgtacggcacaccaggcacgcacgggggcccttcgtgccatccgggccccgcgcgcccatacgccgctgcagggagcccgtcgcgctcgcaggtcgcaccgcggccagcgccgggcgtgtagcggtcacgggcgaggtgtgcgttcccccgtgccgttgcgctgtgctgagcctaaactcgacgtgacgggacgctacgccgttttggtcccgagccggctccgtgtccgccggtgtctcccatgccgtccgtggcgggcgcggtcgtgagtggtgtgtgcccccgcgcttgcggtccttcccgaccttccgtggcgatccaacgtgggtgccacagcatgctgagaacgcgcggaagctacgcgtgataaggagggaacgtggactggggccgaacgctgcaaggaaagaagattcgcggccgtcgcaacagcctggagcacctccgtcgcaggctggacggcgaggccgatgctgacgcggatgccccacacccctccaccgcccatccgggcgtcacgtcacatg

SEQ ID NO: 579 - DNA, 2105 bp, Zea mays
  misc_feature (1)..(100): optimal_loci_174736_G1, chr5:14052635..14054739, Cluster 4
agtatcacagtaagagatttttttaacacatacattgtacaacattacacatttatcattttgagagagagattttggttttggatcctttatactgatctttttttactttgattttgaattttaattggttttgtaaatgaatgtcaatgtttaatgtctatgtggtgttgctaatattttcgttaaggagaagattgtaaaatctcgtgtgataatccattgttttatattagaattacctttgtaaagtggttaacatgatatgatgttgggcatgtgtgctaatgtgtggttttgatattgatttaacacactcatgggcgtggagttgcatggattgacttcgagggtgcatttggttcagctttttgaaactatttctgttttaaaaagtagaagctaaaccaaaaggatcaacttttctagtactactttaaaaaaacaaccttttgtagtacaaatttgaaaatgacttggacccgacttttgttgcttatctaagtttgatatattaataaaaagatacgacaatttaaaacttaaattggatttagaataattaattgttgtaataaatgaaattaaaatatatttttaataaattaataaaaatgaaattgtaaaagttatttattaattcaatatatgaatgacgacagatataaaataaaatgggattaaaaataattaagtgttagaataaataaaataaaaaatatttataaatagcaaatatatagcaagtagagtctagttttatttgtaaagataccaggaatgcaaatatgaagtttgtttttaattagatatattgattaagaaatatagttaaataaagttatataagcaatatattgtttgttcacaacagacaactgtttgagcttaacaactttcgttttttacatcagataactcacgacatattttcataacagaaaactcacatcaactttttgacaactcaaagctgaactaaatccatcctaagctaaatcgtgaacttgttctcgtacatggttgacgtttggagtatagattggtacatatgaaggtcatttgtgttggagaattatatgaaatatatataatgttttaaaggatcgttggatagaattgcaacacacgctaaacagtgaaaagatagaaagaagtggaggtgaccttttgtaatttggcatcctcttcgtccgggcgatcaaccatgggctgatgggcgcagggctgctgctcctttgcgtagccgcgtagggacgggacgtggagagggatctccgcggggagccggggagcgtgaggcagctggctgctccgctgctggcccctggccggactaccggtggcgctagacgaatagcagcagtagctagtagccgtgcgcgcggggtggaggcacgatgggggccgaggtgatgtcacgacgggttagcgcggcccagcatggcacggggcaggcccaggagggaactgttggcaatgcaggcggcctagacgggaactgttggcccaagtggggacaatggcggcccaactcggcgcagcttgcaagcgggttggtcaacccaagttgctggcccaagagtgtcgaaggtcggctcaagaggggccgatgcgggctaaattgggtcttttattataaatatcagatttatgatttatattacctcaaaacattaaattaatctagagcttttgaagattttgtaaagaaatatttttttgtgttttttgagagcactttgtacacataatactcatgattaaggcgttgtttatacaagattagtgtggtaatctcattcctcctttgcttaataatgtgcggcctagttttgatcgtaaaaatgtcgggaatatagatatgaatttggttcagtaagtaaatctttaaattataagatataaaaaacaaaactcgtgtctcggtttgtgtgcacgagtaaaacaacaggttgggacgcgcttcctctatagttacgtccaacgacagacgtgtggggttacctgctacagctacgtccgtggacgtaattgtagaggatcatacttggctggctgagcagagcctggccgcgtgtgcggccgcgtgaggcattatcgct

SEQ ID NO: 580 - DNA, 1425 bp, Zea mays
  misc_feature (1)..(100): optimal_loci_175177_G1, chr5:16327319..16328743, Cluster 4
aatctttaaattgccaaatacagaaactctatttgtgttgcttatttgtgttttattggtccattcatatccaccccctgctaattttctagtttatcaagcattttcccttatcaaacattcagactcaaactgatgtgcttgacaaaaacgtatgcttttacccaagaatttcttaaagctcttttaagcattgcaaatagaaatactgaaactggagacggatgcttattttctcacttgctatcgtataaacatctcagtacacagtagctaagcaactgtccttacgtcgtcatgcaccaccaattcaccgtcaccatcactctccgcaagtctgaatttttattatgtatatgcgcgaacagttggtagggaagagaccaacccgcagggaattaggtgtggtgtggcccaaaagcacagacagacgctcctagcctgataacacattctaactgctgaaagatacatgtgccgtgttgtgccctgagtatatgctggtctttcccttgatcgacgacggctcgctggtaacgtatgtatcagcaggtgcacgagcacgtacttttaaaaattatatataaaagtggcaatgcgtttccctatgtttttgaattattagcacgcgggggaattataggtggacatggtttagttttaagaagacgagcttctttctttctttctttgtttcggttcccgctttgcatcgtggaaaggaaaagcacacccgtattattctctggtttgatttgatgggggggcgtccaaataaactagcggtagcttagcttgaacagaatgcgtttgattgagcgggcatacctttatggatcgtctctctctgtctgtcagtctgtgtgtgtggaagtttcttgggaactttgatcctgcttttgcatctgcagagcaccaccatcctctgctggtataccttgctttgagtacaatcaatcattcattcattgaggtcaaagttgcatgccctgggcgggccccgcatcggatctgtttatgcacgattggtcgcgaaggtgagggtcatgtgcggtgtgtaaactcccctctccctctctgctgggatcatgtggtgtgccctgcctccagcttctattgttgcagctaggccggtcttcgtaggcaagaattgcaagtaaagaaaggatccaatgcgttccatgcctgtgctgttctgcctgccggccaatgaggtcgttgaaatatggcgcgcgcgcccctttgggtcagagggactggcactgagtgtccggatgagatccaggagcaacgccttttctggttctggagtaggcggagcagagtgtgctgctactgctagctggacggagtggacgctctggcgctttttgaaaccttgctcgtcccctagtcttccttccagatgagatgctcatgcagcca

SEQ ID NO: 581 - DNA, 2780 bp, Zea mays
  misc_feature (1)..(100): optimal_loci_180086_G1, chr5:42295021..42297800, Cluster 4
ccacgtccaagatccgtcgccgtgccctcgccggcacaaaagcttggtgtttgtaatctgctcatatatatggtcgctgcctccgatcggcactgatgaacgagagcgatcgagcgtccatccaacgtccctgaaagcacaacacccaaacgccaatctatctatctatctatctatcccaggtagacctcataaagacggtcaaacaacgtccgaagcaagctaggacccccggcgcggcgccgacggacgctagctagctctcggtcgtcaccactcaacgcgacccgcgacgtacgacggatcatctctgggcaaccggctggtgcggtgcagacgtgcagtggacacatgtcccttggacggacctgccagctgtacgtacgtgccggtctgccggaacacggccgggggggggggggggggggggcgctcggatctctcgcagaagggcggccgagcaggatcgagcagccggcagtgcccccgtcggcgccaggactggacggacgtacccgaggccgagcctgaagcaggccggccgacgccgacacgtacggggctgggacgtttctctcatgctccggcaagagcaaaaggaagcgagcgaggacgtatgcgcgcggttgccgtcagcgcccgccgcccgtgtgtgtcaccgcgtgccgcggcgcggaaggcgtgagccgtgagcgggcggggcatggaccaagggggtggcttgttgcttcctgcactgcccgaaccgaacccccgctggaggccggggctggactggagcatgcatacagtttggcatggaatttatgtgtgttttcatctatagtactccttatacaatgagcatgcatgtgcacgaatccacggtatagcacggccggtgcctgaaagaataccctattcggaggtccatctcctgctatttttaattttttaagcaggccggacgagcgactgagcttgtcgtcgtcgtcgttcctcgagtctgtctgtgctggccgcccttgttttatgaatgaattttggacatctccgaacgagatatatatatttgctatacgaatctgtgtcaaggtgtccccgccgtgcaaaggggaaaataataatacttatgactatgatgatatgtataaaataaaatggaagggtaggctgggtcaggtcaacgattcctgacatgctagaaatagcatggaccaaggaagaagcccgtatgtcgttcacctgcacgacacgaccacggatataggagtcacaattgctgtactgtaatagccgcgtagtaatggactttatattattactttcttagaattagaaggaaaaaaagtgagagaaaagattccccaggtcgaggcgtagagccatcgcccatcggccggcatcacgaggacgacgaccgagcagctccgagtcatcatcacagtgcccagccagcccaaagcgtggtgttaattctcaggttccggattccctgtacgctcctcgtataggaggacgcgcgtataatacgccgcacggtctcggtcgtggacgcctctgtcttcagctgttggtcgacaggaacagttccgctccggtccactggaacgagaagaaagagaaggaaaggaaccaaccaaaacgtgtgcggctcgcggccggcgccgccgatcgccatcgactgatccgtccgtctcgcctccgtcggcgtcgccctggtggttgcctggatggatcttggacgtggctcgtgagccaggaagggagtactagggaccatatgggctgccatttctgcgtcccagcaggttcgttcccgcggttattttacttttggcttctgccatttctctgtttcggctcaggcacttcattaacagctcacgttcctttcactttcaccgttttctatcggcgacggcgggctattggcgtgcaggtttcattgacgacggcgggctatttactgcagtgctatagctgcagctactactctaccagctagcactagcagcaggttcgatgctgagctcaggcttcagacacgggtggatggatggatcgtcgtcgtcagtgaggttgctgtcggcgaattttactgcgactatgcagccagtcaccagtccaatcaaaatttaccacaggcagacgtacacgtgcgtgcaggcatcgtactcgtacggtactactactaccacagccttgcaagtcaaaaagaagaaagtgttggaggggagagcgagtagtagtagagcaggacgattcctgcactcgccaacagcatgcgactacgagctgcttctcacgctagcactctgctaccggcacagcacagtaagtacatggcaacggcatgctaatcttgcttccgtaccagtcagtcagtgcaggcataataggagatcagtgagacttaagcacctgccaggcatcaatcagcacgccacaagatgaggacgtgacggggggggtcgggagtgcggcacgcggagcactgtacatgtgcgactgcacgtcgcgcgcggcgcagcgcagcgcaggcacagagccactgaaccagtagccgtactctacagaagcaaggacatagagaattgacaagaaaaatcacgcaagggaggagagagagaaggggggagcatagcataggcatagcaagagcaaagctgaaaaagaggagcaccactcgtggggggttaaaaccccgagaacaaacttgggagtagcagcggccagccggaagcgagcggagaccgaggggagagggggtgaagaagcaacgagacgcagcgagcaag

SEQ ID NO: 582 - DNA, 2534 bp, Zea mays
  misc_feature (1)..(100): optimal_loci_181810_G1, chr5:53401199..53403732, Cluster 4
gcctatgccacccggcggcgagctcgagcttgagcagtggtgcacgcaaagattagccaggccaggccagtaaaagacaaggcgtggccagccggcgcagcactggcacgcacgccacggcccaaggtttcggctcccgcacgaggtatgttaggttacgcgcgccgcgccacgtcctgaccgactgacgtatctgacctcggccggtccacaacggcgcccggatgcagaggaggaggaggaaggcggcggcgaacgattcggctgatgcgcgggagcggattccttcgcgccgcaggtgccttctaccttgccgatggccgtatctgtcacgctttgctggattcgcgcgcgcccacattcttatctttgccgagatttgcgcactcgatggtgtcgggacaaggcagctgttggctgttgcagcagcacgggcgcactgcttggcctgctatgcgagcttcggtcgtcggcgttcttttagtttagtttaggcccatgcatctgctgctgtcatcgcctctatcttctgatgatgatttcgggtccgtgtacgccactccttctccagcaaatccagctccttgctccctgccgcggcggccaaacccacaggaacggccgtgtccgtccgtcgtcgcgctctggaaatcatctgcctgcccttccgtccatccacagtcaggcggcgacctctctgaacgcagtgacggccggaactcaactcgttgtctagtgcctacaggaacggggaatgtgcgtgccaggcgcccgtgaccacgcgcagccacacggcactcaaattggcttctttggctccatcggcggcgttcagcggatatgctgctgtcgatggcacgcaacgcaacctagcacagcgtgacgatgctggccgtttaaaacgaccgccggcccaccagctgtccaaatagtagctcatcggtaacggggcccagcatacgatacgattccggaactaacttggcagatagataggctttccttgccgggccgacggggctggacactctctcacgcgacctgaacagaagtggtccgtcggccttctgtcgcagtccacgggccggggctcgatacaaacgcatacatgtagttacgtacagtacaggacacaaagtggttagctagctaaccatcatcagggcacagcatatatacatgtagttgcttactagccaggtgtcctatctgatgtattacactgttgaaacgcgggatcagttgcttattcctttgtggtacacgtccaaacataacaaacaccctcccaccccgcgcccccgggtaattctaggttttggatcaatcattttttttgagtttgactaaactcgtaggagattatggggatgtttacgatggctctgtagtttataatatcaatttaattagtttaaaaattaatctaaataataaacaaaatgacttatctaaatgtcctctaaaggcttatagctccaactctatgatttttctggagcacctaatgatctgctccaccaactctacaaaaatccctggagctggagctatcccaaacagggcctatatgtaaacactccttatgcatgtctatgacttaatttattaaaatgcattttatagctaatgcaataacatttaagacacgtttggatcgtctagtgtttgttgggttggtctcatccgactcgatgactacatccagtcggacaacttggttgtgttctgaccgggcccacaacaacctttggttatggccctctttcacatagctaggtacgcaatctaacaatcgtcgtaccccttttgtcctacattctcattagatctgatctatctctatggaattagtgaagggtagatcatggctatcatgcccatagaacctagctcaccaaactctgaatccatggcgtcatctttcaaccctaaaggtcttttcccctgttgctagggtcgtgagctaaggtcatacaaatataacaacagtggtcctagtatactagaatgagatttttgggggctcagaatctaaccctaggtactagattacctttgattttggaacaaatttgagcgacccccctctcaaacctcgtgtttctactccattagaacaacaagcagaagaaggagagatacaaaccctaacttgggtttccctaaactcccaaagcataaccctaactttgaccaaatcctgcagatagaggaaagaggagtcttacaacttatctggccatcggatatgttgataggccaccgaaggaggcagcacgagcaccagtctcggacacaaaggcatgtgcgaggccttaggtcaccgccgtgacgctgaccaacgacaacacgctcaccctcaactttggatcaaagaacagtgaagtgcaatgccttttattttctttattatttcaatacgagtaataatcatataaatgtttgtatacgaatcttgagcattgttttaagttaatgcttgctggaaattaagttactatgtttcgagccaagttttaagtttaagtttt

SEQ ID NO: 583 - DNA, 1457 bp, Zea mays
  misc_feature (1)..(100): optimal_loci_182924_G1, chr5:60516372..60517828, Cluster 4
tcatacctgtttcacataatcaacaattagactgagttcattcagattcctgacataagaagcccttgaacttaatactgactttagttcgctcctcatcttatcaatatctccacaaagtttttcagtctcccactgtcacaaagagaaatggttttcctacacaaatcaaaggacccctttaagcgactaacccttgtaataatcattacaaatacaaataagaataagtacatgacaaggtagtcaaggcaacagtgttgaatattgaagatgtaaagagaaaggcagcaagatgaagacatgtgaactgcaatccatgcaaacacagtgcacagaagaagtaagaactatttttatgttacctgttttagttaccaaattgaaatctgcaggtctgtagtattaggttcagctaaaacagtgcagagcacacaacaacagtgatgcctattagtcccaactcccaaactgggaccacagtgacaacaatccaacatcatgcatacaaaccagagcattagatatgtagctcctggctattacactgtagacaatttctggagctccactctctgtaagagacttatgagtaggttctatcacataatgcatcagaatggtcctccaaactacataatggatagttcggtgcaaacaagacaggtagatgaaacaatggtgattagtagttccattaagttgcagatgagcagaacaaaatgatcctcctatacatctagccatctaggagatcaagaaccccaaaagaacaagcctcagtctacctcaacaataatggatgatgagatgaacaaaacattaaataacaagtccgccaatgagcacaatcagtaaggcatcttgaagtttagagcgcgcaatagaatatcaatatattaagaagaaaagaaacacagtataaaaaccaaagaacaccaggtctaggaaacatgaaacaaaccccaagaacacccactcccacgcacctatgcaaaacaaaaatacaagacctgaactagaccaaccagcccacaaatctaacttgtgggggtgacaggcaggggggaggagattcctctagctccacccaaacttcaacattgtagtgtgcaactgacttttgccaaaaaaagactagcattccacatgaaaagtagatctcctccaacccaacatgtaggtatttttaaaaaacaatgacttaaaaatataatttatagagtgtatgcagtataaagcaaacaactatatttctttcaaattaacgaagatgatacacccgaatatgatataccgaagtctatacagaacatagaaggaagctaacaaaggagcaaataaaattcgtttctcgctcacgtacaggcgtaagcatagacctcggcgtactcagacagtcgtacgcaaataactatactcttttttcctgcacccacgtcccattcatcccatac

SEQ ID NO: 584 - DNA, 1695 bp, Zea mays
  misc_feature (1)..(100): optimal_loci_186304_G1, chr5:85237945..85239639, Cluster 4
gtgtgcacgggagggttaatgctatgtgggtccaagtgcataagtaacggcgtcaattagtgaatggacagcgatggcatagaggaaaaaaagtctaaaactgatggcatagagggaatgctataatttccaatgacacataaggaattggtataatttctaatggcatagagggaattttctctagattaaagccatacgacgtttcaaggagacgatggcgcaggccaacctgcccttccaaaacgtgtgcgccgcctcttgccctcttctgcagctactaccgaataagaaagaactcaaaattctctaccgaataagaaaaagctcgttagtggaagttgagcttcgtaatatggaacaatgaaaaaaaaaagatgctgcatagtcatcgatattatttaaatatagaaatacagctgaaatatgggacatttttttgaaacccacgtttaaaccggaccatgcagaggccggtgcagagattttccttcgtggcggacggggtgctgctgcgcttttggaatggcacacatttcgacgccagtgcagcccgtcgcagaatgcgccggagcccggacggaggttcctaggccccttttcggcccattcccgaagccgcacgcacggctctgattgggctctctctctttgctggcgaaaattagcttgctgccattgtcgatgaagacgatccagtcgatggttctatagtttcgagagttgattatctaatagagtgatttcgagtaatttttttatcggaagtgaatttatttagcgaaaatcatttggtaaataggctgtgaagtgatttttgacgggttggatagtgggaagcaggttgtaagtggtggaaagcaggtttttttctcacactttctagtacaaaatagagattagattcacttcattcccaccattgagcagttcagatttttgggggcgtttgatagagctctcgtatatccgctcacatcgagaatcactctcgcagagccaaaccgtaaaaaactgaactgctttattatgggagtggagtgaatctagtatttattttgtactataaagtgggagccaaaaaacctgcttcttacctctcccaacctgctccccactctctaacctctcaggaatcaatttacaacctatttgccaaacattttttgtcaaataaattcacttatgttagaaaaacgtttggtatcactttattagagaattggctttcgggactagagaatggatccaagctgtgacaaatgaacccacagcagaattaattctagttggaaccgaagctatgagaggtctaccaaatgtcccgataagctattggttggtgctatgctcctgaagacagaacggcttgtcccgatcgaccgatcgagcggcatatgtgaagcacttttctcgttgccaacgaagtgggaatcgaatctgtctttttgtttttcctgtgctgattgttgaagaacaatggcgaccggtcaggtggtgctaatgcctttgctaattctttagtttgtttatagatgttctggtttctagcgtggattgaaaaggaaatgctatgcgtgggcaatcatgcacgaatttgttcttcgctaaagttgcgtgtgcctgctttcgttgaaggtggtctttgtttttttcacatatcatgtgtttggttgcctgtatttgatggtgctt

SEQ ID NO: 585 - DNA, 4126 bp, Zea mays
  misc_feature (1)..(100): optimal_loci_198422_G1, chr5:164860424..164864549, Cluster 4
caaccacaggaaactaactcagggccatgtgttcaaactcagagaacatgcatgttgggttgcaagttgcaacaagggattaaaattcccccaagtactactggaactaatctagatcgagagggatggagtggatccctccattattatattgtcactcaatcccttttggggggaggggtgggggttaaattcgtttaatccatgtctcaaaaggtacattcgattcatccctagtacggacaactgagcttctatgcttacctgaaagtgagtaaaaagaaagaatatgcacacgcatctcgtagattacataaaagcagcaataaactccatacatatatgctgtcaattcttctgtaacaagagggaaaagtcttacatatatatgaaacaagagtagagtgtgctcatttattgaattgaatataggctactcaaactgatgcatgttgcatcaatttgtagttacagtttacatatgcttgtatatgacctgaaagggcgtaaacggacaagctagctagctaggcctcagagggccgggcgcgaaccatccaatggtacggttacgaagttctcacgtactcatgcatggtctctactaaagctagcctgggtgacaactctctctggatgggcgaaaacatccgcatatcccaatcacgagtgtcagcgacgagctgagtgtgagtgaactagctagagggccgggccgccgggcaggggtcgtcacgagggaggagaggggcgcgtcgtgcagtgctgccgtcgcgtagcgcccgcccgcgtgctcgctagctgcctagcccctcccatgaacggtttctgcggttgccgttgcgaaagctgacaggagagagagcggtcctaggcctgcagcgaccacgagcaagggccctgaccccatgaccatgagcggcgggctagctctagctacgtgtacagccgcagctccgtccgtctcccgtctctacggagggaaacatgcagcctgtacacttggatatcctggtctgagttactgcagaagtgcgtgcggcggcgtgctgctcctgcaaaagcgcaagagctgggggatggacgcattcgtaacagtaccagcgcgcccatctatctacgcacgtacgtacgtgcatggcgcagatccctcgcacgatgtgaactttttgtacgtacgtactgcacattcaggccaggtggccttagctatctatgcaacgcagcgcgcatgcaatgcagtcgtcccgtcccatcttaattaacgagatcgcccgacgatgactgcaatttttttctccccttgcaccggcggccaaacagagcagagaccaccacgctctccactccaccaagaccaaggagtagatgctgagggagcctttcaagttcgtctagaccatccggggccgccgccggcgacacgatcatagaagcgcctgacccgcgcgcgcggcgtcgatcggcgggggggtccgatacgatcgatggacgcgacgacgtccatctgaaatccgatccgatcggatcgacgccgctgcccacaagcacaacacagcacgtaggggtgcgtcacctggggacagcaacggctgtggcttcacaacacagcatgaagcggtggctagctagctcggggacatgcacacacgccgaccagcagcttgggagtcaagaacacggcatgtgagaccacgtcccggccccgacgtcgtggcgcatgtacactgaaagagctagctctagctagatagataactgaacgtcccacctgcctgcaggggaagtctggttaataagctgcttgcacatccaaatgacacacatgcatatatcacggagaaaggggaaaaaggcatgcagtctgcgcatatgccatgcttgatgcttctttcttgttgagttgttggctagcttttggggtcatgctctggttccaagatttcgtccatgcatgtgctcatgttgtgtgacgtgcagcttattattaattgtagacaccgccagaggtggtcctggtccacagtctgcatatgtgtgtgctcgtccgtgaaattttctagtattccagaacatgctagagcggcatgtactaacgacgtctctctctgactggtggtgattagcataacaaatactacatcagattattcgatctgataaccgtgtaagtggggatgatatgattattcgatcgattttctacacgcagtcggggggcaaaataagactttttcttatttaaaggcaatacagtaaatgataagatactgaactgtcatctgacggttaattaactttgtctggccgctggaatctcgatcgtgccacagtggcgaccagagcgtggtggctatacagcgaccacgccaccaggtcgcgcgcgaggtgaaacgcgcgcggacgtgcggcggaggatcgtcggagctagcgaggcgctgtgtccgccccgaccggggcttgggttgcaggggcgagatcagggaggaaatcttgtgttcctcttcgacatggcacggcggccacgctcttgcttagcttgtcccacgacggcccgagcgcggcgttgaaaagcacgcggccgggtacacacggacaactaccgtcgctgctagcacatgaggctgtggggcttggccgggttcgatcgtatatatggatatgcatgcatcagatcagcgcgactgtgccactgttacatagatttgctcctcgatctcttgacgtcgacgagatggttttccacagtgactgaactagccgtgcctgttcgggggcagtttcaatagtcagatgttgtcatgcgtcacaagggagaggttctagatttttatagcatgcatgcatagagaaggagcgagaggtgactcgatccatccatccgatagctgcgtatatatcgtacgtaggccaccaccgtcgttacatctaaatctagctctcgtgcggcgattagatcagggtccggtgtctccctatctaccagtgaaaggtttcatacacgcgcgcgcatgcacgacgacaaacgctgcagatgcggcgccgctctggagaggacgagagcagtcgccgtcggcgtcgatcgatcggcgcttctctcaccgcgccaccgcgggccggccgggagagggaggaagccagcgtaataatctgcccaatgcaatgccacccttcaatcttactcctagctagctagtcattagggattaggtaccgtagcgtcgtcattcatcaacaaacgccaattaatcgaaggaacgacgatgacgatgacgaatcatcatcaggcaggcgtacccttctcttatcttattacatgcatatggctccatttattgatcaacaaacgctttccgtatcgatgctgcagccaccgccaacgtctcgtctcgtctcgccacgcgcccctctctgcttgaactgcagactgttgccaccgtactgacaagctagctatagcctatagctagctttgcgtggtacggtacgccacaccaccacagatatgtgtgacaggaacagctgatggcaaggttgttcacaggtctctacaagggcaataataccgcaataggttgctgttcttggagagtgggcgagaataacctaacaggtttatcgacgtacgtacgtacgtgtaaaccttgtcagatatccgcggacgaatgtggaaaaaagttgccatatatattgcatggttcgctgcagaagctgggtagtaatcataaattcagggaaaaacaagagacgacgtaattaaaaagaaggaattttgaaggtgtttggtttggggagtcaatccattttagacgagttggtgcatcatgagtctatttcataaattagaattaactcatttaccatattattactaattattagactacaaggaataaaacagtgatggatcaactcattacattttacaaaacaaacaacaaagtgatggatcgactttcattcaactcatattattattaaaataatgcactaacttatttctcaaaccaagcacactatttaggtttcattggagccacatgctatcactactcacaagacttgcaaaagttaagcacacaaggttatcgatccgagttttaagctctagagtagccatatatgc

SEQ ID NO: 586 - DNA, 2106 bp, Zea mays
  misc_feature (1)..(100): optimal_loci_201152_G1, chr5:180366212..180368317, Cluster 4
atgcctgtttagctagagtgcatttaggttttacataaaattaaaatgagctgggaactttactccattattgttccagtattcgagtattccccaaagtctaagaagtctgctcctacaacgaaagggaggtgtactagacctggcccactgggccgtgtagttttctgactttggacctgatccccaaccaaggccttgaatgcccacatcgtctgcagtgtcgtccacgtgctgcttgtgttgcgtactccagtagactggactagcagtacaacttgcgtgcgacactgcaaccgcatcggcgccacggcgcggcgccgggccggcggccgtgacggcacaccattgcggtatgaagcccgtagggccattgtctgcaggccgcagtctatctccttcattgtcgtcgtcgtcgtcgatcagggtccactcctccctgccgccggccatacagctagcgtaagtgtccgtatacgaccatgcatgcatctccataccagggccggtgtcagtgagcagtacgctcagacgactcagtgctgctacgagccagtctggacgcctagccgcagccggtggacgtacggccgggccatgccttggtggggtgacagcgcaacggacgtctcgtcggcgggcaccgcacggcacagcgtttcgcacggaagctgcctcgtcgcttcgaccatcgcttcatacatcatcatctgatcgtcgtccagaactacacacgtgtcccatggattcaccgtgcacgcacgaacgacgaatggcaggcagcaggggcagggcggtgcaggtgtgcgtgcgcgtgatccgcgtgcgccatccagtccaagatggtcgacgtcgccgcccgtggttgatcactcttgatccggccgctcatgtcccacgtcccgcaagcggcaagtcggcaagagcagagcgcgtgccaaagtcttattatctggtgcgcgttcgccgctaactgaaacggtgcgagacggcggcggcgatggttaggatctcagtttttgcgaggctcacccgtctcgcagcaagccatgaatacggcagggtcgggctcttggtttcacttggacgacattcctacagcgggtgagttcgtatcgtagggcaaacccggcgtaaagacaaaggagcaacagggagtggtagcggcctacaggagctcccaatcgcagggccggcccgtacatgtgagcagtttcgggtgcatggacgcagaatacagctacagcgcgcgggcatgctgtccaggactcgcgccatgtctctctgtccctgctagctccctgagcagtcgccgtcgtgccccggccgagcgctcatgcagtcatgccacgcgcggttgcgttgcgttgcggcgacatggatagatctagccaccaaggcaaggctgcaggggaaaacccgaaggcgaagacgaagcattgccttgccttgcccgcgcgtacgtcatggatcacaggcgcgcgaaagatcgaccaagaagccgggtagctgtacgggcccgaccgcgtgaacagcagaagccacccgggccaatgacaagcgacgcacacgcacgccggcggcatgcaccgagcggcagcgcggtgcatggaagctgcctcgccagtacagtacacgtccagtccagagacgcacaagcacggccgaccggcttcgatgggggtgtctccgttgagcctcctcgctttcagttggcgcgcgcgtgtgacgaccgtcgtgcgcgattggccggccggccccggccgttaccgtggctgccgtctctcgtactgtcacacacaagaacagtagtagaacacgaaccaactagtggttctccggcaccaccacgcatgacattatcgtcaagatgaaacgagccccccctcccaagtcccagcacattttatgggcactcctgcccggcgaagtgaccgctcgatatccgcctggcccacagccacgaactttaattctaggaaaaggatggagaacagaagcaactatatattggcaccgcaatttctgattgtagattgtgaaagtctgaaaggggttttccagccggccgatcgaacgggcaatagaccttaagggctgatttgg

SEQ ID NO: 587 - DNA, 2522 bp, Zea mays
  misc_feature (1)..(100): optimal_loci_202164_G1, chr5:186418518..186421039, Cluster 4
agctgaaacgctagtatatatagtgccattgcaccggtggatcagtttcttactccgagttgagagttgcaaacatcgcactgataattttgtttgaagctgcaagcttcagtttaaaaaagttaaaagcttgagtttcccaattgtacgaagtcttgaaggtgctaaggaatcacttggttattagttaatttctaagttaatccagtagtgaccattagtaactagatatagatgctgatggcaccacacaaatacttgggaaaaaaaaaggttggtttcctttttgactgcaggggctaaagaggctatgattatgctcacaccgtcagatagcaagaactttagacggtttcctcccgttgatatttgtcccggaggactaataaggaaaggcaaattctatcggtgacagtaaccatccagattagtggagcagttggaacgagccgtagcgttttacacagcctgctgctgtaggttccgtagtgcttgctccaagcgtcctctctttgggaaaaccagttcacagagacacacgagtagacgacgatgtcatatataagagcgcagctgaagtacgtaaagtaacaccgtcgtcgatcatgcaacggcaacggcaacacggcatatgtatgtgaagaacaggcaggaacgaaaatgcaagttgtattggtagctgatgtcccggcggtgaagtggcgctcaaggcttgtcgtacgtgtgaccagaccagctcttgtgagagttttgtctttgactcgatgtggcttacgtacagctagctgcgccacaaattaaagagcccaccagttgctgcccggtacaattagttaattcattaaccgaaggtttgcccagttcagaggcgtataaaagctgcacactttcagctaggctgggaatgagacgaattcttactgtgctaagtcgattttaacacggacacgtacgtcgggcgtcaatcaggatacggacctttcggaaaacaaagcagccagattgatcccgacaggaagccaccaaagtgtatggtcagaactggtttaaaataagaagggggtttcggtcagatatatacagtactggctacaacaagttcagaagctaatgggggaagtccaagaaataattaattacctgacgaaaccccctgctagatgcgccacgagaacacatcagcgtatctcactgtccgagaaggagggcacacggcacagcacgagctctcgcgctctgcagtacgaccccgatttgatggggggagaaggagacgcccgcgacccgaccgcatccaaccagccaaaatgacaaagtgagaagtttcttgcagcgattggtcgacgaacacacacagtcagatacagtggagcacgcagcggcggcgttcatggtttcttctgggtcaatgtttggttggcccacggtgaggcggacgtcggctgggatgcgcggctgcgacgacgacaggcggccctggcggcatctggaatcacttagtcaggtacgctgtacaaagtgcgatggtaattggtatccattctttcgtttgaacaaaactatggaaatcggcagaaaaaacagggccgggttgggggggggaattcgaaccgtcgtttttcgtcgtggcagatctgaaagtatggggctttggcttggactcatggactgagctctgaagaaccgacggaggagaagtttctttggatggaagaggtgaggtgaggagcacatgctcgcccagaccgaggaagctatactggatgtactgtactgcatgcagctcaacggtcaatgtgtcagcgtgccctcgtgcgcgggccaccgagtcaaacctactactactagtactatactagcgcgacgcgatgccttctgctctggccttctattggctgacgcgacctcctacctcccggctcccacttgctattgctaggccactgccacttgtagtccagacttcaaattttgagatggagcatgtgtgactgctgtttcgtgtatatatatgttctaaattataattcgtttcaactttttaaagaattcagacatactaagttaaactaaaatcatagaaagaaaattataacatccaatagatatactataaaaaatataactaatgaacaaacttatgttactcatttggtatgacgaacatatcaccggccggaccacatttgatgttggatgatgcattgatttacataattacatcatacttcctaaatatttatatttgtatggatgtttcatatttggtaatttggataatggattaattatttgatctacaatacttataactgctatgttattagttattaatagattaagggcctgtctggttcctctactctagggactaaagtttagttcctaccgtgtttggttctagggactaaaagtattcagaacgcattaaatgaatcataagaggaccaaaataccacttagcattctcccgccattagttcaactaaaataaaggagtggcaaaagtggaattaatatga

SEQ ID NO: 588 - DNA, 3490 bp, Zea mays
  misc_feature (1)..(100): optimal_loci_203160_G1, chr5:191884734..191888223, Cluster 4
tgtaaaccgtggtttcaccatccccgggatacggccgggatccgtgttcagtgcatttcctgcgataattcgggctctactactagcagctagctaggtcgtgcgtgtattatacattattcgtcgtgcacaagcgacagcaacggaggcgtgagaccagttcatcagttcgcgctgtgtggatggacgatgtacacttgtccaggagcggcatatatgcagcaatgctgtgtggtgctatttggttacgctttaatttgtcttgccgaacaatgttatttaattggatgcagtaaaatctcagtaattggtgcattacttttaactaccacgagtaccatttgcaagtacaactgcattggcgtcttctcgagtaccgtgtgataaattccaaaacatacttatgtgtcgcgcatgatgatgcttcaaatagtaccgcgcgcgctactagtactatgattagggcatatatatatatataccgatcggtggcgccggtacccgtatcataatatttcgatacgaatctaagtacttgttacaaccacttggcaagtcttttaattccttgtacgggcggtattaagattttgcgattattagtaatcaaagcctcgagcttgaggacaacccaccactcaccaggctgcatgcatgtacgacaatattccgtgcttatgcgatgccaattttttttaattttaattatgtaatcaaagggaggcagcagcgccgattattctattgatttattgtcgatcgagaacagatcttctttcgtccgtatcatggccgattctcgtctcatgccaaaagatctactactagtactaagcttgctagctagttagagtcgtagacaacgctaggagcaagcaacacactgggatctgagatttcgggatgcagtatatcctgcgcgtccaagaaacatgacgcacggtctacgtacatccttgcacctaccgtcgtgcgggtgggcctccctcctactggcggcccattgaggtagcgacctacgcgaagcttacgcccaccacacacacacacaagcgaagccaaagcccgcacagtatccgtttttagccctgctagtccagtagtcctctcttcggccatgggaccatgctgccgtgtgtcgtgtcgcttcgctgctggtcggtcagtggttagtggttctaatgccggacggagggttcttgggggggtggaaaaatgaggaatcatatcctacacgcgcagatacaggtcgtttctatgctttatcattcatgtggactaatgcgccaggacagaacaataatacgagtagggtagtaccagcagcactggcactagaggccaagggcgaggccggcctcgtgcaaaggcacacccggaaatggccaaacgaatggccccaggctcacgtcgtacggccagcgcccgtagcgtctgccattatgatgcgctggagtaggtgggcatgcttcaacttcaatagcggcgccagcgttggccggctgtgcgtgctgcttcgcctgcgcccaccgtacggccgctggtggtgcgcgtttcgatctgcgacctgccgcgccaccgccacggtcaaattggtcctgactcctcctcctgcctgcctgcctgccggtggctatgtggaaaaggcagtcgatgccgcggccactcgatcagcagaccaggtgtccaggcggccagcaaggaccggcaggcgctgtgcagctgccgcgtgcatgtgcggaaggctgcaacgcggtacgcgcgcacggcggagcgacgacggacggccacgacaaaacggcgggggaagggacgctgtggcctgtgaaagggcaaacgaaaatctcttgccgccggtgccacggtcgtatagagtcgggggccgagatagagcggccccccggggagcaggcagtggttggttgctcttggtttggatgtctcgcctgcggccatgcgaatctggaccggacaggattctcccatgcaacacagtagcgctcgtgccagcacgtcatgcccacgtagaatactactactcctgcattgtctctattcttgctgtggccaagtatagcaagcggaggcacgtacgtcgccgaggagggtacggccggggcggccggtaacctacggtgcgtggtggtggctggaacgtccgcgtcgcgctcgctatcacctgagtgacgcctttgtctccccacgtagaccgccccgcccatcccagcccagtgctctcgcagtacgccatgatgcccatcgccaaaccacccataaaaacgactagtgtatgacgcgcgcccatgcgcgcgtgccgatccgtggtgtaaactcttattataagaatgtataactttatactgtgtgatgaacatgtatacatttagagtactcattattaaggacataagaatatcagtatcagatcaaatttaccaaactatgttttttggcagcggttgccaacagaattgtagcgtttatgtcaactagagattgaactgagatcattacaatgcttatggagctgcagcaatcaaaactccacatacatcaagacatgcattttgatacatatgactgtccaaataacagttgatacaattcaacaaccacaagcaacaaagaaataacatacttctttagtggattaacatgagactaacatttacactgtcatgcactcgaaaactcaatgtctaggaaaagaattaaaaaatatgtggtcgtaatttaggatttcattaaaagagaccgcaatatcaaactatatattctcttagcacctagtacataagatgtaaattagtacaaatttttttgcacctctataagatcattttcatatgatgactccctctgtagtctctgtctcattaagtcatatatgtacagctgacagtgtacatcatgtctagcatacctgatggcaagtaagcaataaataaaaggggcaaacaaaaagtaaaacttatcaaatacaaaacacaatggaaaaaaattcaaaattggggtttatatacgcaatagctaatcatttcatcagtaagtggcctcgacttccaatctgcacaataaagaaaaggagcgaaaaaaatcatatgtaaaaacaaacataacataaaagaaattttgtagggtttatgtgcgcaatatttgatcatttcatcaggaagtagcatggacctccagtctacattttgatatattctctccatctgtctaaccttgaagcctggtattattgaccctaattaaaaaaacttgtcctgtgtcaaaaaagataaagtgtgtagatgtgcaaacgaaagataaaaaacaacatttcatttaaaacattttctaagcttcgagaaagatgaaggaaaggcgcacagtttcagaaatattacacaaagggcaagaatgttattttaggacattgaaataaacatctactttattgctaaaagtttttctcctagagtgaatatggtgccaaagcatcagg

SEQ ID NO: 589 - DNA, 2163 bp, Zea mays
  misc_feature (1)..(100): optimal_loci_204231_G1, chr5:197709561..197711723, Cluster 4
gtttcgacaagagcaataacaaaagggtggcgtccgaaatcgcaaggacaaggaccatggtgcaaatgacgatcacttcaggctcttgtttaagaaaaaaaaagatgaacgcccccttgcccggaaccgtcagtatcgaagactcgctctttaagtctttaaaataacaaaaggggctgaaccatccaaaggcgggtgtgggagtgtgagacgcacaagcggcgcaggcgcagccattccattaccttcggaatccaattcagacggtacctccctacctctcatgttaacaacgcctttaatttgctttctccaattcagatggtacctcatgttaacaacggcgcctttaattttgctttctcctgggcttggaccacgagcatcgacatcatcgtatatatccacaaagatctacgcgatgggacggagcagcctgcgtgcgcgcacgttaggctgctaggagtacgctgatctcgaccgcacggctttcgttaccacgtagcaggcttgcgtattatcagaagaagaaaaacagctttggaatggaagtatggcacgagctcggaacgggaacttcggacgtggtttcctacaggcctacaggcatcaatcaatcagcacgctgatgggcttcacgggctctacatgaagggtaatattaaagaaaaaatggaaaagaaatatccagatctaaccgggtgatagaattggcctggaaggttatgtcatacgtatataacatgtttgaactgggctagctgctgcaggtgtttgaattttgaagtgtagctagaattgctagcaagtagcatgtgttggtgtcggtgtcccagctgtatatgatggattgaaaaatgggaccaactttaaatccgagacgattcggactgccgactggcaaagcgtgaaagggcatctaggctaaaggcactggttttacgataagataaggttagcttaagtgggtggcatgagcggccgatttttatcatcgtcgtacccatctgaatagcaacgctgccgcctgcagcgactggtgtaacaaaggggcttaaatatctaggagacgatctcacctttgtttaagatcaacagaaaacacacgcagacccgagtctgatttgtcaatgactcttataagcctttgttcctttacaccaatccagctctgaattagtatgaattggaattaaaccaatgtcacaaaataattcatgactacttaaattttttattcggttaaacccatcgtgtaatataatttaaaggtttggaaatttgtttaaactatggaagacatagattctatccatagctcattaggtatgaaacaaatacataaagatattgcataagtttatattagaatccattgatcaaaagaataactagctttgagagatacatggattagatgatgaatttaatcatattataggattggatgtgaggtatggattcatcaaattcagatccgaattaaatccatacacggtgggatttcatcatatgtaaccgaacaaggcataagtgtttctatatatacttttatatggtattaaagccctaccaagtttatcgtcatctgccttcacgaatccgcttttctgcagcctacccaaccccacgaagctgacgaaatttaaccatgtactatgacatgtataagctagggctgctatccatagcataaaactactcaacaagacgccactggcaaaaatccccctaaggacttgggatggattgagagggattccaattatctcaatccactcctaatccaacaagctctaaaaaagtcgacgacggaaaacgaacgaggtgaacaattggaaagccagagactgctatctgctcaaattgctatcaaaagacatgctatttttgctattctgatatgctctcgtttatttattggtttatttttttattactaatactaatgtctcactatatgtattatagttgttgcgcgtggaattattgcatatttgagaacaaacaaaaaaaaagatgatattttatcactgagtaagacatttcttctgctcaacatgacaaagaaaatagctaaaaacaatggtgtactgtttaattcttagaagaaagtgctcagatgactttccatgtggctatttttgcattgctaatttgttc

SEQ ID NO: 590 - DNA, 1895 bp, Zea mays
  misc_feature (1)..(100): optimal_loci_205474_G1, chr5:205142899..205144793, Cluster 4
tggcttgtcaaaatctccatggccaccacctcaaagaattgacagacattgatgacttcttggtgtgattcttccttctacagcagtctctgaaaccgaagccaatgcgtttctctgaaaataacctgcagaattaatcgatggtactggtttgtgatttagaatgatgtcattgcggcagagccaaatgaaccaaaacattggtgcaactccaatcaaaaagtttctttttatgtgcagctcctttgttggattcccaaatccccgtaatatgattaatactttataggacatgtctatatgaaaggcaaagaaattggttctccatatatttctagcaaggtaacaatcatgttatgtaatatatggatattgttgtgttcatatttttttatatactcaaatgaaccgacaaagaatgcacaacactggccgatgatgctcacaagtattcattaagcgtgtgcgtctttgcttgggtatggtcgaggcaagcaagtggaatggtttcaggattaaaaaagctctcgatatatcaaggatagacaacgacgaccacgacgacgatacatcccaggaacgatcgacataacctgaaactgaaaggaaacaaagcggagaaatacactacaactgatcgaacagctgcacgcgcgccggtcggtggccccagctttgggttttagcttatctatcagtagcagctaccaccggccggccgctgacctatcctgccatcaatctcgatcgcctccatcattgcatgcccgcggtggcagagaccgtgcaggacaccaactggcccagatcgacatgccaggccggcttggccggggtcaacgaccttgtggcgcgcatggcctgtctgtcgagagcgcaagccccagccgcggcgacggcggtgtttaattcggttccggtgggtggagctgcagggcgggcagagccggccgcgcgcccgtccgcgtcggtcgcgccgctgggtcgcagcgccgcgcggcttgtcctcagtcgtcgctctcgatcgatcacatgtgcctgctgtgtggcgcggttttggtggctctgttcttgcaacttccgagccatttacggccagagagatcagttggaaccaacaccaagtcaccaacccaagaacgaaggcccgccgactgccaccaaccctagctgttgggctccaacgattgctttgcgcgcgttttttttcatcccaggacctggctgcaacatacgccacaccagtttccatatatgggcgtgtgtacacgaactacgacgcacgatttcacgtcagtgacaacgccaaaaatgacggcatgcattacccgcacgtgcatctcgccgtcggtacgtaacggcctttcacatgcatcgtcctctggccgggagacgcgtgtaatactgtaatgacggctagggcgggggtatttagacagtacacacggtggtacgtatttcctcacgtggccaaaagctcagctgaaggccaaccgcttgtaggcagctagcgtgtgttgcagtatgtaattgttgcacacaccattgctaaccaagtttgtattgtatgatgacccaattaataggccttcaaattaaggggaggaacggcagccagtgcgttttgaattggtgtctcatgcatgtctcatcggccgcctgcgcgactgttccatgggggcatgcatatatagcatataacccatgacgcaacttgcttcgcgagcatgatcactgaagcacagcacagatggtttacgacttccgccaaaaataaatcaataataaacaaaaaaaatgttagcatcacctcaggcaacacgcgcagcagcgacgtcagtgacgacacggatggatgtgaaaggtaaagggatgaagcgataatactcctacgc

SEQ ID NO: 591 - DNA, 1939 bp, Zea mays
  misc_feature (1)..(100): optimal_loci_205827_G1, chr5:206917211..206919149, Cluster 4
cgtacggcagactaaccgcagctcagagtgcccattcacagattcactacaggatcaaatcaaataaacgctcacagtgacgccattcttcaacctgtccgccgctcgcacatccatcggtgacgccattccgtatgatccaagctcatcgagctgtccgccgctaattgtttaccaagcttccgttaaccaccctcgcgtctgttctcctttcctaatcacgtgattgtgtcattcttaacccactgctgccgctgtacgtgcttaggccacctccatccacacccccaaacctcctcccaacccacgtaaggcttgtttgagatcaaagaggcttgtttgagatcaaaggtaatgaagtggattgagtgggctagaatcccctactacttaattttgaatagtaagggattataggtccctcaatcccctcaattaccctttgtcccaaacaagcccgtagagtgtcatttggagagcaagccctccaatagcttctcccaccgtctagccccatatggaggagaggaaaaactacttgggtgagttctaatttgcctccatactttaatcattcaatttctttgtaatattaactcttttaagtatagtaatctgaaaataatgtgtattatagtagtataaatagtgtatgatttttcaaactttaaaaaccgataaaaaatcaaataactgaattatagtatatagggagagctagataaggtgaatggttggagacgttctagatgtgaggtatcttttagggtgatgtactaaaatataacagtaaatatagataggggaagaaatatagggggaatggttagagatggtcttagaagaggaatagagaaatggcgatggacggttgagtccaggcgaccacttgatccacttggggggtgctggcgctcgtcctgacagaggtaaaaacaccgctgtcgccagattaattgcttgattccatggccacaaactgacgggattggtgacttgtgaaggtttccttgtcgtttaagtgtcgattccttttggaatggatgtcgtaggccagtttagtcaactgacaggctcttttaagatggcttcctgtcatgttcacgggcgacctagtttggcctctggctcctcttgattggataatggctacacgcaagcgtgatgctacttcagataataatactatgaaccagaattgcagggaagctcacagaggatagtcccatctggtttttttcagcacgaaaaagagagagaatattcttcatgtaaataatgacccattttgatggatcttcagaattcggacactttggagcttcagaattcagatagacaatatctgtatgtatcacgcgaatggtttggtttgtaactgaccacacgtgcttcaggaagaagaactgatctgacatacttgcagaataatgcaggcacaagagcaagctgcagacaaggtgaaaaggattcagaaatcaggcaagtctcctgtgcgctcctatcataaaaaaaaatacgcacatcttgacaacgtctgctgcagtcactagccactaggacggaagatagagagagcagccaacccaagctagctcgagagaaatcattggcgagaatgatgaagcgatcagtgcgggcagccgccagccctccacgggcgccagaacggcgtcaggatcaggcaggcaggtcgcaggtgtcgacctcttcagtccggcagtaaaaagagagaaggctctccctttgcacccgtaattcaacggacgcattattcaccgcctgacagataggctagcttctaggtcaaaaaccagcaaggttctcgcaatcaagcatccgctatcgcatgtcaacctctctgtctcatgtcgacattgctcacaccctctcgtggctctgagaatcatatacgcctacgcagctatggcgacggctg

SEQ ID NO: 592 - DNA, 1667 bp, Zea mays
  misc_feature (1)..(100): optimal_loci_206366_G1, chr5:209717225..209718891, Cluster 4
agcaatagcataggggattggggatgacgatgacggacggtgatgccaagtgccaaaacagaaggttcttgtgctgccagcaacaaaggcgcgcacaggctgaggccttcttactgatgttttgctctgtaacatctctgcacaggcctgcctctggttgtgttgtgtgcccccaatccatcgactgactgctgtgtttctatgacacaggtgtaattttgccggctatataatagaagctcaactcgcagtttttttttactattacttgctctacagccatggttttatagcagcgagcctctctgctgctgtgtccgccgccgcgctgacaagtttgaagcggcaagcacacacacacacagtgccgcttctgagattcctcgtttgcaggggggggcaggatccggtatatgctttgctttgctttgcaggtccggtatatttctccttgggtgcagcgcgcttgtgtcatccggaaatgtcccccgagactccgagagcgacctcatctctgctgcttactctgcactagtacggcttactattctccctgtaattgtaattggttgcagcagggcaagtggagcagctccctcatcgatcaatcatcggggtggcgcggcgttacttaagtgccatttggatcgaacctttttttgtcgcaattagtgaggcgcatgtgacaccagagaatcgcacaaaacttccattggtcagatcgaaggcgtgcatgtgacttgatcgaagcccatgaaagttgagatccaactttcaagcgatgtatacagcacatggaagtcgaggctccacattgcaccatcttctatattttaaaggatcccatataacacaatttgtctgcggcgtccgctattattttatcccatgaaaacacgaatctccaggtgttctccaaatactctttcactatttagagaacgaggctttagtccgataaaatcggtattaattcttaaccagtactaacttaagcgtcggtagcgatattaactaccgtgttttcgtagaagccattagtatcgattagtgtctctaaccggaactaatattaagtaatcaatactgattgaaggttgaagacaccgatcaatattaatgtttctgctttataaacacccttccttctcaagttgccgccaagaacaacgagttcttttcatggtgccataagctttaagcatgaggtgatgtccaatttgtcctatcattggtttgttttgtgtagactagacctaaactctaaaaggcaaaaacaatccaaatgacctccatatatacacacctttatagggaagatccaaattgtccatagagtttgaagtccaaaagcttaaaattttgaggttagatcgaaaaaaacacaaacccaaaatggggttttcccaaaattggtcaaaaggttggaattttatgcacctggtgaatcaacctatgtcctttcacgtttctaagtttctaactagctcaagcattcgtaaggactcaaattcaaaagatcactaaaaattatatggagctcgagaggggaaatcacaatcgagaattttaggtaataaaagatgaacaagagagtttttcatattactcgtccttcaccattcctggtctatcggcacaagtccgtataaccttcaccttcgttg

SEQ ID NO: 593 - DNA, 4298 bp, Zea mays
  misc_feature (1)..(100): optimal_loci_207201_G1, chr5:213556132..213560429, Cluster 4
gatatcaatctctggggtcctgataaagatgtgcatggattagtatatatcccccccccaaaaaaaaaatcaactagaaagaattccataaaagaatgttattatacctagatatttcatcagacttctgtgtttcagcccacaaacttccctgtgttgctcttgaaactttcacccagtgcaatggcttcagcggggtccttttagatgcctggttggcacgtaaacttctaggactttttgagcgggctgtgctacgatcctttgcaccaaatgaaaatgctggatgtgggggagggttagaattggcaacacttcccttcgtaagcttatgaagggggccgggtggaggtggaggtggtcggattgttggtgacttctgtgaagtgttattggccacggctagcttaggaggaggtaatgggggtgaaggtggtactgatggtgcagaagtaacacgggatgacagtggtgctggaggcggaggtggatgaggggctgccacacgatttcttctacttaaggatgggaaactttgtgaagagggaggtggtggaggtggagtaggtggtgtttgagaagaatgtggtggtggaggtggaacgtgtggtgttccaggaggtggagatggaacaggcggtgttcgagatgaaggtggtggtggaggcggaacaggtggtgttcgaggaggtggaggtggaacaggcggtgttcgagatggaggaggtggtggaggtggaacatgcagtgtttgcacccgtgtaacgctttgtgaaaatgtaggtgtcaaagacggggtgtctggatattccattgttgcactgtccttgttatctagaaactgcggttgagacaatgagacttcaggtgatgatcgtgaccgtagagaggaaaatggtggttttgccaaccctgggggtgggggcaggggcgggggcggtggagaccgagctctcttttgtggagctagaattacagatacagcatctggatttgagcttgaaaatgacgctgctgctgctggtggatgcggaggctgatgtggtacgactttttctatagtgatttttacctcttcaccatgtgtcaaaggaaacagcgtcatgcctgattttgacggaggcggtggtggtggtggtggcggcggcggcatagtttcagatcttgtcgcttgaattgcaaagggcctagtgtctggattttgaggtactgctggcaaatctgtcgggagagatgctcttgcgttgctcaattcctcatccagtgaagatgaagcggctggtgacagtatgaaatcattggaacctgtagtactatcagtttgtaatttcccacgagtttcataggaaggttcttgtgatttacccagctcttcggttctcaaaagatctttaggagggactgatggttctgaaggtggagaggaacgcacggttgctctaagggaaatgttgatggtacttgtgctagtatttatgggtaacttagtgggaacagggagtaaagagacagtgggtggagggggaggaagaggaggaggtgtgcacaaaggtaacagagatgctgttggtgctggattgttttccatcagagaggaaggttcatgttcaactggagtttgtgaacaagacatctcacctgatgctgattctgttatctctgataaaaattttactgcagagtcagacatcactcgccgaggctgaaccggcgaagatgattgttgtggcatgattgtacttgaagacagttccattggtgaagcactggtctttgaaaccttaaccttagaaggtgataacaatgctgtgcgccgcattcgcgaaggagactgcactgtagtttgtgatttggattgaacattagctgaacttgaatcttggggaatatgtctcggtttagtgctgacaagcatatccaattcatttccgaccttcagaacaacactagaagaataaatttcaccagaagaactttcagattcaagttcttcacgagtatcaaagaaagtctcaggttcatcggtaatcgctgagatctttagctgggttgtgtgaggtacggtgtcttttttcccatccaaccagtccaaatggttaaagatatctagcaccttagcaaactcttcaaccccaagtccttgtttctcttgatgaataacaggctctgttgtgacatgtgaagtaactatgtccatatcggaaaagataacctaccatcaacaaaagttgcatgtaaaaatccatgcactacagtaatagtctagttcgccacttggcataaacacttacctcaaaccgaaaatctttagggaattggtcttttgcattccataacatgtctatgtgatcacggttaagcatcaagatgtttgaccggatgaatgctgtattgaacatgattcggaaaaccatctcttcacgatccagatcctcatacagatggatacactctaggacaatatcaccttggacatgacattgaaggtctattttcaccagttcatctgcctaaggtcagaaatggtcaattcctttctagtaaaggttagcaaggaagatttaaaaaaaaaatcaaattttatgtttcgagagatttataacatggaaaattattatataagacaacattagctaacagcttaaaagcagaacaatgaatgacccagcagaagacaattacctgtgaataaaaacggacaaggttgcttttctttggagttgaaaaaagaacttttggagtctgatcagggggcatgagatgatccgggccgtatatcctgaatattggacggaaaccaccttggccatgaaaatttggaaccatcctcaaaataacacaatctaatgtgagggctctatcagctggaggccactcaggcatgacattcctcgtcgagatatagcgcaaatatctcatttgagaaggcatgggattcagaggtgaaatcatctccaaaagctccaaagacgattgcttgtagaccatatccagcactttctcctcgtcggaataatgccccaggtatattagaagagcagctaacatgaaagccagaataggccagctccctcgttgacagtgcattagcagtaagttatgctgacccaaagaaagccagctttcgctggacttcaagatgcagtggatcatttccatggtgaggagtggacatccctcatagtggccagggtagtccaatacagtcataccatactcagacaaaatatggtatatagggctttcttcctctttagtcccgaaattcgagatcatgaatgagtgatcgcgaaaattttccagaagatctgctgcaatgcctctaatgtgagcatcgaaatggtccccttccacctctttcagggagaagcagtgatcaaaaactgaaacaaaatacaataatctatgagtcaaagatgcaaagcaagtgtaactccatgtagctatttagtcatgtctaagtcagttgctactgattgtacatgtactattgttatcatcatatatgccttatgaagtgattaatgtataatttgagtttttaagcaatcatccatctttcaatcattatgtagtcttttggacaaatcttaaagcattctagaatctagagagccatggtaattggtaatacatgtagctacaatgctacatatagtagtgcatttgtatttttttagatcaccggaggagatgaactatccccacctgaatttcattaccacagattccagcaaaagcaggtaatggtaaatggtagttacattgttgggtcgtgagcccagagttacaaaacaatagagtcgagaaagcagataaatatgaaagctaaaaggatcactaaaacttcctaactctctaattcatgtgcggtacacccaaattgaagctttgagagcaattgcaggtgaatggtcggattattctgattgcatctccctaagctcatcacagctcaagtaaatcaagcttagataatgcaaataacgccatatcaatcaaactgaactgctccttgcactaagctgctaggggcctagggcacaacaatgcaaataaagaaaggcacgggaaaatgcaaaggaagaactccgttaccgtagacgttatctgtgatgaggagcagaccatcgggcggcttcttatagaagaacttccggaacagcgacatgacgcggcaggaccagcagctccaatctccggatcacttctgctcgcaggaagtccaagagctggctcaactccagcaaccgattcggctcaatctttcgcgatacagctgaaggatactctctacg

SEQ ID NO: 594 - DNA, 1933 bp, Zea mays
  misc_feature (1)..(100): optimal_loci_207234_G1, chr5:213721432..213723364, Cluster 4
tgcatcgtgcagcgacagctcgaatgctcgatgcctcgatgtaaggtcagttccccaaactgcccctcatgctccacttataactataaccacttcatattgcatgagaaaaaatagcaatcgaattacttcaaaaaaaatagcaatcgaataaacaatcaattcttgttcggaagaacacaacactgccgatcgatccagctaatcttgctctggctattgttccgtgcagtcagctgttccccgggttatgcctgaccgagatcaccgccgacgcctacaaggtcccggtccccgatgagtagcaaagctcgccacttgctccgccccttattggacagcctgaaaacacatctagcaggtttgttccttatatagagcatcatttgtctcgcgtcccgttttgctggcccaggcaagcaagtgtgtcatttatcttgcataataatctctccgttcttttttatttgtctcaccaaatattcaagaatagagttaagcacaagagaaagatgcactataatttctacactgtggatggagcaatttgcatgtattgatttgtggatggagcataagtcaacctactcagtcggccagtctatagaacctcactggttgttggtcctctatcaagtgagtggtgccacattttctatgacgcccagtctacatgagagtgttcacaccttccaaccgaagaagacatgttgttttacctctacatttagatgcacaacaatgcagatctagccttgagtttgtctctgtctaaaccacaatggttcagtgcagggcagctggacaacatctgctaactagaacgggatagtcgatcacctgaatggtgacaaattcatcattgtctttgtttaaaccacagtggttcagtgcagagcagctggacatcatctgctaactataactggatagttgatcccccgaacgatgacaaattcatcaaacttggtgagattcagggaacaaaaataaaggcatgtttcgggaaaattctcttatatttcccattttatgttcttgaaaaacttggaaacatgatctaactacatttaatcttttcaactttcctcaacttgaacaaaaaaaaaacagtggtaaaatttttatatgcaacttgattttccacatgtttttttattttggtaacagtatgcaacttcatcataccactatgaaactgcttatagatagacaagtgtccattgaggacttgtatctaaacttgtttgctactttcatattgttattttatgttagagatgttgtttgtcatgatcttgtgtcaagtatgttctcatacaatatgtgataattttttctcttttttatgtatagcctagccatttgtggagagtttgcctagctaactgcccagagcatggacttcacaacccacttaaatctccagagaagagtgtttggctatcttttgtttgaactgtatttcagggctaacttattttggttaagaaaaatgagcaatctaacatgacagattattaagtctgaaccacttatatgccccctgtcatctgaaactctcattaatatcaacatttttgaagttatttgtttgttttcctcgatcgtgagcaggggttgcagtttttagttattgtccttcactcataaattaatgtattttttgggagcactctgcttatgccatcatctacatgtttgtaattgcagagtcatggtggattttgtgtcgttacatatttgagtgttgctccagaaaggcccgaaatatgttcttttgactggagggctcccaccaataggagggccttgcactgcagatacaatgtatatatagagcctgcttttaaacaggctcaacgatcaaaacgagaagtactataataggtatccccaaggtatacatgtcgtccatgaggttataagatac

SEQ ID NO: 595 - DNA, 1478 bp, Zea mays
  misc_feature (1)..(100): optimal_loci_209266_G1, chr6:9504204..9505681, Cluster 4
cttcgacggtaatttactgtcttcagacacatggaccaatgtgcttcagttctgcccgtttgcttgcttctactacccttcccttaccacccatgcatgtgtacagagacctttcatttttcagaaatatgttgacatatcttaatggtacaccaatctctagacatcaggaaatacttcccccaaaataagaatattaaagtgatattcctaacactgatgaacaaaaataatattaaagaaactagtacaaccccgtgcgttgcgacggcacaaaattacggaaacagagctctcgaacgtaactgtcgctaccttcttcgttcgggcgtaaccgccattctcagatcatgaagccgtggcgaaaacaacgctcgtcattttcgtgtgcaagcatagacccacgagtgggcaggccgcgcctgtatcgcgccttggctgtcggcttctacaatggacgtgtggccctatcactgccacggacgagcgtaggctagcaagctccactaacgcgagcgcaggactcgcctccatggatacgcgagacttgccaacttccatgtcgtcctctgagcacacgcacatggggaactactagatgggaggcttggaccatagtttaattataaagaaatgtaagaagaggttaattatacaaaagtgttgacggtggaaacaatggaaactgatgctatatagaagtagagaattactatttattaatgaccagttcaacttgatgatctggtagtattgttaaatgctttgtcaagcatggccttctaaacataacggttcaagtgtgctattttattttagaaggtctagagcataagtgttctggaactcgtgctaaaatttgaacaagaatgtaataaggaactagaatgagaacctaccaataaaactcacgatgaacaggaatggccacacagtcctagctaaaccttctaagcatttctcacaaaaaggttggacatcaagtttcagcaagaatgtccaaactatctcttcgcgttctatggctacttcccttacatcagacacttcagaagagtggggattatcccactcaatgtccccgaccatagagatatggactccctcgtcatccaactaaacattattctttgtaaccggcattgaatctatatcacttacgcaagcgttatcaacattattatcatcttccatgtgctccggagcaatagatcgaagcaccgagatatcttcacaaatttgtattgtgctagtctcttgcctaaaaacatataatcacccatcaagctggcactacaaggatctagattcgacaaacttttgactggattcgacaaacttttgactggattcaacaaacttccatgtgctctacaaggatctagatatcttcaccttcacgtagaaattgtaggttttggaattcaatgccaacaattattttggttgttggaggctataaaatacacccctaacca

SEQ ID NO: 596 - DNA, 1623 bp, Zea mays
  misc_feature (1)..(100): optimal_loci_221602_G1, chr6:90534754..90536376, Cluster 4
caagatcatttcgttcccgatgtttcttcttcctccaacaaacagttgttcatcttcttcaagcctcctctagcacttggttcgaaaccctcagccaaatactattcctttgggccaagtctggaagagacgatgagtcatggcatgtgtaagggcagatgtagtactgattgtagccatcagttcacgtgctgattcggttgtatgtccattcgttggccacaaaacaaattaccactctgttggtactcgaagctagctccaggcagctgatggccaggcaactactatctattccattgaaggcagacgaccattgctgagttttttcaattccacagtgtaaataaatctacatgtagagcatatgtgtagttatagcaaagactcatccatggacctcgcaaatcagaagcagtagtgcatacgatccatctgtcaggcatggccttgtagttgtagtaacagcaatagcgtcagtcctccctcgtccatcttgcgcttcatgttcattatcaacgaccccacatgcctcaccttcaattcaatctgcgttatctacacctctgaaaatctctgcgctcattagtcttgttgtgtcgttcctccattcagtgcagccccgtcaatcttttaactgctgggactcagttcgaagtttccgttgcccctgccctccgatttccttgtagctgtagagctcccaggaggaccgtggaatcagtgcaagctggttgcttctcatcctcttctgcttccacccatcagcagcaccaagctgtttgtagctgtagtttctgaacgcggtgtttccatcgaccacataaacgtacgtacgtagagaaagtcgtagtttaggcatggcaggtatcaggacatgcaaacctgctacaaacatcgaatcaaccatacttggtcttcccttcagtagctagttcatctctgatgaaggatggagtcatccctgatggaatctgcagccagcagcgagattgcaccatggtagtgcccaggggcggaaccaagattacagtataaagggggccgaccaattcatcaataatatatggtgaaaaaacattgtataatgttattaaacttaaacacttgcatggaataagaattctagttctttataaattatcttagtacatgaatctattttctagctaattaatatattgaactaaagtagtgttacagtaacaataacaaaataataaagttagtcatatttggatctaattttgtagtctatgcggacgttgtggctgtgacatgtgattctgataatcgatgttgttgggctgttgggactcattctgttgcttcgcatgatcaccttctctcgactttggttgttgggctatggcagagacaagtaaagtggtcgatccgaagctgtccagccagatgataagataaatcataaaagggtgatgtttagatatcaacgtctgcaagcgaattaggtttgacatctcatgtcattgattgatcattcaacaaatattttatcttataatctttgtctcttttaaactttggttgtcatattacaataaagttatgaatcatatatcgccaaccactatattaaacatgcgattaattatgatgcac

SEQ ID NO: 597 - DNA, 1725 bp, Zea mays
  misc_feature (1)..(100): optimal_loci_225892_G1, chr6:112953156..112954880, Cluster 4
cgatacaagcttagtttcaatcattaaggcaatgatcaaattcggtttttagataccatcaagaaggcaggtatttggagttgctggaagctatggcgtacgtgcgtattcaattcctgtgcggtgaaacagatagatataaatatatatatatagcccaactaggtttggtcgcatgcatgagcttggccgatcttaattctcaacaaaccagattgtagggttgttaggataaataatcagtgaccgacagaagcttgtgactcgtgagaaagctccatgcatgcatgggtagcactagcacataaatgtgctctggatcttgtacgagctctcatggacggacagtttaatttgattccaagactgacatgcaagttgctcgattatctgaatgccgttgcctgtaagcaacaagttgccacctacaaaaagtgcaatagcctccatttgttcccggtctagccgtacgtctagggcattcgtagatcacgtacggaactcgtaatataaaaagatttctttggcaacgtgcatgagatcagcatcgtaataaccgtaattcaccgtggaataattcattggtcatgctgtcgttttcgtgctgacgatgagctatcaagagtggaagctgatggttgtgaaacctttcattttcgcataccctaattaagctataccttttgccttatgctttatatcttgtaaaattccttacttctattttactggaattagctctcggcacaaaactctcttgtcgacttctaaaaaaagatcttggtttcttcaggcttcaacgtatataagataactcgtcaggtaaacgcacacgtggttggtcgagaacgcattctttgcacacgcaaccatgacaacgcacgactacgacgtacaagcactacgagagggggggtctatcaggatcgcaagcaccgctaagttaattcttgcaaggtagtatttgactagcattatatatggacacaattaagtacgtactaacaagagagagagagagaacaacaaccacaaaacgtggacacagtgcattcgaggacacacgacgacctcgtcgttatcacggcaactgttggcgtttcatccgtttgccattcgaggaccggccggaggcccgaacggtggcggtggtggtggcggcgccctagctagctgctccgatcctcccttgctgcaggctgcaggctgcagcactgacctgaaaatatgagggcgagccgacgaaaatgcgcgcgaacaaccttcgctcgatctccgtttgtgtgttgtgtggtgcacgtccatcgtcaatccgtcctttcattttttttttcttctcctttttggaaatgcatgtgtggtcatgaggtctcaatgtctcgtgtcgtatgcaccgtagtccgtatgtatgtatagtcgccaggcttgacgatctgatcgaaagagccatatgcatagcacgaatctcgggcgcgtgatggacagatacattcgtttcagtgtgctgctgcttctgcgatagttaactaggggtgacgtacgacgctgccatgccaaccgcggccgtggcggcgtcggcgtggggacgacgcgagagcgagggctcctgatgcggcaccttggcacgccggccccccgtgtgacgtcgcaggcggcatcagtggagggaggatttcctgccgactagcttcgttcagggtggtcctgtccgtcatgtgtgttggt

SEQ ID NO: 598 - DNA, 2618 bp, Zea mays
  misc_feature (1)..(100): optimal_loci_232501_G1, chr6:146236572..146239189, Cluster 4
tttttgggttagaggcagtagtatatttaatattataaacattttttgttttttatatatttaatcagacttaagatacgttaacaccttaaaataaagacgagacgagaacctcatatgaccgagacggagtaaatatcaggtttttttttacagcctctcactttcactttatgagctaggaggatatggtgacctgggcctaggaaatccccacagaaggtgacgtcgcactgaacgatagaaaaggctccgccctctggcattgtgcaattcgcccgtcataagttgcgttttaatataaagataacgtacaacaatgacccttttgatcgatttttaaatataagatatatttaaaagactgcaggatgtaaatctaagcattcagatcataaacatagttaagaaataatatgtacatgtatataaattatgtaatctaggtatataaattatgtaatccatttaaaaaatatgtgtttttttatcttaacttatttgagctggattatgcaatcttgaaggtaaacaaaataagactttaggtaccgtttggttcacatatttgtaacatgaatggtaaccgataacgttaaactatgtttggttaaatctaaccataattagataacacggtataaattgatattgtcctattgaaactggttacaacttgtaatcaagtgtgaaccattacggttactatttacattacaacttataaaccaaacgacagcttagttaaatatagacagcttgaactttacatatttttggacggggcacgggaccaatatcttgtgctgcctgatctgccgacggccatacttccgcagcagccaatggcacgtggaaagcgtgcgagtgcggcgcaagaatttcaagtcttttttgtttttacctcgcgatccaggaaccacggttccgggtagggtaggcggccttctgtcgtcattggccacgcacgcgcgcgctcttgttttgacttttgaccgacggggtggattcagggatcgaccatgagagaggagagatctctgactggccttcgctttgtgcgaacgaagtgcccggattttttgtgttattgtattttagtagtttttttccaataaatcccacgtttacgtctatgaggctaacaagtcgcaacaaacgccacctgcagtcctgcacgtactgataatggatccggcgggtcggtcgtctaccactcgggaaacaaaatggtgttctcccctccttttattattactattaattaatcatcaatcaacacggcagcattgttctcttggacttgtcagtggctgatgtgcactctatttcgtcctttatcgacgtctgtccctattcctgcaaaaacgatgccaattgatcgacagtgcaaaagcacggggtgggggtcgctagccacggttgacgtgctccctctccgagcgtccgccagcaggttgtcgtggtgcatccagtgcttgcctgcctaggctaggagtgtcaacgtcgcctcctctgccttgagttgagtgacaacacaacgacggaccggtcttgttcttgttacgcgtgggcgtggcgtgcccgacgccgacggagaaacgttcgtcaatggactgccggccggcacagttaatgggtagacccgtacaccgtactagaccacagcatctatcgtaacccttttgttttaatctcagcgccgccctatcaattggcagtgagtgcatcacgggccgggacaacagatgagatgcaagttcttatcgcacagccatcaacagagatcatttctttcgtatggtggctttggcatgggcttgtccggaagaggcagtgttgttggtacgtaaaatggattatatttcgcgagttcggattagagtaggctgttcggactggcagaatccttcgtcccaacgtggaacgcttgtaacctgctgcttttcagcgtaccggaatatgagggatgtgcgaggctgggagcgagactgttaatttttttttagataatgggaaagaaaatcccggcatgttcatccgacatgataatctgatgggagctcagaatcccctgcccggttgaataatgatttcaaatttgcccgtacgccaatgctgtcgaaatggactagtatatgagtagcaggaggagcctaggaggaagagtggtgagctacaagcagccgctcaacctttccttttcttgtaagtaacaacgatggggacgagaaaggtagcaagcaactctcctgccaaacaatatagagtccagattgttgggtgcctggccggccccataccgtggtgcggttttctcgtcacagggtcggtctacgtcaacaactttattggtcctcctgcctgcctgcgtgcacgtttgatttctcgcgttgttgcccgaaccctccggaattgagtttttgtcgccaggtgtgtggcgaggaactgggatagaagagctgactccgcgagcagcagcctagtcgggacaactcagataagctaggactatttctatttttcatggacagtaagcataagctggtgcggtgcgaggagagtatgattagtcaggtttgcaaatactcagacgttgtgccgtgccggtgccggtg

SEQ ID NO: 599 - DNA, 2316 bp, Zea mays
  misc_feature (1)..(100): optimal_loci_232755_G1, chr6:147307467..147309782, Cluster 4
tgctgctagctgcccttctctcgatctgcccatgcatgctttttcatgtgttctcaacttctgacgagccatgacgatgcaacttctctcgatcgatctcgtgcgcttgggatcggagccaagccagaatgaatgccataccgggacgggatgggggcgtcttgcattggatgcaatatgcatggcagcatggtgctgtcccatgcatcacacaaccttttttcaatatacattggccggcctggcccccgtacttttgttccttccttctattgggactgccttggacatgtacacttccagccacggacatatctgtctctgactgattatcgctcatcctgtccggggacgattaccagatgtgcaccttttgcttctttcttgatatattgcacgcacatatatcgatcgatcacactcgctagctagtatagtagtataaacgctgaaagcaaacagctcgatataaatgaacatctttccatcgcctgcacgaacacacgatcaatcagacgcgccatccaacacatacgtacgtcgcaatgcaaaagcaatgatagctagccctagctccagagaaagcatgcggtcgggtggacgacgatagatggtgcgcgcgcactacctgtggacacgaacaagaacaagcgtacttccgtgccatcgccatcgcccatcgcgcacggccgcaccgcacgtaccaggcgcatgcatgcatgctgctctgccggcaagacacatgcacaatcatcttacaccaccgtaccacgggccggatgtgcatgcctggcctagtggccagctgattcgttcatcgagcacaattcatcaatggtcggcggcggccgccgggactgcctgcgccctgcgcccaccgtacgtgccacgagatgagcgcggccgcgcgcgggactgctgcctctgcctgtgatgagcggggtggcccgtggccgttccgcaaaccaggggcgtcaaagttgtggcgacttgcctcgcggtcccggccggcctcccgatgaagaaactaaaaatcgggatgcaaatcagcaaatgggccacaagcagagcgaagttgggggggggggggggtgggggggggcagcgtacgtgggcagcccggcgtttggatccatcttgtgaattggaaaacatcagcccagcaaaatccagacagggtgctctagtggtactactacttctatactgctcgtccacaaactcccagtagttactgaaaatttggtataatctgaattgttgctatctcactgtatggtgtatgaactaaattcagtttagctccctgttttgttaaaccttatggaagcaaaagatctacgagaaagcaatctgcaaaaaaaaataaacaaacaatcataaacagacttttctagcgagagtttactactgcagttccccgggtattgaatctaggggagcatacctgtatgttcttactgcaactatattattctatgattgttttgttgtcacgagcgccaccaataatgtaggtctcgccactttctttttacaatgtatggatcatcacgctgcttgtctatatgtttaataagatatctatatcagtatccagctttattttttaatactgatagacatctactgaatgcaccaaaaatctgttgttttgcgtgcttagtttgatttgccaggtctaagtttttaaagcaaacatgagttctttattatctctcttttttcaactgtctgatgcacattgtaattgatttggataaaggcatttaaactataattcctgcagtaccaaggttttcacgttgtgtttaaattattaatcagtggcaggggcccaatcccccatcccccatgatgccctccactactttaaccgacatgatgtcaaactcaaggatatccatgcaatcattacagatatctttaaatttagtggtatgaatggtgtttctttctttttgttgcattacttgggttcttattagaggatgttacaggcttattgatatccccatgcaatcggagtgtaggtttttaagggagaggttcttttagaccttctaaggtaagatctttttctttgtggttatgcagttcccctatgccccctatagtttgtgttctaactgtggcattcttataggtgaaggtaatgctgaactgcatgactttagttctgaaattctacccaaagcattacattcctctcttccaaagccatctaagcaaatgaaaataatcgtccatcataaaataatcaaagggaggggctactgtgctcggaatcaaataagaacacaagtaacatttacg

SEQ ID NO: 600 - DNA, 1423 bp, Zea mays
  misc_feature (1)..(100): optimal_loci_233284_G1, chr6:149330943..149332365, Cluster 4
atctagtatgaacacacgtactatgtatacggatcggaagggaagtgttctgatgaatttatataggtgcgtcgtcgaacggctcgtcgaaagtgaaacaggcatttggtttggtgtgggtgcagccgtgcatgtgacatgcaactgagctactggtgtttagggttgttgctttgcagatcttttgccgcccgggcgacgacgagatgggctagagagcacgcagcatggagactggagaggcgatctggtgggtgatgaactgatgatgcataatgcatgcaatgcaagcggacagcaaaccggctgcggcggctgttgctggtagggaagatgcatccagcagcagcaagcctggtcatatcggtggttagctcatcagggttgaggccggggagactattgccgattaactcgccttgaaacccagaataaatgcccgagtaattggagacagcggagggcatgcaatgcaacggggcggccgggggggattcctttcttcatttcctgcgtgtcagagcggccggccgggcgatcagtgaaaccacaccgcgcgcgcgcgcgcgcacagttcatgccaaccctgtcgcttcaatgcgttgttgcaaaaggatcacccgacccgatccgaatcgaattgaagcacactgctccgatcgaaccagccagccagccacgtaaatgcggcgaattgaagcatacatagacatggttgcgtgccatgtgttgctagtactgcgctatcgctaggaggcaggcattccactgtagtaacctccatcgtctccatggccatgccggctgctccatacagtaccgatagatcagagctagcacatactactgttcgagtcaacaagcaacagtgtgacagtacagcacgctgcgcaaaataaaggacgctttaatttgttcatgtatatttagaattattgtatttatatatatggatcgaacgtccaccgatattacttgtttcgaataaagaaggaatacaaaggagatgtactacataaaaacataggcaattaattcttgccagcttaattaaaccaagcagcataatgatggattcattagcgtaatcactcgaaggcatgggggctctactccagctctagtctggtataaagaccagtccggcagcaggccagtcgtcgtccagacagtacactgatgctggacttgcaagctcaagtgactttccatgcagctgtacgagtatctgtcaagccatagcaaacctacttttaggcagagagataatgtgtcctagcctttgttgcattcagcatcagtgccgaacgtaggacgaaaattcacgaggggtccaaaaaccacgtgacaaaatcaagtaataccgtaaaaactagtgttgcgtagaatttaagtttcatatcaatagatacaagtccaaaga

SEQ ID NO: 601 - DNA, 2391 bp, Zea mays
  misc_feature (1)..(100): optimal_loci_233379_G1, chr6:149677823..149680213, Cluster 4
aaggatggggtgagattattctaacttgacccatgtttggtttagaggtccagagtcaggatcaaggaatatttttcaaaaataatgaatggaatcatccctcaaaaaataagaaaaataagggacgtgatcaactcagggttaatcctgtcctatccctcgttgacaccgaaccaaacacatccttaaaaccccgccatctccggaccaaccccactacaccaggaccttggcagaccatagtatagtagtagctccgtacggcgacacccatccgctcccggcagcagtcgctgttggcatcgtaccacgtcctacgcgtgtgtttgtttaacaccctgcctccgttttgcctgcgcagcaggtcacctggatggatgttttggttgcgaacctggacgtacgcatgcgtgctccagccaacaacgccaggcggccaggcccaggcaagcagaaaaacgatcgcctgcctggatgaaactgaggttgcctgagcattaatgatgaactgtgccgcttttgttctattaattagcaactgttctcatattaatgttttacaattgtactttcggatctacactatgggttcttataccggctcattggttatctggacgagcgcacccacgctcgcccgattcaagctgatcggaaacgttttttttccgtatgagtggatgtagctaaacggtctcaaactgatttgttttgcctacactcgtgcaactcatgcttcagatatacagacaaccaaagaaatgcttagataaagtcaatacaagtagtgacgcacgaggagaagatgcaaccaactaatgagaggtaatattgaattattattggaaattcttcatttattctcatgttattcaatcaaaagtgtacaccacggtcgtagtacgcagcaaccaaacgcgtctggatccttgcaccggccgtctggccacacatgaaagaaaccatcagtttccccccagacaaattcttgccagacaagatgacgaggcacccaacccaaccaaaccaaacgcggggccctacgcccctacgtccggacgagggcgcgcgcatatggctccaaccgggcggggcgagcccacctccactgttccgaggtcaactgccggagacgtcgccgcccccagcggacagcgtcccctcaccgttcacggctcaccagacggtgtcctggccgacgccgccggagagcggccaggcgaggcgtcgctgtccttggaccccgtttgcattgccagccccctgtcccggtccctgttcttggaacggctaggagctcgaaagcgaccggcgcgggaggagtcgtgcgccgcacgtacgtacgggtgctgtcgtcgagtcgtcctgggatcatttcgctctctgtgactgtgagccgtgaggtgtgtgtgctgcccctatcagctagctctgaattctatgtgcatctgcttcctcttgtcgagctgctggctgctgctgctgcatcgtcatcatgttcccgtcgacggggtcggccgcgcacgagaccggccgtcgcttggctcccctcccccgccgcgcgcgcgcgcttgccgtctgattcaggcggcgcacagactgtcctaggagacgggcaaatggctgtgaaggctgtacagccaggtatctgaaaagtggtgacaacatttgctgcatgcttgctttcggatgacagcgaattgcagctgtaaaaatacatcagctgcagcgtagtttgcagtgcacgataccccaatcaccatccacgtacacgaggtgtaggatagactgccggcgtcactgtcccctggagcagatttttaccccctttctagctctctatctgtccgagctgcaggggctgtgatttcgtggacaggactggaacgcattcgctgcacatggttactggtggttgctgctgccgcacatcgtgtcgctctgccgatgctacctgacgaaagcttgattgcgccggagaaacgagccgcagcgcgcgtgcaggacggacggacagagagtgacgacgggcatgcctacgcaccgagtaaaacgtccggtgtcgctattcctcatccatcaccaattatttcttcgctcccgggacgagtgaatctgtgcctgcctcctcctatctgtcctcctctcctctgtcgtgagtacatgatatttcttcgccctccgatccccgctgcttcgttctgtcatgctcactcggtgctgaattcagatgacgcacacatagctaatacacgtctaaacaaaacaagatggaagccatataccttcacttgtcgcgggccattatataagggtcgtctcagctcaaaaattacacgatagtttctgtgtgcagttaagcatatagatttctcatttagagattgttga

SEQ ID NO: 602 - DNA, 2197 bp, Zea mays
  misc_feature (1)..(100): optimal_loci_234254_G1, chr6:153795008..153797204, Cluster 4
aatgacagaaatagcttggaacacgatgcacaacgcaaggaagcaccaacgcggggataaataatgtgtgagcaacaacgagagagcacaaaggaaaaagaacgcacaaatgtgtggagaagggagagaaggttggtgtgcagagaaatgagtgggataaggttggtttggtggaacatagaattgaatggagggtagtaatttctttcctatttaaatttgaagagagaagattctttctacatagatcctctctaattctatgtctaccaaatcagtcctaatagagaaagaaaggagaggtgaaaggcttatttgttaatgcacataagtagcgggggagaggaataaaagagaaaaaaaaacaatagtggaaggggaagggaaagagtgccagccaccaacgaactatgcatacgaaatgaatgcaacagacaagaaccatattatttatataaaattgattttaaaattaaagtgatacacaaataaatcttagaatatattagaaaatagataatgatatttattttagtcccaacccaaaatgaagattttggggtgtgacagttcccggcggccgggccgatgccatactatcttgagagtctacctcatcatgatattcagcaattaaatattctgtcctttgtctaatttagattttatgttgatacgtgaaggtctttactcgaacaatttgtccggtggtgtggttgtgcaatctgcaacgttacatgactatgaatctatgatgatggaaatatgttttgcattttttttgcttctacctgaaagtggcaacagaaaggtcgttagttgctgctacttgcaagttgcaacattatcttgattgaaatgatgtatccctgtacttggaatgtcacctatttcaaggccagggatgtcaagctgatacatgtccttttaggctacatggaattttgccatgagtttctacctgttgtggttcatcggctcagaggaagttcatcatcatgttgccccctttgtatttcaagaagtataccttcatggtctctgtctcatccgagctatttcaataggtattcagaaaagcagttgtgtttattattgccacaagtggacggattcaaagaaggcctcttaagaatgccaagcatagtttccgcttctgtttcagagcttgtgcaagctcgccgcctccgagcctgtccagggggcgttgtctagcgtccagttcacggatgaagacgatgtcgacgcccaccacagcacgcttttcaggggctaccctcacaaccttaacagcagacactctgccctggccccgacgagaattctgagcacattctcttctagtacccgatgacggcggcgttctgggctcgggtgcgcgtctagattgaccctgcgacaagcgcaagaaaaagaaaagaaaagctctaggaaatcgagggccggaccgcgtttcccacgcccattggcacgcgctcactctcctttgctgctggaaaatttggaaacatggctacgacgtcatcttccggcgcgatgacacgccgatgaaccgtctgacgcgctgctgcatcgatcaagagctaagaaacggcgatgtcggatacctgctagggataattacgtagtaacagaatggtgtaatatgttcttagccatacgaaatgttcgaaactgaaccctccggcctgtcttgcaatcctatttggcttcttgggctgcagacatttacaataacataatcaggtggggacgctcccctcttgaccgtaaaatagggtatctaattaaactaagctgacatggtttttttcttctctggcatggacactctaatttttctatgaatccagtggttatgagtgaagcgatgaataattattcgaatcggtacgactgaagatgcgatcgattattttatttttcacacttctacatgaccttttgcagctctatttaccaggtttttgaaggacatgcatggtgcaatggtaaaagctcaggttgtggattcgaaacaacctcttcgtatttatggagaacggcttgtcttgggttatcgctttcgtaaaccccactcactcatgtgtgagagctcgtgtcattgactggtttaatgttaaagtaggataaagcgggtgagacaatatcttctcgatattttaagattacgccgtcactaaaaattacttcgatg

SEQ ID NO: 603 - DNA, 1541 bp, Zea mays
  misc_feature (1)..(100): optimal_loci_234857_G1, chr6:156527053..156528593, Cluster 4
tcattttgtccttcgtattcgtataataatatatatatgcgggtgaatcgatctacttccagagaagcgttggtactcgtcccgagggtatgagttggtacttttttggtactaaaccaacggaacacggcaggtacatagtaatacgttattacaagtactctccgaatttgaagagttggcgaagcaaaaaaaagtttgaattttgaacgtcgtctcagctgcattgcataaataggagtaattaattagcaagtactcatacatatactgccatgcaccttgctaccacaacagccttgctgcttcggtgtgcgcgtgtttgccgaaacgtgagcgaggttcgtctgtaagttttcccgcgttttatatatacaaagaaaaaagaaactttcgcgtggttcgaaatggagctccaaaccaaaccacaccgcggcagcggcactgcctccatgccggggcggggcggggcggcgggaccggaggacagggtgcgagcacggcggggaacatccggacgtggtggcactggcggcgcgccattgttcgaggccgccgcttggccgcttgtgcgtgccttatcctcgtctctgtacgtacgcttctggttggatggctagatcgacacgagcaggcagtgacccacaaccacagggtcaagcagcagagcaacttctgtccgtctgcaggtcgcagatagtagtagactagtacagtacactgtgatgcggtggtggtggcagcagtttaacacttttgtctacaaaaaagggaggagtatggttcgcgtggatttcaggatatgcgcgatgcacagctgcacacacagagagctcctccgcgttgtttcgcactggaacgcgagagtgcgcggcacgaacgacagtagaaggcgcccccaacttgtcatcagataaaagaagctactacgactacgagcagtggggactcatcaagccctttgccctttgccctttggggcgcttccttttggagttgagccgcaaaggcggccgggagacgatatggaaagctgaaagggcaaacccatacaatcataggtgtccgtggcacgtacgatcaagcgtaatagcagcgcatcgcggtgctctgctgtctgctcccaatttgcaccacgagctagctctagcttgtggttcggtcaaggggagcatcacgcggccatgtgtcatgtgcggcacagccagccccacccacgggattatccaccatcatcattctcaccacgagcagatctagacaaaacaaccattaattttatctccattaaattataaaatcatcaatttaatttatttaagtgctaacaaacatacattgtaacgaagattaataaaatttattggtgtcacaggacacaaaaaaagacaggatccgcccccgattctccctcactaataataaggtggtccttgttgctgttttgtccggtgagtttccgcttggttaggtttcgatatcatgcatgcacgcgtgttgtttttttttaatcttgatttgcatgagatgatggtactact

SEQ ID NO: 604 - DNA, 1645 bp, Zea mays
  misc_feature (1)..(100): optimal_loci_235792_G1, chr6:161353835..161355479, Cluster 4
cgctgtccgtggggcgagaacgacggctcaactcgcaggagggaaaaggcattgtacccaacaagcctttagtatcagaaattctcaatggatggatggcatcacttcactggacacacggttgttcaaatgaagaaggtgttgcatgttgattgattggacattggataagtgagccttcttcatctcgggaaaccctaaaggcccaaccacttgagatggagtcgaacaagcaatcatgcaaccactcatttctttgtggtttacctttgaaaagccgaaagcgaggtcctaactcgtgggttgttgtggtgggacgatgcctggctttgtgcggaggcggagagccatgcctgctggtatatatgcgtgtaatagtaaactatctccattccataataaatgtacttctagaattcaaaatttattctaaaataaattttagaataaattctataaaaaaaaactccaaaggtctttaatatacacctaaatttaattaaattgcatatacaccatgcctatattgaaattaaacggaacaaaaagaaataaaactgatgccactagtttttttttctaactggtcttcaacaaatcaacgcatcgctcacaaaaagactttcagctcactaataaaaccagcaaaccatggcagtaaacaggcactacactgcacacgtacgtcagtctaggccacacaaactcacaacacaccgatcttaatacaaaggttgaatacctttaacttttaccagatatataagaagaaacggaccattaatgtttatgacaggtaatgtctaaatatttttataatataaggttatctgaaggtataaatattgttaatattttgtataaatctagtcatatctaatgaagtttaggccgtacaaaactcttggctggcttttttaaagcatacccattagctaggaatggtaaaaaaaaatatgcactacatccactaagcggataattatcagtttttttctagagttactaatatggatctatccagacacggaggaggaaagaaacacacccttgtagcctctggcgtccggctttgctttcatgcttttgtcgctgaccttcttttgtacagtatacgtgattccacggccggctacagacatcgtggacaccgacgagtggtaagcgacctcgtcgagcgagaaagctccaggcgaccgaacgcgatccggcgcgttttgtctctccgatacccagcccagagcagtgagcacccccgcccctgcgcgccacgagagggactgggactgaccacccatgcggacgaggactgcgcatcggctcacgcttgggcgcttggcggcctgggcacgggcaggcatgtgccgcgcgctcgctctccgtttcctacgtttccggcccggccggatatggatatcaggttccgtcagcccaactgcatcacacgcgcgatcgccatcccgcccaaaatgctatcttcactcaccgtcgatcccgcccaaaatgatgtcgcctcggtcggtacctaataataaataaacagtctatcccataaaataaaataagacatatatatttttgaaaatgtttttaatagtggaactttgacaattaattattattttttaaatatgatatcaacaaa

SEQ ID NO: 605 - DNA, 1868 bp, Zea mays
  misc_feature (1)..(100): optimal_loci_236675_G1, chr6:166066751..166068618, Cluster 4
attcatcacaaaacttgtcccgctaagttgaccgtagtttgttcaagtgtgcagtcgtgtgtattcagtattcatacatggaaagccctgaagcaacagaaaactgcagtccagcgtctctctcgtatgcctgcttggccagaatccaaggcacatgctctcctagttcgagcgtgtgagtgaattgaacccggtggcggtggtgcaggcagggtgtgaaccgaagtctctcccgcacgtgtgtaatgcatgcaccgaggaaaaagcaacgggggatgccctgcccagtgcgtgtcgttagcggcagagcgtacgtgccaatggcatgcaggcggcgtgccggacggaggagcgagacctagggagggtctcagtagctagctccggtccctgtcacctttcctcgagtttccaacgccaaccaaacctaccttaatttctttaatttcgtccagagtggaattctcaagagttgcgtttgactagcatcacgctggcgtcaacacagaggactagcaggacaagtctctctagaacctgtacgcgacacgtcatgcaatccattcttggtgacggactggactggagtgcggactgcggagcacggagctgggaggggaagaccgtccagccgctggaccggcgccacgcacagcatagtagcgcgtcaaataacaaacaaaatggtagcctaacgttaggcgcgtgcagtgtcaattgttaggctgacactgaatgctaatccgagcgacaacgcgtccattgaatcgcaacaagctataatgatgatgaccttgaatatacatactactactgtattatctagctgacgcacatggccgacgctgatgtgagcaagacctgtgtcgccgccgccgctcgccggactgtgtgcgacgtgcgccgcccgcttcttcattcctgaaaacaacagcgcccgcccgcacgcagcatgttgcagggacgagaggagagaacacgacgcgacggcgacggcgacgcgaagctgagcggaaatggcccaaggcctgagtcccgtacggccccgggacggtcgtcgacttggacacatgctccgcgccgggccggccagaagctaagcaagtcaaacgcatcgagcttcgcttcccgctggcgtagtacgacgaacgtgtgtgttgggcgcggtggagacgacgacctgaaagcaacagttagcgcacgggttcacgggctcggccggccggtcagggctagctgcatagcgcaatgcaatgcaatgcaatgcgtgtgctgtgcgaactgcgacgctagcttctggctgggtattccggacactagcaaaaaaacagaggtgactgaccatgagatgggttatgggtagagttagaacctaagtggatcggagctggccgtgtgtgtggtgtgggtgcgtgaatcgagcaccatgatcggagacaggattggcgcgaaagcaacacaacaagtacccggcccggccgagagctgcaggcttcagatcgatcggctcgcgatcggaatgaagagcaaatcatgcatgcatgccgccgcttcaattcatcatgctgctgtgcttgtgcttccagctcactcgtgttccgtactagcgtcggtagaaacggtgcccactccaaccctccctccctcctccattaggaaccaaagacatcatgtcggctacctgtggcgcgagatcatggtcccaaacttacataacggacgtctaaaccgtagattgttaggctatggccatgagatcgtgcaatgttgactgcactgttttgcaacatgggctgcaatgtttatatatgtacaagagatgtagatgaataagctgctggagatattagagctgatctcagaatccg

SEQ ID NO: 606 - DNA, 1811 bp, Zea mays
  misc_feature (1)..(100): optimal_loci_236817_G1, chr6:166889346..166891156, Cluster 4
ggtgtgcgttgtcgtcctcccgatacgacgttatgtcatgtctgctctccatacggggcactgtagcttgctcggtgtcaaactgtcaatgttgcggtaccgggtcctgcaaagtggactcacggcgaggttctgggttgtgtctaatatagcttcatcttccgtcataccccttacatcaccttccagcatgtgtaggtatacatccactatggggtattgtgtctaatatagcttcatctgctcgttgcggtcccacacgtcggtcccgcctccatcctggcctccctcccattcgctcctcgcgacatcgcctcctcctcgatgcccgcgcctctgctaaggatttctcgggttgtgccagtttcagggaacccacttcctccacgaagaattccgttgatagccatgagcatgtcgatggccagaagcccagaacgacgacttcgttgttatatatgggccttataccattgaaagcatgcttgcatttgccttcatagttctaatagggattatttatgttataccatccaaagcctacttcccttcataattctaatgtggatttaagttatatatgggccttataggacatttaagacgaatctaatattgagggtataactaatcaagatagaaggcgattgataatgtatggaaaaggtactaaacgaaaatgcacaaaatgatggctttttcgcttttcaaattcatcattaaaggtactaaactaaaatgcacaaaatgatgactttttcgcttctcaaattcatcattttaccattttttttcttcgatcaaggctaaccaagctgatcgagtgcttggtaattggattcgtcaagtccaggaagatgaggaaagctcatgtgctctttgtcatgacttcatcagaggcactgtggattgctcgacgaggtaccgactggactttgacccacggctgaagcaggctctgagcggacaattcactttgcatcaaagaattagcacagtatggactatggactcatcgctttgtgggaatctgcatcccttgtgattttagatcgtcattttgaagtgcacaacaatatgagatgcttcttgctgttcatctgttcaagtatgtgatcgccagttatttctttgctcgaaccttgagacgacgtccacacagattgtgaggccatccaacctccggatgctcctaagcaagccgaccaagagggtgcgctactattgccgcgagttcgatgacacgctgatggtgcccgtgtttggcagccactgagccacatgtatgccatcctcttttttctaggtaccaatagttcttgtgttgttattgaacaaatcgactaatcatggtgaaactccaaagtgtaaaaattcggtcagctgattttattctaggtaagatatgcagtatttttttttctatttaagctaaaaatagtatgcatcattcgaagcagcgatggcggcagctgcgcgcgcaggcagggtgcgcgacagctactagttgggaattgggatacatcgcatgttgttttctagtcgaatggtttaagcaaaacggaaaatcttaaaagtctaatagcatctctaacaaggtgacttagaacaatgctctaaaaattaaaatactacatgattcaaagtgttcagggcactcaaatgaattatgctccagcagttaagacctagatcatatatatattttttaaagcgaaatatgttattaggaaagaaaatattgagagcgatgcacaaagcaaagacatgacactagtttgagtgtagcaaatttgggtcaattcatggag

SEQ ID NO: 607 - DNA, 2222 bp, Zea mays
  misc_feature (1)..(100): optimal_loci_236900_G1, chr6:167410111..167412332, Cluster 4
accgacgatctagagtttgtagggatggtcgacggcagcgaggacctcatcttcgatgcactctgctcggattcagactcggactctacctctccaatgagcggcgagggaggtgcccccaacgacgaggagaacaaaagacacacgaccatcgcaacccctgccctcccgaaaggacaggtgccactggcagcaccagtgaaatgggccgccacacgcggcaggagccagaggggccatcaggcgtgatgcctccgatgagagcccatggtagtttgccgacaggagcgagtccacaccctgtttgtaattccttgatggttattaataaaacatgtttcagaactattcttggggtcggacacaggaaaagggggcgaacgccaacctaggctcggcccagtgccaaccaacacggatgttcatagaattgaagaaatgtcaaaaaaagttatatcccttaaaccattacaaagacacaaattttccttaacccctcgtgggggagcgcaatcaagcagggcgactcccagtttccgagcaaagggctccgcagctttcaccatttcggcaagctctgtatcactccaggcatcgcagtaaccttcacttagggcctccagttcgattccgccttcgatatgggacgtaacaacgacgaaggcctgacagatcccccggcagaagtattcaattttgagctcccagatccgacctgcgaggctctcgaggcaggagatcaaggacatgtagtttctatgtgccgatatgtgccttttttccttctccaactcctccaagcgatgctgcgtataatttttatgtagttttttatttctagtaaataatctgttactactaaaaattcagataaattagagccaacataatatctaattagcgtttttatgtaaaattatataaattttggatactataagatgatagaactaaaaaaacaaaatttatgctacttaaatcagtaccacattattaaaactgtcaacgaaaacagaccaatggttatttgtctcgtttataaagctgaagggttgaacaatcaattttaaaggcgaaatatcaatgttacgcagacttattcctaaacctataactcactccagtattggaacacactgaattttccttttcttcttctcttctcctccatctccggcagttttagaagaaaattttgggaggcaactaggccaaggcggtgaggtcggaagagacagtagcaaggtggtgacgccgctgaaacgggtggcggagcaggagatggggctagcttgagatcgggggcgatcatggctaagacggcgtggagagggaaagatggaggtcgccatggacacggtagcgtctcaccggcgtgcagttgcggcgacgcgtcgggaaaaagaagatgcatagagcccaaaatagtcgggtgtagtatagacagttttttgtacggaaaaactctgaaattcaagtcccaaatcacccaattcgaattccaatttcaattccatctcgtcgcatcagtgagttccaacactccgccacccccacctgtggctgaggaggacgaggatgcctcaatgactgccgcagtagctgcgaagaagccagaagaagaaaaggaagggtgcatttatgatggatggtgacaacgtcgaccagatccttgcagggatggagcatccccaggcctgagccagaggagatgaaagcccaggattctgtgcctgcccctgatgtggatgatggcatgggaaagaaatcaaagaagaaaaagaagggagggaatggatgtggatggtgaggacatcgaccagatccttgcggggatagaggactgctaaagagcctgaggccaaggacatcagggtcccctgtggatgatgctgaagggaagaaatccaagaagaaaagcggaaggaggaagaggagttgaacaaggttcttgatggagtccctcttgtggaggaggacaagtcagtgtacctggaagtcaaggttgttgaaggtcatggtactacaattgaattgatgttgttttggtcaatagtatactgcatgaaggagatcagatagttgtttgtggcatgcaggtagatgtctaaatcttcttgtatttctatatagggacccattgtgacaactgtcagggctttgttaacaccacacccattgagagagcttcggtatctgattatgttgcagctttgattagt

SEQ ID NO: 608 - DNA, 1714 bp, Zea mays
  misc_feature (1)..(100): optimal_loci_236965_G1, chr6:167698880..167700593, Cluster 4
  modified_base (1535)..(1535): a, c, g, or t
  misc_feature (1535)..(1634): n is a, c, g, or t
  modified_base (1536)..(1536): a, c, g, or t
  modified_base (1537)..(1537): a, c, g, or t
  modified_base (1538)..(1538): a, c, g, or t
  modified_base (1539)..(1539): a, c, g, or t
  modified_base (1540)..(1540): a, c, g, or t
  modified_base (1541)..(1541): a, c, g, or t
  modified_base (1542)..(1542): a, c, g, or t
  modified_base (1543)..(1543): a, c, g, or t
  modified_base (1544)..(1544): a, c, g, or t
  modified_base (1545)..(1545): a, c, g, or t
  modified_base (1546)..(1546): a, c, g, or t
  modified_base (1547)..(1547): a, c, g, or t
  modified_base (1548)..(1548): a, c, g, or t
  modified_base (1549)..(1549): a, c, g, or t
  modified_base (1550)..(1550): a, c, g, or t
  modified_base (1551)..(1551): a, c, g, or t
  modified_base (1552)..(1552): a, c, g, or t
  modified_base (1553)..(1553): a, c, g, or t
  modified_base (1554)..(1554): a, c, g, or t
  modified_base (1555)..(1555): a, c, g, or t
  modified_base (1556)..(1556): a, c, g, or t
  modified_base (1557)..(1557): a, c, g, or t
  modified_base (1558)..(1558): a, c, g, or t
  modified_base (1559)..(1559): a, c, g, or t
  modified_base (1560)..(1560): a, c, g, or t
  modified_base (1561)..(1561): a, c, g, or t
  modified_base (1562)..(1562): a, c, g, or t
  modified_base (1563)..(1563): a, c, g, or t
  modified_base (1564)..(1564): a, c, g, or t
  modified_base (1565)..(1565): a, c, g, or t
  modified_base (1566)..(1566): a, c, g, or t
  modified_base (1567)..(1567): a, c, g, or t
  modified_base (1568)..(1568): a, c, g, or t
  modified_base (1569)..(1569): a, c, g, or t
  modified_base (1570)..(1570): a, c, g, or t
  modified_base (1571)..(1571): a, c, g, or t
  modified_base (1572)..(1572): a, c, g, or t
  modified_base (1573)..(1573): a, c, g, or t
  modified_base (1574)..(1574): a, c, g, or t
  modified_base (1575)..(1575): a, c, g, or t
  modified_base (1576)..(1576): a, c, g, or t
  modified_base (1577)..(1577): a, c, g, or t
  modified_base (1578)..(1578): a, c, g, or t
  modified_base (1579)..(1579): a, c, g, or t
  modified_base (1580)..(1580): a, c, g, or t
  modified_base (1581)..(1581): a, c, g, or t
  modified_base (1582)..(1582): a, c, g, or t
  modified_base (1583)..(1583): a, c, g, or t
  modified_base (1584)..(1584): a, c, g, or t
  modified_base (1585)..(1585): a, c, g, or t
  modified_base (1586)..(1586): a, c, g, or t
  modified_base (1587)..(1587): a, c, g, or t
  modified_base (1588)..(1588): a, c, g, or t
  modified_base (1589)..(1589): a, c, g, or t
  modified_base (1590)..(1590): a, c, g, or t
  modified_base (1591)..(1591): a, c, g, or t
  modified_base (1592)..(1592): a, c, g, or t
  modified_base (1593)..(1593): a, c, g, or t
  modified_base (1594)..(1594): a, c, g, or t
  modified_base (1595)..(1595): a, c, g, or t
  modified_base (1596)..(1596): a, c, g, or t
  modified_base (1597)..(1597): a, c, g, or t
  modified_base (1598)..(1598): a, c, g, or t
  modified_base (1599)..(1599): a, c, g, or t
  modified_base (1600)..(1600): a, c, g, or t
  modified_base (1601)..(1601): a, c, g, or t
  modified_base (1602)..(1602): a, c, g, or t
  modified_base (1603)..(1603): a, c, g, or t
  modified_base (1604)..(1604): a, c, g, or t
  modified_base (1605)..(1605): a, c, g, or t
  modified_base (1606)..(1606): a, c, g, or t
  modified_base (1607)..(1607): a, c, g, or t
  modified_base (1608)..(1608): a, c, g, or t
  modified_base (1609)..(1609): a, c, g, or t
  modified_base (1610)..(1610): a, c, g, or t
  modified_base (1611)..(1611): a, c, g, or t
  modified_base (1612)..(1612): a, c, g, or t
  modified_base (1613)..(1613): a, c, g, or t
  modified_base (1614)..(1614): a, c, g, or t
  modified_base (1615)..(1615): a, c, g, or t
  modified_base (1616)..(1616): a, c, g, or t
  modified_base (1617)..(1617): a, c, g, or t
  modified_base (1618)..(1618): a, c, g, or t
  modified_base (1619)..(1619): a, c, g, or t
  modified_base (1620)..(1620): a, c, g, or t
  modified_base (1621)..(1621): a, c, g, or t
  modified_base (1622)..(1622): a, c, g, or t
  modified_base (1623)..(1623): a, c, g, or t
  modified_base (1624)..(1624): a, c, g, or t
  modified_base (1625)..(1625): a, c, g, or t
  modified_base (1626)..(1626): a, c, g, or t
  modified_base (1627)..(1627): a, c, g, or t
  modified_base (1628)..(1628): a, c, g, or t
  modified_base (1629)..(1629): a, c, g, or t
  modified_base (1630)..(1630): a, c, g, or t
  modified_base (1631)..(1631): a, c, g, or t
  modified_base (1632)..(1632): a, c, g, or t
  modified_base (1633)..(1633): a, c, g, or t
  modified_base (1634)..(1634): a, c, g, or t
cctagggagaatccaggaaacatcacttgtttaagatgacgttcacaaaacagcatatgttttcgaacagttcgtagaacaacacttatttcaccaaattaattcagaaaaacaacactccatctatattttgcattcttttattgcttacctcacatacaaatagaccaaattacatccattcatcacacaaccttctttttacctattatgtccataagaacaacataaataaataaaatatgtgacctctattttatagtgttaaacatacatatcagcacacatgttttatgaacgaataagtctatatttaaccattaaactcagaaccaggtacctcggccatcgaaccattaaaattagacatatttggtccaccgaaagcttttcgattgtacttcctatgttttttatttgatgtgtttttattttcaaaaacttcaatcacccatcctattcaaaaaaaatgtatgtttttagacttcttcctttatagaacatccatgtttttttatatatttaacatcatacttaacaatataaaaggtagagctcatatatttgtatgtgttcatgttgttcttatggatagaagagataaaaacgagactatgaaatgaacagtgtcaatttggtccatttgtatgtaaggtgagaaatgaaagaataaaaagtatagatgaagtgttattttctgaattcatttggtggaatcggtgctatttttgaattacttaaaaaatctatgctattttctaaacactgttctaaactagtggtgtttatggattctctcgacactccttgccttctgggccgacgtcgactacctcactgcaaccaaagtcattccattttgattgccatggctctgaaatgttgtaattgtctatcataccagatcatagtaataggtacttgatgtggttggtagccttttggggtgaaaaaaacagggttaacactaggtaattgttcatttagttcgttaaattgaacggatcaatcgttgccttctttaatggtgaagtaaaccaatatgatgattgagtagaatttatctgcattcaagtgtttaacgcaacgggacgctgcgggagcgggccgcgcccaccgtcagaccctggtcagcccgggagcgagctagccgttgggcttgcagccatttttgacccaggaagcacgtgggcccgcgcgtcgggccggggttaaataaaaaaaaaaacaaggccgcactgaaatcgtagctagatttgcgcttccttgtgctgtctccatgcccccgctacccactctccttgctgcacaccgctacccaacacgaggggccgcgctgtctccatgacctgtggggccaccggctgccgtgccgttgccgtcccatgcaacgcccacatggaccatggcttgtgttggaagatgtgtgcagtgcagtgtgcgcgtgagctgtgcctgtgtgtgtgtgtgtgtcccaattgttttactagtagtactcggtagagaagatttcacacgattcaaggaaagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggggggggcagaagttctagagattcgtcgcatccaaaaaggcgtcaacacttacattaaccataaagcaagtagga

SEQ ID NO: 609 - DNA, 1432 bp, Zea mays
  misc_feature (1)..(100): optimal_loci_237488_G1, chr7:1989212..1990643, Cluster 4
ctccatagaagacattattggtctttcagtcaaacttaacttcaaaaccttcaactcagatagtagatcatttacctcaacgtcagaaccgtcctgcgaagagggacaaatggagcaaccacaccagacctaacacctaagactatatatacatatacactacttagagacccttccaaaatcggaggcccggtccagccaccccacttgccctcctaaagatccggccttgcatggatcccctctaattccctatcgaccaaatcagattttagctagctaccaagatcatcatcgcgtctacgccatatatgactaattggacggtagtagaatacattcgtgtactttttgtctattatatattaagtcccacataggatccagatccatggatgtgtggtcgcctgtggatctactatatactaccgtaccgggctctagcaacaagcatgattccgaaagctgtcacagtcatgccatccggccggccggagcatattggtggtcattgttgcactcatacagaacagctgctaactgtacatcctttaccaagcaggcatccagatgatgatagatagatagatatgctcttccttctttatttcttccttgcttgttggtcttcactagctagctacaaaagctagctagtgcaacagatataaaaaagaactaacataaagcacatgtatgtacatgtgaggaggggagatgacaagtttaccctatatatatggagatgataagcgtcagctatccaacttgcacgacgtacagtactgtcctgttcggcgagctgggtgcaggtgcgcgcgggcgcggcagccaacgaccggcgttggcaggagcgagaagccatgttaggctagctgttctctaaatttctccttctgtattatttttgtatttttcgtacggatcgaaaaattaccaaacacgcactataaaaagaaacatccttagaaaaaaacatataatcgtaattagacgtcctcttatctagcatatggccactatctctaaagtttgacatatcccacaaaaatctcttgctggacatcttcctttgtgtaacaatttctagaatctgaactagaatgttcctctaaaaagaacatgcaagattgatggagttggtttaaaagtaaaggccatatcattgcgacaaagctaaatagaccgaaacattgccgtcaccccaccaattaggagttcccccccccccctatatatcgtacccttgttagcaacccaattcacatttatatgattaacgctgtcgggtctctctatttgaagagcaaagtaatataattctccaaatatttctagcaatataacaatcaaaaagtagacgttgaatagcctcattttgattacagaaattgcatttcatactacctttccaaccgcgtttagctaagtt

SEQ ID NO: 610 - DNA, 1987 bp, Zea mays
  misc_feature (1)..(100): optimal_loci_237728_G1, chr7:3169902..3171888, Cluster 4
aaataaatatctcaatatttattattatatatgatatgtaaaaacagtggctttgcataacagtggtggtggcctgctgccacacttgcttatcaccatccatgagcacgctgcacacagtcggcagcggcagcagcagcatcttttgagcagtatatatacacaggttttgtcctgagcagagctgagctagaaactctggcgccgcacagtctgctaccattaattgacgaatgtacaaggcaacctactgttttcctccttgcatggccgctgctagcttcaggcctcatctctctctctttcctttaatttgcagcgttcattccctgttggctgttgctgttggagagacgtggcgtttcactccagcatttcttgtatgagcgagcaacgacagcgctatcgacttcgcgcccttcctatactatactatactatatgttggcgcgaggatgtgtgttttgcggctcgatatatcagagtgctttcgatcgagaatcaacaaggtctagtggcatgggaactaactaactagctagctagtagtcatctcctagctagctgctgactccttcctgcttgctttttactactcccctagctagtgtagggcatgttgtgtgtatgtctctgtgaagactaaaaaatgttggagagatgttgatgcaagaaaggagaaaatagtaaagcaagggatttaattaaggaaacaaagagaaccattattttctcttcagctactaataagccttgccattgcagggcgtgggggccctaaagtagtcccccccccctctctctcttctctctctagcattgcactgctttagcatatcctgacttcctgattgattcctgcattattcatctctccaactggggtagctatagccagggtatccgctgccatcttttatcagagtgggggagagagagagagagagagagaggggagaatgtggacgcatgcatcacacagtacactgcctgcagcagctgttggttagtatgtgtttgtgttgatgatcacggccagccggctttgcaacatgccgttttgctctcctctcgtctcctgccgacggtctgctgctacctaccggctaaacaaaacaaaacctctgatctgatgagcccatccattgttgcctagttgcatggcatttttgccaccaaccggctactaccaggaagccggccactaccttaggctgctgctgctgctactactcttcctgcccgctgcatcaatctctactctctctctagcttgtcatgccaccaatcaggactaaatatctaactatatatatatacatctttcatcgtttgccagttcaggccatgcagacagaatatatatcctcaacaaggctgcacaacatctatttataaggtggcaagtctcaactagacgttagaaccaacatcgctatcaatatatatatatatatatatatactctgtctgtatctcatataacctaattgatgaaccaatgcaagtttgatggcggagttaaatggaaaactgtattgtttatccgtgataaaaaaaagctcaatattcacattcatgtgatagagagaaacctcagcgctcacattaatatatgataatgtaaactatttgtacttgtggatagatgcaacgatagtgagtgtgtcggaggttgcacaacactctaaccaaattattaccaacagatgatgatacgtttaccaagaaaaacttagaacttattaacctagaggtgtatagtatccctagctaactaataacgaactaggttttaaacatagagagtacatccaaaaaaataaagctgccgctgccgctgcagcagcagcagcacgcgcatacaaacttttgcttctcaatgtctgtggtcctcattccctcaagcgtgcatgttgttagcttgttaattaatgagtggcgccaccagagagatcatcagctgctgctttcccaggagaagatg

SEQ ID NO: 611 - DNA, 1593 bp, Zea mays
  misc_feature (1)..(100): optimal_loci_237871_G1, chr7:3671892..3673484, Cluster 4
gaggacgggcgagctcgatcgaggcaggcggccatgcatatatatccatcgagagccaggcaagctcgcacagaaatggagagtaggtgttagacggcccgtcgtgtcacagcaccacaaatatatagctctcgctcgcttaactgattgaccgcgctactagctgtcaagaactcaagatccatcagatcttacagaaacaacagccgtcggcttccttgttggtgttactgttctttttcccccccctttcttcttccgtttgggcagagctgatctgcttgctgatggcaactgttgtcggcagtaggtagggtagagctatatatagggttttttatataatacttatgtgctttatatagtatatgcaggcaccattatgcttgctttttgctgcctgattctatctacctatctttggtgtcaacgcaagttggtgggggtgtgcgcgtggtgcgtaattggatggactgtcgaccactgctcatgaacagctagcgtcgtcgtcagcaaaacagcaacggcctggcaacagtcatcgccagagattgcaatctcgtctcgtcaggaggttttatttaatcaccggttcaagaaacatacggaacacatactggctgcgtctccgatcgaaacacacacaacacgcagcacagctggtggccacgccgaccgtcgtcagcactcactcagcactgctctgccgaccacggctgctcggtcgtcgtcgtcacggcgacctgtgcaacaaggcgagttggagtggaatttaccgtggttcctctgtgccgacgccgccgggttaccgcggcggcgttcacgtacggccagcagcgccgcgcgcccgcgcggtgccactccacgtgacgtgacccttgacgggacgcgttgctttgttgcaaggccgagaagacgtgtagctgggctggaatgtactacatgggttggcccatactcaataaaccagcccaggagccggttaccggataatcatatcggaatcggaactgtaccgtcgtctgctcctctccttcagtttcggtctgctttaatgatacgactaaacttagatacgctatatatattttttttcagttgccaatattatgttagcattacaagaatcagtttctagagtcgggtcttccaacggcatctctgttcaaatttcccaagatatcaacaaatttttttttgacaaagaaaggctgcagcgaaaaccccacaactatagattttattaagattaaaaacagggactccggagaaagcgatagtgagcttaaagagaagaaaggcacatagagacaagtattttaagttcagggctaaatctgattatttgaagtttcggcgtggaattgaagcatgtcctccaggaattgaaggacataacagattctctaaagatagccgaattttgttgtttccaaatctcccagtgtatacccacgtaattccagcattcggcactgaaagggcactcaaatataggatgataagtggtctcttcgcagttcatctcgcataaaatacaacaatgatcattatttggtaaatcgtagcactttcttcttagcaaattccttg

SEQ ID NO: 612 - DNA, 1584 bp, Zea mays
  misc_feature (1)..(100): optimal_loci_238863_G1, chr7:9598017..9599600, Cluster 4
gatcataatctgctctatcaatgaggtacaaattacttgatgtgattccctacggactacgacaataccatgttttacctacatgaagattgtgaggtactaactgctctttccatatttttttccggtggtggtgatgttggtgattcagatttttcattggcttgtaggtatagtgatgttgatagacatgtagcccttttttctcactatagtgaggctactcaaaatagtacgatacacaaacatcagtctagattttcaacacatcagatattttatttgtcagaaagtttcagagggttagatatcaggtgcttgttatgatttctgctgtgtttcttttaggtattcacttttctatttgaaaaacatcactaatggagtttatgtttcttagtttgaagtggtagatgatgcaaggctttcagccaaaaccgtagctgttctccaaaatctttgccaaaaggttagtatcattctgcctttcatgctacctgtttatagcatggtctgttgtctgtacatccattatttttttgacactgtgctatgcacatgtaaccgtgtaggggctcttctattgaaccattagtttctctgttgctgcacctcactctcctcaaatttgagctgtgtggaacactgaaattgacccctggaccctggttaattgacttatttgactatttctgtgttaaatatacaggagaaatattcagcaaaaatcacactattaagtacaatgtgtttgtgtagtctaagtttggacaaagccatataggctgctgacggtgctactgttaagtacgaactgctaagaccatgccaacattatgtataatgtgtcaatgtgtttctgtagtctaagtttggacaaggccgcataggctgatgacaacggaactattactgttgtgcctgttactgactcaatcctgtgtgccgttcactcaatgcatgccttagtcctctgccattttgcgctattgcaggatgcctgaatcctctatcgttttgcttcataaacattatttgacagcggatcggatgccagatgcatttcgagcttggttaatggataatgcttgttcattgagtttacgttttcacatctgagattcgactatgcgtataaagggctcatgttctgagtaacacttgctactttcttgctcttagttagtaaaatagtaagtgatgttcaagtatgtttctctgatgccctaggtgtgtggtggtctggtggattaaatgtgaatgttgagctgcaactttcaccaattggtttggagaaagtcaatagaggcttgggttcttttagttaagaaaaattgtgctggtgttcagttctaacatgaaattgtttattgttctctgtaatctcacatttcttttttttttatatctgaacagggattatgtgccagtttcagtttttggtaacagtctacaggacttttagacattcaaaggtgagaatcactcaggttcagctccctttaaaaaaaagtaatgtaaacaacacctttctgtaaacagtgccctagaagaaccacgctcctgcctacacaccagtttgtt

SEQ ID NO: 613 - DNA, 2125 bp, Zea mays
  misc_feature (1)..(100): optimal_loci_239968_G1, chr7:15466806..15468930, Cluster 4
gggtatggttcatgggttgtccactcccgtgttgagcacgtacttgcatgccctcagcattctctgagatgaaaccaaaactacttactttcaccttgaggaagaaatgtccaattgtccatgccgcaatcctctctcctgagtcctactttgccaccgggtcctgcgggagcgaagcaagaaaacggaaaacacacaactgccactctctcagtcaatatgatggatttgtcacttctccgccattcctaccaccaccagaatcctgagctggtcccggcctggtgcgggcagtgagtgagtggctgtgccaggaagcatcagctgcctcctgcctgcagctgcaggctgcagccgtccgtacgtcgtcagcggaccatgaatggctgccgatcgattccctgcagcctttagtaataaaaactgccgcacagaggggacatggtggagcggcggccagtggtccggccactgacaccggccggccggcctggatgcatgtctacgggttgccggccggccggccggggggggaggtgccgccagacgcccagacgggttcagagcagtgcagctgctgaggtcggagcattgaccttgcaatagctctgcgctgtgggaatcagagaaattgaaatcgcctggagaggtttgcagcacgcaggaccgcgggagacgtcatgatcaactttggtcgaaagagaaagaacagacaagagatagtgcgaaattgtgtgtgaaaatattgtgttagctgacattgaaacattgtggttaattgtcagtgacatagcaaagtgatttacatgcgtttaaaagtaatgcacgcgttttgattaatgttgaattgtgcaggtctgttaacatgcattttaatattgttgtaacgcatagcgtggatcggacttgtgctcgtatacggttgcatgtgtcgttgatgcgtaggtgtttatcaaggtgaaacatggtcgacagcggcgacggaactagttttcggtacaaacttcatggaggaaccggggtatgaaattaggcttcgtgactaagttcagtgagaaactgggggtccttagtcaaggttgctgcgcgggatgtttcggtcgaagtgttgatgcatatcgcgatcgcgtgcgttggagtgggtttgacccgtgcggtagctagcctagttggtgcagctatgctggagttccaattaagatgggcgtaggcccaatgggtgcgacacgagtgtaccaagagggcatcaggctagatgaatcccatgcgacgtttcaagagtccaaccgagatagaatatgactctgatgtccttataaataggtcagcgaaagatagtacagatcaaataagagttgtagtagtccaaggagggtttggcttcgaggcagattagtattgttggtccttataattataatatagatcaaatattgttctttttaggacgaggattagagtagatagaccataagagtagatctatttgagatattagtctaggttttttgagagttcgttagataactttctagtgcttttggagagcactcattgtatacaaatcttgatgattaaagagttgattatgcaagattagtacgataacattattcctctctctttgttgactaattgcattcttagtttcgattctagattgaatcttggttttcaattgttactgatgttttgatttatctagatcattactaatgcatctatttactgacctacaaagtctgagatactaatcttttctcattattgattaatttcgaaattagatctcgattaattttcgttactctttggaaactgtaagcttgttccgttaataactttagagctgaatatccaatcgacatgattttagttggatttgtttcatgatgttatctagtttaatctgttaaattttcagattgatcggagttattgatttcggtcagtaatgttttcactaacgtaacaacaatgtgtccaaatttatagaagtgtaatattttgattttgcgattaggagaaggcgagataaatatttttttcaaacttggttagtttttcctttttgacaccgtgaaatttgaagacatcaagcggctgcatgagttcaagcagaatg

SEQ ID NO: 614 - DNA, 2373 bp, Zea mays
  misc_feature (1)..(100): optimal_loci_253634_G1, chr7:105361283..105363655, Cluster 4
ttactttatgtcaagatattcttaatgaataataatttatataaaagggggggcaagaaaagaagtggtgcaaagtagtagtcgcgagcaaaggctacttctgctgctgcagcagcaccgtgctgccgaatgggggcagctgcctccctccctcctccccacgccgccacaaaggaaaccaccgcccccgctccaaatattctcgcatatcatgcacccttttgaccattccatcggccggacccggcgaccacaccacactaccacgccacgcatcgccagccagccaccactcccctgccgcactgcactgagcaaagcatgcagctcgtgcgatcgctgcgacgggacgagctcgttcgaccgacgccacgccaatgccatgccccgctccgctcgtgagcaggcagagcagccgaggccaaaaaaaaaaggcgactgcacgagcgagcgacgagtgtgagcgcagagcgcacgtatgtgcggggccaaaaaggaggcagcacttcttttgatccgcctttgccagcccagcctctggattcccccgaccccgattggtttttatcatcgaatccgaaagcaatcgtgctcgtgccgtgcgtcttctgcagagctggagatacgctacgcgctgttctaccacgtaccgccgttgttcgagcactggcagtggcagtggcaggcggtctctgattcctcctcttctcttctgcttctggccttctgccctcgaagacgtcgcgcctgcagataccgtttgcgtacaacagcctgagcagtgagcattcgcaagcgtcctgcgctctcagctgtcctctgaaatacagtgcctggaaaaacctgaaacagccctcgatcattctctccgattgcagagatcagatcagatcagatcagatgaggggggtaggcaatactcgtacacatgcttctgcgatccgagacagaggctttcgtcggtccgtcttttgggctcggacggacgctccgctcatgggattccaaagctgcctgcctggccatggcccttttcctctcgtgtggtgtggtgaccaaagcgcagcgcagcaaagctgtgctctgaaagcccgaggctccacccaccccgcatctcctcggcgacgccatccgcaccgtccgatcggacccggaggagtcccgcgtaccttgaatcttgcttgaccggctaatcttttatttgacgacgaaatccattccgagccctcggctcaaagtcgctctccatcttttttttcctgagaaaaaagagggggtttttttcacccccctcgtggaaagtgaagggactcctcaagatctacccttctgacaaaaaggcgcggctgcaaaaactgcagccagccatcgccggcgtctgtagtactggtactagtaccgtgccgcaaaagctgttgtctgataccggaattttctccatccagccagccattcagctaacgaaacaagacaaacaaatacgccgagtgagcgcatcacattcacagcacagcagcagaatgcaaaaaaaaaggattggttcgtacattagagcaaagtatggcgtggcatggccggcctgccacaggtcatcagctattggtggcgtgcagcgccccctgtgtggtgtgtgcctgctctgcactctgctcctggagctgcaggtccatgtccaggacatgttgccatttcacctcaagtcagcttgcgcaatggttgctagctgtactgggtgggtaactcctcctcctccccttccagaaacactgaaaagaaggaccaaaggatatgacaaactgcccctgttaatgggcactacaatgattatgattcccattagccactactagtgctgaccactgttgcccctgcatatattatcaggctgtggatattgtattctgtagatcagctcaaatcaaactgctagttccctcgtcttaaaggaaagcataaaggacatccttggcatgcgtctagctagcaggggattcacaatgattcttttgtatatatatgtattgttctgatcaaacttgtttctttaatgaacgaacaaaattctggtctctaggactaggacaaagttcacaggtaatagggcttgcacacataggactaagagagaaaaacaacacacacagacacacaaaagcaaaacaaaaaacaaaggtgctgtttggttcacatatttgtaatgtaatcggtaacaataaacgttaaattatgtttgtttaagtccaatcgtaatcggataccacactataaattgataccagcttattcaaacttattaccgcttgtaatcgaatacaaaccgttaccgttaccatttacgttacattttgggaaccaaacggcaccaaagttcag

SEQ ID NO: 615 - DNA, 1557 bp, Zea mays
  misc_feature (1)..(100): optimal_loci_257267_G1, chr7:124869736..124871292, Cluster 4
ttgagctgcctgagagtaagcaacagggctgcttcatcaggtcgttggcatggcagctgtgcatgtcaaacggggcagaatcgctggacgagtttcggctccctccctgtcctcgacgacggtcgtcagggattcagatttgaaacctctctccgcttttcatcaactcaaaagtcaaaacccagcaaaagggacatatggatgtgaaggatcgatgtgcccgtgttaccaggctccatgatccgccgccgccgccccaccagcaccaccgtcgcccggccagccagcgtccacctaacccgattgcagctgaccgtgagagtgaggtcctcaaccgacggccgaaacggaaacgaaaccgcaggtccaagtccaacctgcggcgtcaccaccttgacacgtacgggccacaaaaccaaccccaacccaaccgaccgaccggatccacgatggtttcccacgcgaattcgacggaaatcgtctgggtcgtcaccagcagaaacaccctcactcacacctacttcatgacagttttcctttctccctcaccactttcatggtttctctctctttcggcgcgcggtgtgcgaaagtgactgtgatgcacgaggggaaataaaaaaacaacaacaactccatgtcaaacaaaaaaaaaactccagtgtacgcatgctgtgttctcttccttcctgggaggaaagccggcaaaagcgctctggcgctcgcgacacgcgaaaactacaagccagccgagggcgacgctttccatggccgcctgcatgcccttagctagtcttctctcgcgcccttgcttctttttcttctttttaattttctccccacccctagctagtcgacgacggcgatatgaatatgatggcgtatcggggtgatgtgtatcctactcgcacacctcgcgcatacaaaaatggcgatcgctgccgtacctcacctcacctgatgccgactgaaataagaggggggcgtttatccgcggcgtcgccgtcgctgcgttttattggagccgtgattgggggcggcagcacagagatctccagagccgccggcacaagacgaaagcgaggagagggtggggccgtctcacgtactgtgttcgacatcgactgcgccctcgcttctcacgcaagcgagcatcatgaaacatgcatgggtgctctatatatctcgtctcgtttcttccacgcatataaacgaaatgatataataatccaatcggatatgcccatctctctcgtcgtccaatcaacatgccgtgacgattgattgagggaccggctgaacctagaattaatatgcgggttatgatgatgcatccattgttccgcccgtaaccgagcttagttttagtctttgtgaagtgtgacgagagtgcgaccaaattattaatgtttcttgagactgtcgctcccgtagtcgacagatcgaggaagaaaaagggaagtagctagcttggcaaagagaagcacacgagttgttgtatgctgcttcttcccgtacgttccaatcacggtgatactacagcagccagcataagct

SEQ ID NO: 616 - DNA, 1858 bp, Zea mays
  misc_feature (1)..(100): optimal_loci_260207_G1, chr7:141130570..141132427, Cluster 4
tgaatgggaagtgagtgatggatgtcttttcttttctgcctttctttctttttccctgcgagtgaggagactcactcacacatggaaaacatggaccttgccatctcggtaccgaaagaaaaacataggccccgtttgattcattcatgcctcgtttttttaaatttcatttctacggtctcgttgttagctaaacaacttctgatttgtttattggaatctcaacataaattggtaataataggatttgtattggattgtgcgcagtatctagcttcttaaattctaaggataaccaaacaccaccttaaacatgcactagcatttatgaaccatcttataggttagactgaaattcaagaaaaaaattacaaattcaaatattcgaagacgacaaggaagctaaaattaccaacacacaaatatcacttgtgacaccgacacctcaactgatttcaagatttgtcggccttcgtattccaaggcagatgtctacttcaacttaaaatcgggttttggccttcagaatcaggttgtcaactgatttccacatccgttagccttcttattcaaaggtttaaatttaaaatcagattttagccgttcgaatctagggatgttcctaaaacatccgacttatatgacaaatctaatattttaacataaatagacatgaaatttaaagctaatttttggtagtgttattaagaatattatgaagtatttaaaattttaaataaaattagtattcacgatagaaggaatcaatttgctgtcgtttttttatatcataaaccatacaaatctctttatcttatgttccgtagtattcagattctctccacgattctgcagaaatatagattcccgaaaaaagctcgttggagaaaagaagctgaagataggtcccaactcccaagcctacactagatgaaccatcggtacttccctgtcatcgtgacgtgaaaaatcagcaaagatttttgagcgaagtaatcgaaccagctccaaacaagctggatccagtgagagccgctaacgcacatggcgaatctgtccataccgggggccgggggagctctttctagtccctggccccgctcccgagtactagaaaacaaaaacagtgacagccgtttccttaaccgtatccagcccgcaggcgtttccagtttccgcacgccttccttcgtccccctccccctgcctccggtactccgggtcgggggagtggggaccagctgctaagcacgacgggaattctcgatcgggttgatgcggatccatcgtagcgcccgctgaaggaagggcccacaggccacagcctgaggctgacgggacgggagggactgcttgatttttctgtccatcccgtgtactgctttccggccgccgttttcgcgttgcctttctcgttcttctctgcctcctggggcttccggaggccgacccttttttttcgtgggcggggggaggcgacgccgaggcaggcagcttccgtgcagtgggtttttggctgctggctgttgttgtcgcgcgcccgtagcgtgttccagctaaccgctgcttgatttgtcctgtctgtactaactaaaaggatagacatggatgacaacagttgtctcgccgtcttgatggggggggggggggggacagtttcttttctaaggaaaaaaatactcctatttcggttccgtgctcgtaccgctagattattagtggctggtgattcgtccttgcattttggacaaccctgctcatcggaaaccccaacgtgcgggctaaacgtcgcattgaaatctgaatctgctacttgtttcgaacgaagcgaaagtgaaggagttttggagattgaaaa

SEQ ID NO: 617 - DNA, 2139 bp, Zea mays
  misc_feature (1)..(100): optimal_loci_262113_G1, chr7:152173933..152176071, Cluster 4
cctacgagctcttggaccgtgttccactcatggcctatgggttctaggcctgagtcctctgatgccctacgaacccacacaatggcaagatgagaccagcagtcaggctacaaaggcagaaggttagcatgggaagaagcagacaagaatgaataatgatgacacctggacttctgtcatgagcacggatcgcacgctctcccgacaatatccgaaacacgggaatcgacacaggggtgaaccattgattttacactaatgttacactccctttagggagaagctatctataactacctcccccttgatctataaaagggaggacggtctgcctcaagaggagaggccccccaagagagaaaaacatgatagatatagaatcgtgtcggtgtttcgaacctcgctccggcaattaaatttattgtgcgcgttccgagctctggaggggtgtgcgaggtggggcgcaagatttatattggttcagtcataacatccatacatccagccatcggtggctttcgctaccggcactattgatgatcaaaactcgtagtagaggttacaactaggcgagagagcgaggagagactccaagtctctttttcggggtggaagtggaggatagaagctacaaggtggagtccggactaagtattggctcggcgcggtggcgctcactagcggtttgttggggaaatgatccctggtctagcggcggccctatatgattacttagccaaggaatcagtatgcttgttaatatcaccagcggcgagccaatacttagaccagcgtatatatatgtgcgcgcgcgctatatgcatttctaatcttttgttaatatctcactgttaccagagttactactgcttgattatcactaacacatactgatagcaccatgaattaattaagggtggttgatgaaaacagtgatttgtactagctaaagctaggcatagtactatgtacgcacagatacaggaatagtgataagatacgaaaatgcagaggcacataaagcacgcgctagctgcatgcgagttgcgacgcagggaaagatacaaaggaggcagccgcagcgaaaagactgcggccgcgacgcgttgtaaaagatggcttcgttttactgcggcgcgcgacgggcgaaagcgtatggcgtataactatatggtgatcgggtgtgcacggcgtggtgcatgcaaaccctcgcgggggcacgtacggcggaataattggagctctgaatttgatgtgtgactagacgcatggtaccagccctgatctggccgtgtcagccctggccggggggtcgggtctcggtgcgcggtaccgccggaccgcccagccacaccgcgggacggcgggagcaactagtgttacaaatccaccggccggccggggccggggcttcgaattcatgtctctgtgcacgcacaccgcatgcatatactagtcctgctttaaaaaaatggattcccccaccctagctatctcctgcgcactgtgcaagcttccactcattttgttctgggttaccgcgccgtccctatgggctatgggtggtgttgtgttggtgggcagagcgagccgcaccgcatgcatcacgtacagcggctggtggcctggctgcctagccaatcgagggccgagaccaccatgtatgtgcctctctggccgtctggcacatagctgccggccggccggtgcagctaaccgcggcacggcatcgatgctgccaaaacccggccggtaagatccgtccccgggggccacgttttactgcgcacccaccacgactacacgtactacggtcgtgggcctgccgcggttttttcctgccgcgaatgatggatgggggtgggagacacggcccggccggtccccggctcagaagatggtcgcagcagcttccacctgggccccccgctgccccgtcccggcatgcatgcgcaccgccgacccctgcttgcctgcctgctcggcctcaggcagccacagcagcgcctgtctctctcggcgctctactcttcctttccttcgttcatcgcgcgttggcgccagcaggcgcaaatccccaatccaaaaaaaacaaacacggtgaaatttcaaccccacctatcgcaactccatgtgtgt

SEQ ID NO: 618 - DNA, 1627 bp, Zea mays
  misc_feature (1)..(100): optimal_loci_262733_G1, chr7:155563944..155565570, Cluster 4
tcgcaactagacacatttcgcagctagacacatcatgagcgcaagagctgcaaggtggcataagctaatttgtacaatgaaacaaaagtatttatcttggcatgtgcttctttgaacaacggacacctttcgaacaaagttggtgtatcagtttgtaggatggacatctcaaatcggactttgtgctactgctgcaggtgcatgtagatatgcctctgtcagcacatgatgcatctgcactgcatgcctcttacccgtacaaagtgtccttgctatgttgtcactgtgctcaaaatcctttgcactgccactgatgatgcccttagtagataaacattatctaattatgagaatccctacctaaccaaacgctaccataatcaggcgcgtggtccatgtctgacctggccaattcccaagtactacggaccagagagtaattctatgacacccatggtttcccacggtggcaccagcacaaggttaaatttccaacaggaccagtcgagcaatcagtgaccttctcatgctatatattacaggtcccttcctttttggggagtcggctaccacaagaatatgaggttcaaaccctacgagatctggtcgtcaggaacaacttgtgtgtgtttaccatgtactagtatgtacatgtgcagccggcgccccgcggacttttgatcgggaagaagagcatctactacagcagatgggctcaaaacaagtctcctccagcagtcatgtagcgtccccgccatcctccgtcagtgaagccttagctgcctgacaacaggacccgtgcctgctttaccttcttttgtaccgaaacaccacactatataagctcctaaaattatgcatgttttactgctgatagaataaacaacggacaacccattttgactgggtttaactcaaaacctcttgcgggtcttaaattaaaactcatcaaagctgactgtttcctacaaattatctgtactcaaagctgactgtttcctacaagctgtctgtactctatggtgtcgattctgttctcaaaaaaatcaagataaaatcgtaccaatccatgttggttttagtactgatcaataagacattgggaccgagatttggatactctgctggaggccaggaacgagtgaaatggaggagaaatcttttagactggagatcaggatttggagggtatgctccgaagtttggaatgatagatcaatccagagaaagagaatatgtacatcaaggatttgaaacagatgtctatgacttttggttagtgcagtttcacagtgtatacttcagtttcgagaaagaattcagatttttgagagcagttaattaaagcagttcttatggctcaatgagagacacaaatggaccctatactggtcggagccacatacacagtgtgaggtgcacaagctatgcggaccgtatggtagctgcaaccctgacgcaaatgctacgagcgcaaatgctgggagccctgaggattgtcaggtgacttgcttcaacagttgcagctgcagtgcttacacatataacggcactggctgttttgtttggcatggagacctacctggtcaacctccaagaacagcacactggcgatggatgaggaacc

SEQ ID NO: 619 - DNA, 2293 bp, Zea mays
  misc_feature (1)..(100): optimal_loci_263003_G1, chr7:156733047..156735339, Cluster 4
tgcagaagaaccacccaaccagagtcctcacgctggtatatcagccttttgccctgggggttacagctctcctagcataccacgaagcaaaaaatcaacaccaggcttcggaacctgacaggatacacaatttacttcttaagttatttttggaataatacttgtaagtggatacctatctctgagataaatagagatggttcataaattatattccgttagcctgactattgcgccagtactagtatatatatttaattttctctctctaaaagatagtattagctagtatgtttccgatttgatatattgcataagtgttatataaatcatggttattgaacaagtgatatcaacctcataccatcatgttttggaaattagctggatgtggccactaaggggcaatgtgggtttggagcctttgttggcatatgtgtaacaagtgcagcattcgggatagcagatgcccatgctcaaggtggcatgattggtgacctatccttgatgtgcccagagttcgttcaggtggcttgtttccaacgattttttgatgtattgcgcactgatagaaatatctcagtgcctatagttggctgctcttatgtacccatctccattttggtttgcagtcctacttggcaggtttggccgcatcgggccggagcaatcatgttgcgttgtcatgttgagttgctccatatgctactttgtgcagcctatggaggatccgaaacaacatgtgcgattaagcaccaaacaactgcttctgcagaacatggattacgtgttcgatatctttctgatatgtcttgactatctattttccccggattcccatctgaagacacacggcctggggacttggtaaggtttctttcatgtttttttttccttttttactgacacacggtgactactagctcctacatttcggcataatctagcgttccacatgaaatttagtcccctctgctgtgtgcttttcaggtatgttcaatgcgtgggatctcataggcagatatatgtgcccttcattgccaagctgagatctcggaagtgtaccacagcagcagctctcgcacgctttattctcgttcctgcattctattttactgcgaagtacggcgaacaaggttatatgatcttcttgacatccttgctggggttgagcaacgggtatctgaccgtatgtgtcctcacagtcacagtcacagaggcacccaaaggatacaaatacaacgtaacttttactctgttatatacttcacgccatcagttgctcaaagatagattttttttctcattgcaatcttttgcgcaggggccagagcaaaacgcgctggggaatgttcttgttgttttcgtcatgacagggctgttttctggtgtcgtgctcgattggttatggttgatagggaaaggttggtgatactgaagtcacctcataaatggtgttactagtcttttgctgaggccacatttggaagcacctagtttttaagaaattgatttatagaaattgagatcgttccaaacatactagtttatgactcagtttatagaaattagattcttaatttcttaaaatcaagaagctagtttctcttagctaataaataaaaactggtttattaaaaactaggttgctttcaaacatagcctaaatgtatcaacatcgatggaaaaataatgacaggtacaaaggatgatggggtagactggtaggatgctgaaactaacttgaagcgtcgtcaagtcttaagcgaagtttttactggtctcctttttaggagaatggcaggtgctctgactttttcattataggaggaaacaccaaatgatcacaatgttgagggctcgtcgaggctgattaagaagccagacctgaagagagagagagagactaatctgaggacctgcccccgggttattggccagagtcaggaaccaggaaaatacacagtcacagacacactagcccacgcccgaccgcccccacgctcgcagtccactcgatgcttttgggcaacgtcaaaatacctttgcttgctgctgagaataggcgcactacgctgcttgaaatggtcacgccaaagcaactggtcctccccttcagacattaacgagaggaagaccagtatgtttggcaagggttctccagtcatcacgcaggccttgcatagatgatgttcaatgattcggctcagctcctgccttattagcccgggtcacagtgttgtctgctcctatctggataagtcatccacacacgcatcaacttgctcgtaag

SEQ ID NO: 620 - DNA, 1647 bp, Zea mays
  misc_feature (1)..(100): optimal_loci_264447_G1, chr7:163932815..163934461, Cluster 4
cctttcacatggctaagctaattaatactagtgtatagctacagctctactgtatttctctctctctctctctctcatatggaactgctttgttggtgtgatgtttcgggtgtatggacgcatgattcctcccaattattttgccttgaagccgtgcatccctttatgtcgtagaggctaaacacataatactgccttccttcgcctcaataaaaaaaaagagcactagctagggtgcttagcctagcactgatcattgatgttaggtagtacatattgtgttctttttgttcaccccttgtaggtgagctactagctagaaaaaggaagaagaagaaagtgagaggtagccaatgattaaagtaaaagcgtgtgcgtgcggccactcaggcgctgagtacgtgtaaggaaagtggcgatggaacggatcgagcaacgaacaggactggcatacatcggaccaagatactacgacgtacacgtacgtacgtacatgatggtatggtatgaggcagctgcagtccacgtcgctgtagtagtcaccatcaggtttgcacacgccggtacgtacgccactggctggccagccatcagtttcctggcgcggcaacgtgatccagcgtccagcgagaagcgtgatgccttttgttttcccttcgtagtagtagttgggaaggaccgtacacctcgtaggtaggctcctaggctaccgtccgaccagcttagcctacgctttatatgccaaccaatcgtacgaccatagacagcagtcacacacaagcaataacgatcgttcaaactttttggcacgatattctcgctgattctgacagcgtcatcacgcatagatttatagtttacagcggatacgcttatcttgaccctggcagtagacagtagtaggtgtgccgacacgagtgctcgagtaagcaccaccaccagcacctggctctgcccggacttcctttgcaaacaactgcaacgaacaaacctcggccacgccacagatatatataaatctcgctgacggggtgaccaacatgctttattttatttttcttcagagaaaataacaaatactaccatacaggtgagaagaatcttgcagcaggtggcgaaggacgatagcagagaggagctactgagctagctagccatagattgctcaacacctgggcgaaaaaaacgcactaggaaaaaaaaaggaaaatagaatactttatatatcctgtatacccttcgggcactattgtagtattgttgatcgtcacggaatattcggctaataagcaaaagtcaaggtctgtgtccaccaccgcgtacacatgcatcgctgggccgtgcgctctggaccggcggtccatccatgacgacgattccccatcttaccctatccatatcatgcacatacgcagatgcggagcggcacgcacgttcagcctgcgccctgcgtacgtacgtgagcatttcgtcaccgttccagtgtagcgataaatctgacacagcggcttagctttgtggatgattagcgtgcgggtttgcgtctggatcacatgctagctcatgtggtgctagctagcttggtacagtcatacgcgccttctgtttctgttttttccctagcttgcgtcaaaaacgatctttctt

SEQ ID NO: 621 - DNA, 1791 bp, Zea mays
  misc_feature (1)..(100): optimal_loci_264594_G1, chr7:164789306..164791096, Cluster 4
tccaatgcatcggatcgggagtacgcacgcaaccctctctctgccgtcttcagtttacgtgtactagtaaaataagatcgactctctggcgcactggatcaaaaacaactgctgagctttcacgtcagtgatcacccgatacgacgtacgcctcacagttctgttctatgctaatagcgccagcaggcgtactcctccttctcgatcgatgattggctccactactctttagtggcatacctaacaattaaacaacgcggatggttccgaattcccgttggttacacccacctcaagtatacgtctgcccccacacccacagcagctctaatggaagggggagcacgcatggtcagggagctaagctgcggaaagagagtgagtgagcagaagagcactgtgcgcctgtgaagagaagggacaaagctggatgattaatgacgccagaagaaagggccgcgaaaagcgccagggaaagggtatcggggaaggcgggcgagacctcgctttcagaggagcagagacgatcagacgagaggccattatggatttatggtacgggctactacggcgtcacctgcagacattttaacctgatccaccacgcggcggactgcagtctacagaacaggcagccggactggcggtgatgtgccggcgcagagcgtgcggactcctagagtaaaaaggcgccggtgcgttgcgttggttggttgatgtggatgcatgcaccgcggccgtggccgtgagattcatcggccgagagagaaggcgggactgggaagtctgggaaggaagcaggatcccggaatacggtgcacgatacaatttttagcggcgagcacgaagccgaggcgaggcgaggctcgttggataaactaatgagctagtagacgtcaagcaaacgctgaaacctatcgaactcgcactcatccttacgctagctacttcagtagcagtactactaccacttacggagtagtagtacgagcactggtattgatcttccatagcctggatattcagtcagtgcgtggtccacatccacacccccatagggccatatatagaagcagaagatgagaagagtctctcggactgcacatacagtacagcgtagtcctacgtacgcatcgttgcaccgagacggagcaggaccccatgggaaaatagtaccggaagctttataccctgtatgtttgaaagcaaactagtttttaagaaaccggtctttatgttttactagctagagagaccaactttttgatttttaagaaactgagaatctaacttctacagactaagttctaaactaatatgtttggaaccacctcaattcctataagtcagtttttttaataaaaaaactgtagggtgcttagttgcacgggacagcctacaaagccgagttattttgttgaggtaaacaactggactgcccacgggcctacggacgcttcgagaacgcacgcacacagagtccctcgatttgattgattccatgctggcgagtggcggatgcaactagctaccggtggacgacggcaatggaattggagctgtgtgggaacggggagatggacgaatgatcgagcggcatggcccagtcggggatttgccgtcgtcccaactctcaactggagtgggtttcgtaatggctcaactcgtgcagcaaactggagcggatgcaacataagataagaggccctgtctggaggggtttcgacggctctcactgtagcattggagcgccccaaatctattatgcctcatctgacttcttcactttgt

SEQ ID NO: 622 - DNA, 1761 bp, Zea mays
  misc_feature (1)..(100): optimal_loci_265089_G1, chr7:167630499..167632259, Cluster 4
tttgagtggatctttcaccctcctctccgtcgaccaaaaaaactaggtaatgccaaatcaagccttctttcctgtttgtagacccagctttggtcaggaaatgaacagagcgtataacagttttttttggagacaagaacaaaacatgtactgcgatatggaaggatactgctaacatggcatagttggattggaacagcctgagcctagaagcaggttaagcacagtaggaacccaagctgtagctgaagaacttgtgggagtgcccataactagcaaggccaagacaggcccaatactatcccatacattgggacattgggtaccccagcaaaggctgctgatcagacaggcattgaaatcctgttaaagattcctcagactctgaaactgaaaggaggcaaaggagctggtggaccttatgcgactgagagcagagttggcacgagcgtctggtctgaaccaacgtttgggctccgttatccattttttttaaaaaaaacttggttcatacacaaagatgtttaagaagacgaaacagtacagacgactgacgtttcttttctgtatgtgaaagaacagattctcctacactgtttggtatcgacagcttggccttttggtcggtatgtattatacatactgtgcaattgtgcatctgcttagaaacgatgggttgcagtgcttattggcgagtaccagtcaaccagtcatagtattacaagccagtcatagtattacaagttctgtgggccagaagaagtgaaagttgagcgctgctgcaatcattttcagtcaaaaaaacttactaactgtatctacccgacaggtctgaaactggtttgagagatgcaggcgctggtgacaatggttttaaattaattgggatagcagcaccagcacacgtggtggctctatgaactgtcaaacaaatttagtgattggggaaactggtcctgtctcctgtaccagcataacagtagcagcggagaaaacggttgctgccaactgactgccatgatgagctcgacaattagttcgatatcgatcaggaagacgatgcgggagataatgaaaggcctgctatttgttgcttcatcgtcaacgtaccccatggcccgtgccagtatttgggccggatggttttcgttgcggctcatgcaatgggcttccctgcttatacagaaaggcaatgggctagctaaccttgcaactggcgactggctggatcttgagttcttgacgaacctgcaaaagaaatggaagggtgaccacttctctttctaccgttttggatttcaccctgtcaataaaaaaaaagagcacactgctgcaaactttctcggtgagcatcaaagcaagtattctcaaggcaccttcagtgccattattcaagtttacacgcttggtagctagtggcgaatgaggagaaagatgctaattaagaggctgcgaagctctaagctaaagctgcgtgaagaacattgctgcagtgattcatggagatggagctgtgttttggcaaactgaagacgctggagctagctggaagcatgctctagagtgaagctactggagactgtgctactcagccagatatgaagagaaaataagtacgtagcagtcagtatgggtatttcatttttggatcaggggtttgccaatcaggaaagtcgcctattctgttgataaaggagaaaaaaggttacacccccaacttctatggatcgatattttttcttgaaaacagatgttgccatg

SEQ ID NO: 623 - DNA, 2277 bp, Zea mays
  misc_feature (1)..(100): optimal_loci_265222_G1, chr7:168294782..168297058, Cluster 4
tgagacgatttctactgcagtagtgttccataacgaaatgacttcaactgcactgctcactgaataaaactagctactagttgtcgaaaccaaacaactcgcagccctcctgacttggacagcataatactggtctgcagctcggaaatcaaactgcacagatacagtgttgcacaaactgcacaaaaaccagaaatgttaattacacttgttagaagcatctatatgtgtaagagcagtagtaggaaaaagaaaagaaaaacagaaagccttgaactgcataaactgaactggacagcagttgaatctcttggcctccttgtgacctgtctatgtcgcaaattctattgtgaagttacagctattttgtttcaccgtttcttccatggcatccttttgcgttcctagatgacagcaaggtttttgaacctatgaatcccttcattgttttactgaaatcacttccaattttcaggtatgttctcaaaagttgctgagcagaggttcccagttgtcggcagcacatacaacaaagcacttgggaagaagcgccgctcgaagccgttcgtcctgcgcgcgccgccccgtcttctacagtctacaggcgaggcaacacgccaacacggctctggctgtctcctccgggcgcctcctgtcccccacgtttctagtcgccgagccgagcaggagaaggcctcgccgagggacctgcgccacgcaggattgtggccccgcagacgcgcaccaaatcggcaaatcggcaattcaatcaactttctctcttccgtgcacctgcagacgcgccaaatcggcaaaaatcgcgcgggaacgcgccggcggaaggcgagcgtcttcttttcgcgtgcgaggcttttgggagaagatataagggtctattggaggtatgattttgctatttgcctccaaaacaacctcacataatgtgcttccgcatgtttcgccgcgtcgcacgttcgtcacgtttacggcctcctcctggagaggcgcaccaaaaaatacaatcaaaatttgtcaaaaaagaaaagaatatactaaacatagcattgtatgcactgttctttttatacgacccacgtatcaaaaatatatactcctaataaacaccaaaaggcacccacccaccgcccagcatcccctgtctaggtacgctacggccattcttgttgtttaatttgcacgacaccaacccccactcgctacacgcatcctaatcctgcccacgacttgttgaacgcctctcacgattttaatacctgcaccggacacgtgaaaggtgatgagaatcactgaatcaggcacgcccggccgggagataatctcgcacacttcctggtgcatccatcgtttattacattacatttcgatgtgaagtttagtctctctgtcatattaagtgctacctttttttttcttttttactgtcgaagaccacctatacctagatacacgtagaccgatcactgtgcatcgcatgttccattgcgtccaacgctcattacacgcatggcctccttctgaagccgtgccagaaagaatggaagcaagtgtttcaaattttgtcaaaaaagaagaatgtaaacgtagcagagtgtatgcactaggtctttttataggaccaacctataagaaaaatacaaaacaccaaatgcacccaccgcgcaacaacccttttatacggtcattctctatggtttgcctccggttgacacaaaaaaaaaaatgttggaccgtgacgatccgaggagacggcagatcagctggttgcaagcaattgaattgttcaaaactttttcgaacggcaaatactctgtcccatgcggtgtcattgcgaaagaaatggtttctctagtagggcgccgccggacacgtcatgatgacgaagacgacgaggagaatcaagcagccgacacggaagacggaatgctaggcgcaaaaaaaaaggaaaacaaatacaaatacaaatactgaaataccacggcgacgtggacgtcagggccccagcggaggtcaccgcgcaccggccgttgggtgcgggctccggcattctaccgcgggcgctgggtgggtcttagtaaacagtaaacaggtttccggatcgatatgaacggaaacatggtacgcggaaccctacaaaaactaggatttaacactattgaaacgagattgttctcacgttcccggaacggaacgaacgttcccggaatgagaaacgtggtcaggttcccagttcccgattactaagggtggataatgttc

SEQ ID NO: 624 - DNA, 2919 bp, Zea mays
  misc_feature (1)..(100): optimal_loci_282994_G1, chr8:104609888..104612806, Cluster 4
catccatcacggtttgatgcatcataccgagtagtcttcagccatctcaatattcgagcttgataaatacatcatgacaacggtctagtggagtgaaaagagagtgagctaagtgaatcatgaggtggtagagtaatttgaaaagagagaggtgtcaatgaactcaaccacccctcctctatttacaggttggattctaggatttttttaagagttttctctaatttttaaattcaaaatgacacgaactaatcagaaaatgtcacatggcaacaggcagtcagtactgactagttaaggtcgatatcaatcgagtctccaaaggcgggttgataccgaccaattggtatcgatgcggttccaacacagttggtaccgactgtgttgctcaaacctatcacctgacctaaccgattggcgttggtgtcggaccgatcgataccgaccacccgagacgctagatcttcggtcgatataggtcagcgttggatccagactaatacacatgctaggccacacaattgtttctgttttgcagtacagttcccttttcaggcgaccgctgaccaaacatgtagatgcaactgagggcatgtttggagcctcttaattttctagtttcaaaataatattgtagtattaagagaatattatagttttataggctaaaaggtgttcagtttaccattttcaatgttttgtttgcaatactatggtggggtgttgccaacgtcatagtttgtgtttgtgatactggatacttcactcttgatcaaagttttctctacccaagagcagcacacacacatttatttcccaactcatctaaggagaacatggaggaggaggtgacgacctagctccactgcagatgccccccctgcacgcagttgcaggagctacacggcaatggccctcccccggcgagcagtagaggcgatgtggcttgggacaatgggaggagcatgacggtcggggtcggtgccacgccgctctgccaagatggctcatcttcgtgcaccgtgacgtcatggatctcgcacccgtgcctccacagctctcatgcccgtgcaccgcgccgtcgtggatctcgcgaccacgcctcctcagctttttattaggggattaaatttttcggtatgtttttttttcatcttgtgcagagtctcactgatcttgcaatcccacacacttacatcctgtgagaacagaccccatggtaggccagttgaaaactcttaaatacccatcctacaaaggaatataaagaaacaaacatgtcaataaccataagatttcagtgccataacagaagctccaagagaaagaagaaaattgcatatgaaccatcaaccatgaaaaacctcaaagcatacatgcaagatcatactgaaaagttatttacttacatggaggcaaaccagatttgccttgttataacgtaaaagcaagattaaatatcagtgctctaagactattctgccagtacgaaatgactattaagaagtcaatagataaaacctattgaaaccaataaatgtatctttgctttcaacagtaaattaatttctatattacaaaacgatgaataatccatgccagtttggtatttggaagaggatgaaacgcctgtctgattgtagctattgatgttaagacatactgatagcattagtttgtattgttctacttcagctactgtcacacatgtactgtttaatcgaaaatatatgttttttaggaaggttaattttcgctgttccgagttcagcacctactctaagtagcagaagtgatattcatttctaagttttataatatctaaggaaggttcagatgaagttgtgacttgagacaaaaaattgtgatttaataccactgaaacctaactttattgcaaagaacactggcatgtgccatcatactatatataatcatataaggagccaaggaggggctaccctagtgcaatatgacgttaatttatagatcaaatgcccatgtttcactatgatctgaattttgctgcaagatgatcaactgagagtaacttccaaaaaatgactcttgtgacatttgcaaattagtacatgtaaatcatgtggttagagggcaatggcactgtggattcaacatgacccttcagtatttcactcaagtaaaatgtggaaactgtggattactcaatcaaaatagaaggccaataatttttttttgatgaaacaggaggggtggatacccctactggaaccaattaaaggaaatatgtacaaggagtttaaggagttacaattgaaaattacatctttactaatctaaatggtttcgccaggagctaatggcagagaaattttttttccttctgcattctctgaagtcatatcaaaaagacctttgaacttattgtagcagttcataactgaaggctctatgccttggaagaaggccaataaaattattacgaaggtttatatctgttgtagccatgtaaaatctggaacttgaacttatgattcaaggatcagttagaaacaactttaggagtttattaagggagcaaaatttcagtgacttcacacatcacaagttgttaatgtctcctcccaaaaaacacataatctctgtttgagagaaattaaatgaaaggaaaggactgttagtggtttttcaggaaaataagacatgagacagagcattctaaaaggattcagttattgcattacacaataaaatgaactccaaacaccaacgtaccaagaagtgtacacacttgcactttccttgcctgcaagtgagtacaagtcaaacttaaatctcagatccaatacatatgattttaccatatagtgggaggtatccaaagaccaatgtcctccaatagcatttgccagttaaactccaaggctcgctttaacatcc

SEQ ID NO: 625 - DNA, 1734 bp, Zea mays
  misc_feature (1)..(100): optimal_loci_282995_G1, chr8:104620976..104622709, Cluster 4
tgtgcgctttctttggtcggagtcggagcccgcccctttctttgaccaattccgttccgttccgttccaaagagaatcacagggacgaccaaaaagaaaacccgtcaccaaatactcctttcctacccaccttccaccacccaccttctacctcctcagatttgcccaaagatttgcttcctgtgaattaatgccctaattgctacttgttttttttactactagtagtgcttaattgttaaacactccaaagcggatggtgcacgaccagtagaggatgcaagatgagaattcatatcgggtcaagaaaaccgcatgacaaaattaaacaaaactgtaaaaaactaatgttgcgtagaatttaaattttacaacaatataaacaaaaggaacaaatatatcactaagttcttgttgactacatcaaagtcgtgcgtaccttatcaaatgtcagcctcctcgaaggaggacgagggtaaatagaggtgacatcactggctgagagccagaactcgctggtttataaactcgccagtcaccggagatggatcgtatcgtcacaacgagtgagatcggaccaagctcgctagtcgccgggatgggttgtatagtcacgacgagcaagatcagaactaccggacggatggaccggtgtcatgatgacaacggcgagcggcgggacgtggcactgggcagggagcggcttccaggatgggacacattgacggtggcagatgtgagtttcaaaatcaacttgagtgttaataacatacttactactgtagttccgttccgtgtctcatgagagcacgggaaattatttgtacgtctgaataggtgacgctgaggaagccagttaaggaaccttacgcgccggttgcccttgcaattgcccccctccacatccggccacctggcatgcatggagatgttagtattatttgaggctgacgtcacgaaacgccctggtggccgtgttggtgtagccgagcctgcctgtcgtacggtcaccggcacggcagtcggcaatggcgacgcgccgagagaagatgcgggctacatttccttatcacctcggctggtgcctttttcatgtctagccggccggtaggtggtcaacgtacgacgactgaaatagacgatgcccataggacgagaataggaatcgatagaaacctttccgtttcacaaaatagctttggcttcttccatctcaactgacctaaacatccttccaaaaaaaaccccaaaagagacaacactcgtactaagagctttagtaaatactatatcggctaacgatgcggacgatagctcaaaacacaacaagagaaggaagaagcataacggaacaaatcacacagcagtgctggcgcccctgcgtttttttttggttgatttgagccaaaattttgcatgcatcttataaacatgttgtactcattcacgtataggtgctgatttacgaaatttaacgtaaatggtaatagtaatgaattacatttaaataccgacgataataagtttgaataagacattatccatttatagtatgatatcgagtacggttgaacttaagcaaacatgatttaacgttatcggttatctattacgttaccaatatgtgaaccaaacgacacttcttgtggtagccaccttatcaacatgtggtagtcacatctactatgatttaatgttcgtcccccacgcactagcaattgacacgtttcgata

SEQ ID NO: 626 - DNA, 1463 bp, Zea mays
  misc_feature (1)..(100): optimal_loci_287717_G1, chr8:129954219..129955681, Cluster 4
ctcaacacacgaaacaaattcaggttataatttggaaagcaatcgaaggtaaacaaacatgaggcaaccaagacggtaacctaggattaccttcatatcttgcatgaaatgcgtttgggttgaatgagatctatttgtccaaaacaaaaaaggaacagaaaacttaatcataaatttgttttgagaaatgccaagtagaaatcaactataataccctaaagtcatattttaggtaatttaggatgtttaccacaagattaaaatacttatgttgtgaatcaagggattaaatgaaaagagcctctagggagttaaattattcctttcatggaaacctatacattgaaatactttttgaagaggtatacaaaagtgtggcctaatagggacttcatggtcatttataaaaaggtaatagacatctaatttgcaatgaagttaatacttattttatttaataaaaggaaccctaattattaaattgtgtgttgcatttttatcaagtttatacgatttggggcatttacttaaaagagttgaataatgatagtaaaataaaatatatatactttgcatcatgctatatctttggttgtgcattcaaatatgtgaatctcaaaactagatttgaacttaaaaagaaattaagacaaaagaaaagaatttatgcctgttctgggccatctctccaccccacggcccatctcacccgtgcaaccggctacctcaccccatcccatcttgcgcagtccagcttcacatccagacatttgtcgggccacttctctgccccgtttcttttccccacaagaatgatgtgtgggccccaccggtcagtctgacctcacatagcgcatacatcggtactgagtgcctctcccaccgtcgggtgggccacgctcgccagagactcgcccgcgcgcatgctctgtctcgggcactggctggtgggacccctactcagatgtcacctacctagcgataaggcagaagtcgtaaccaaacagagagaccgtagccgccgggattggtcactcgctcgatccgattccacccgtatcagactctccccataccttataaaacttacgatccgtgaccccatatcaggctgcgtcgacaactcgaagccaccatcatcacccgggcgtgaagtgcatgccaagggagatttttgtgccgccgtcatggtcccacaattccatggctgtcctatgcacgtggcgtggtcggggatgaacgctagttcatgtgcaaaccttctgcggtgtcatcgggtggatagggctaccatcgccgactcaattgctcgctggagacaaggctccgccgcagatccgcccccaccgtgggcgggtatttttcacagcctaattcctccgtatggcgccactactagcttcgatgttttctactccttgcagagcgctaaaccacgtgggagattgcacagggggtcgccc

SEQ ID NO: 627 - DNA, 2232 bp, Zea mays
  misc_feature (1)..(100): optimal_loci_290611_G1, chr8:145851266..145853497, Cluster 4
tttctattgcggtgcgccggggtgagccgtgagccggcgaggagacttttgaacgcgaggtcgcgcttttgcccgttgtggttgctccgtcagacgcccgagcccgacacccgccccaccacccggccccgttcattttccacgccgagcggtggcaggcaagaaacaaaaagggtagctgcagacgtactagcatagcatagcatccagtggagtgggggcagcaggcggctgcgggagcgagctggtgtcgtacgtgtccgcttctgcagttgcgttgcccagcatcccttcccgggtcggtcggatctgacggccgctttgcgtgactgccaggcttcttcctcgccgctgccgctgccgctcgcgcgctgttgctttttgccgttgcaaaatacaaattccagagaccttatttcctggctgacttttcctcctccttcttcgctccgtccgtccgtccgactgacctttatttttatcctttttctcccttctttctacctcgtttctgcgcgcttctggtttcgtgttccagctttttggaaaactatttgccgccttttgttagctcatccatcgtccacgatttgcggtactactaatatggtagttgttttttaccattcaaaaaactgatatatataaatggcaaaagaataaaggagagccgaatataggaaatgggtggagagaagtagaaatagaagaaataatagtggaagggaatgtatttaaatatgaatagaaagtaccaatagaggaatttgggagggggatggttgaagatagcctacaagtgcgtctctaactgcgttagctaggcagcttacgaatcagcgtgcgttagttttccagtattacaggtttgggcgcactctggctggacttttttttagtgtgggtgggcaggcaactgggcattatttaggtggttggttggttagttacaccgtcaggcgttcacgttagctggtggtggaattgcgattccaactaactgccgtatgccacttaaggtgcacgcgccgttgctggtaacttgtaggtaaaatgcatgtgcctgacacaccgcactaaggctgtcagcagtagatcatatacagcacgagatttgcgctgtagaataaagtttggaataagtgacacgataagggataagtcctgatcattaacatctgcgtccgcagggtaagaacggatagtgcaacagaactaatgtggccatagctttttattatttctatatatatgcgtcgctttcgcactccaagtagcagtagtaggcgtacactgacaggactgctaaactgcagttctagaagcactagctgatggatcttgttctctcctgccctacggtccacctgtacaatactcacctactactacctatattttttttttcctttgacatcgtaggaaggcactccctacggcctgatcgctgcctgtgccgaccatgaagtcaggtcccggtcactttctattcaacaaattctactgacgaccgttgagaacacctggttccggaggatcctacggcgctcgtgcccttagttcgcgggcttccactgcagttccgttcggaggtcgccgtctcccgcgcccctcccttttctttttttcttttatatgcggcgtccttcgcttttcctacgcgctagctgactgcgatggtggtgtggtggcgtggcgtcgttcggtacacctgaccgcccgcgcgcgagtgtcggtggccggcatgccgatccgctggtggtggtggcttcgggcagacggcctccggacaccaccagctgaccagcaccaggcctaggcagccaggcaacaaggcaccccgcgcgcgagggcgaggtgactcaaaatcagaaaaatttggttgtctaggaagtgacgtgaggagcaacttcatgactttttggatgggtatgcgggctcaaaatcagtaagcccgagtacgggctacactaatcctagctaggatcacgggttctcgtaccgtttacagtagttcactcatcgtcgcctaaaatactgtcttacactatagactataatttttatagaaagtggagtttgaacatatagatgaagatataaatggataagtcgtcgaagatagcctaaacatctatgagacaccctatctagccagtgtgttgtagatcaaatgaacatggcttaggtccactcagtcacatgtcaggatggcaaatgagaacatacttg

SEQ ID NO: 628 - DNA, 1567 bp, Zea mays
  misc_feature (1)..(100): optimal_loci_291853_G1, chr8:151725628..151727194, Cluster 4
agtttgattggacaattcagtcatttagtgccactaggtgttggaattatgtttgttgcatttaggcctagtgacacactcagagagcaagcaaaaaatacttatagaaaacactttgaaaaaagttaactctgctctaacatgcttggtaaaacatttgtgagttgtaacacttgtaagaacgttgagagtgctctcgatgttgttgttaagcacactggacatgtctagcctgcactatatatatggagactatggttttcacgtgttcagtttttcgccaagaatcaaggggtccattgtgaaccatataccactcactggaaaggagtttttaggtgaacatagtctcaccgcacatgcctggtgctgacacaggacgctgcacctaacagggaattcagagagtgtgtaaatcaggtccatcagctctaacatgcaccaaacatgttatatgtcatgtttggtggtgcactagacacctaacacacagtaatgcctagtttagagtcgttggaaatatagcctttgggacacgccaaatgtgtccattgtaggcacatgtggtgcattggacatgtctagtgcccttgcaatagtccaccgacaaggcactagttggatttgtttggggtctacaaatagaccttatggaagtctttggctacatttttggcacctcatacacttatgtacacctcttgagggttgagaaacacactccactcacttgcatcctatggaacatcatttttgtgaaattgaatagcttctagtgcattgaatttggttcttgcatcttgtggaaatagttggagtggcttggaattgttatgctcttattagtcttgatgattgtcgtcacctagtcgatcaagaggtttgtgggatagttgagcggtttggtgattgttgttggcttcaaccattgatagtaagcgtctcttgtgctcattccccatgggagattcacaaagagcaactttagtgggatcatggctggttggagtgtctctttagtatggtcattacgacgctcgagtagtgggcttggcatgtgatgctaattagtgtgtgaagcacctagcttggattttccacaacaagggcttaggttggcagcaagaaactaaatctcagggatgaatcattttgcttatttcacttgcctaaattggtttgcttactataaaacttgtatttttattcttagttttttcttgataatgttattagttgcttgcgtagctggcataatagcagtgtaattgtaagtttagttactcttgttagtagctttgctagttgtagttctctcttgctaagagtagattgtttgtttgtatgacatatacgtggaaaccgagctactagaattgattagagggcttacctgtggtgaaatagagctagagcaagtagtcgcattagcaccatcttttgtactaatcaaacttttttctaatggtttatgagtttttagtatgatttttatagtatattcgccctctctgaacatctaaatcttattggccaccaacaatttaaggcttagcaacttttagtg

SEQ ID NO: 629 - DNA, 2163 bp, Zea mays
  misc_feature (1)..(100): optimal_loci_300708_G1, chr9:17629486..17631648, Cluster 4
aaccacaacaaagtgtttaggggatgaacagtgacacgctatatctggggggagagagaagggggccgacgcgtaaggggcgccgtagggggcaccgctgcggctgtaaaatgcccctacgcgccgcatgcaaggggagggggctgggatggggacagcgttgcgcatagcctcacctcactacgacgctacgcttgcctggggccacacgtcagcaagctcttctccatgtccggcctgtgttgctgtcccgtgggatccgagcatcagtcgcgcgcccgctccctcgtccctagtctcgctgcagcgttgggcccacctgtcattacttcctccttccttcgtaacagctcccgctcagctcggagtggacgcacccgaggcggcaaccaccccaagtctccatagagaatatttgtgtttatgcacaccccaacgaccaacgttaatttttttttgctaaaatgcacatctgtgtctatgactctctcgaactggcatgtcctagcgacgcactgggtccgtccatgatggaccaggaccgttagatcagatactttctggcgggtaatgatgggaaacttcctcggcatgggggcattcaggttcctcgggcggtccgtgttcaacttgacaaaccggatggcgatcaaagtggacgagaaccatgtttggaatcacgttgtgcatgtacgccagcatctttgggaggctaatacccctctggtcgtcgacctgcctcgcagccgcaagagccattgaacatcatcgtcctccacgccagttcgctaggtaacactctgtagttccctcagtggtctgtatgtcaaacgtctgtacatcaaattagcatattgatgacgctagttcatatgcacatacattcactattcttcttgggaacttacttaccatcttgtattcttgtgcttgatgaaatgacagctttgttcagttagggaaaaaaaacctgaaacctgttgtagataagcacaatcagtttaaaatatttagttattttgagtagtcaaccaatagagttggccttgctacttattgcctttttttgtcatttaccaaactgttttagattattgaattgctgcaatagttggatcaaccattacatgcttcctagttgacttgtcgattgcaaattcagctagtatatatgaggttgcgacacccaaatgtggatgcacctcaacctggacccgcatcggcatctgaacggtcaccccccaccaccctcttccgcttccgcaccctagaggcatgtgagagcaggactgctgacagtaactttgggattggtctcccgtatacaattactccagaatagaccgtagtttcttgcttcatatagttttagagaaagtaattcttttggtttctggtagtttaattggaggcacagtcctctgggtctgcccttttcattgtcctggcaagaagcagtttattttgaccttttcagtttacagcacactcgcacatataggaggccactggggatatcagtttacaaaagttacagacacaaaaagaacatcaacactgccaccaagaagggcaaggaaacactaaacaagacaagcttgaacgctcctagaacactttttaaattgctattatgtcacaaacctcttcatcactccgtcgaaagttatggatccagcccttcatctcttccaacgtcttctccatcgcaacttgatatttagatgataagttcacaccccagatatgtaaaaagagatagattcatgtagaacaacaagtgtgttgttctgaactccttatcaaacgccattttatttctgttacgcaaaatcacccacatcaagcctgctaacagaaaaaggagaaagaggttacagtgaatctacccaattaccaaaaaaaattctccaccgaacaggaaatattgccccaaccaagcatttgtttaaggcggcgccaaacaaagagggacaggatacagtggaagaagatatgatccaccgattcatgaccctgacacaaggagcagaggtcactccctttccagccccttttcttaagcacaatatttgcctggattttcatattatacaattgccacaaaacaccttaatccgaagcggcaccttgcacttccatatggtttcataaatgcttttc

SEQ ID NO: 630 - DNA, 2919 bp, Zea mays
  misc_feature (1)..(100): optimal_loci_302770_G1, chr9:31209048..31211966, Cluster 4
ccctcctcctccaagagcttttgcttttcacgggaaaaaaaggtgaagggacaaggaacagtgcaggtgcgcgcgcactgctggtcgcaattcacaaactgcgcgcgtggtgctcatcgtgctgcggccccagttgtccgtcgacccccccgcgcgcctgccgagagggccggtgccgcatttttcgccatgtcggccgggccggcgtcgttgggtctttgcattgggattgggatcgatcgggcggcgctgacccagtgaccctcccgcgagtcaccaccgacccgccgtgctgggcgggggagtgcacgccagcccgcctgccacacaaattacgtgcgcgggggcgcgtttgggatttcttcgtcgaccgctcgtgtacgggtggatacaaataaccagtagaacaagtcgtcgccctgacgtgcgtggtgcactgcaggcggcatgggatatgcatggtggattggatgggatgacacggtcgcccatcgcccaaaccaacggcggcgccgaccacggctttcgtcttcgtgcctgtgtatccctagcttcctgttcgtgcgtaccagggagggtctaggctttgagcctttgacggttgcacgatctagatggaaattgatcgggagtacaccccaccccctgcagggggctacagctgctctgtacgaaccctactaccactgtgttgtgctgatttactgctctgaacttcctggaggtagtggtggctgtggaggttggtacaagatccattgcatttttttacaaattgtttagcagaacggctccggctgtattttttatttgatgcataaggcaaatgccaacaatgccaatgcgtgaccatttgcacgaacaacatgtacatataaacagtgcacaaacaattcatggccatgataaagttttaaaaactgatgatcaaatagtttggcttgaggcgcgggggcggctgaggttagcgtgggtatagacatgagttctcggtagttttcttgcgaaaaccggcgagaaaaagtaggtctcgcggcgagaaacagcgaaaaccgtctctgttttaaaaaaacaattttgaaatcccaaaccgttcgggaacgtcggatttcgacagttttggtctggtttctcgttttccgcggtggcggggcgaggaatttgtttcgaacgggattggtaaacctgggtcccatgcgtcctagatctgggagaactgctgggacatgcttgtcgcggagctgcaatgcagccgcagtaccgatcgtgatggcagtcgaattattagcttccttactcactcactcacgcaccaaccaaacatatagcaatggcacatgacatgatgagtcctagactcctgctccggacaaagcatccagctatggtggcctgttacagtacggcgcgcagcagttattgcagttgcaagcatgattgctcagatatctttgtctttgtttccttgtgccctccacctacctacctatcgcaaccgtataggtagtgcctctccatcgatctatgatttgtctcaacagctagctgtcttgattagattgtgtgcgcgacgccattattactagtgtatgctgttgcactcactccgttgaggaattgagttcggcgaacaaacgccgaaaagttcggtacggtgcacatggctgtcgtatgggcaaagctagtagctcaatggttgaataatgtggtttatttgttaagtatttgttaagatttgtcctttttttcatataagttatgttttggttatccgactttgtctgaaccccctggagaaagtaatttggggaaaaaaattccccttcaaaagttatagaacaactgccacgagattaaaccagttcaactgcaaaaatctactcactctttttagaaacatacataaaaaatccactcattttgagttagatgctccacggctagctagctgatttttgagtcctggttttttttgccatggcatccgagaacgggaatccttcgtccactgttagatgttgactcgactgacaagaaggatctagagctttcctctactcttcgcaggcaggccgcggaagctgctgactttcaccaccgacccgccgccaacgccggcacttgccagaccgccacgcgaatgaaacggagcgatgatgtcgtggtagtagtacaattttttttcccgcacgccgcatctttttacgtgcgtttggttcacatgattgaagcagagaaacggtcaaggtagacttgtcagagggctcaatggcagtagccgtcacccctgcgcagaggaaggataggattcatggcaaaagggagctcagcctcttcctccttcaacatcttagattagtatcaatgttctagtttattatttaagtttctttttttctctctcactatagacagagagcagttctgtttatgttagagaggtattaccaagttttttttaaaatttttattgaagattttacttatctaattataaaaaaagattagcaagctgatcctcttatcttgcatggtgacaaaggtttactgtcttcttttattttttagttagttagtttatatttagttgtaaatggatatatgtatgatccaaattttttctaaagatatgtttgaagacttcaagtatatagttatatataaaaacactggtttaaaatactggttttacccttgccttactgctccatcccagagaagccaccgttggctgacccctctcccagcctataaaagggagagacaggtctcagagcaaggagatcaaaaggagagagtttttgaggaaaccagacgccttcagacggacacgaacccacaaggacgaataggaggaggagcgtcgataaggaccaggaggctagagccttgccaatccaagacttagctaggactcaa

SEQ ID NO: 631 - DNA, 2067 bp, Zea mays
  misc_feature (1)..(100): optimal_loci_309558_G1, chr9:74591393..74593459, Cluster 4
accctcaaaaatttgcaagggaaacactatggataatggggggcaggaaagacaggttcatctgctcttggagtgacccctatcagtcaaccgatcaaagtcatattcagaggcctgtattatgatggggattcgaagcagggaaccgtattctagctagctagccaacaatcgacgcgagctgagggaaaaacataagaaaagaaaaaggtagtttctttctcaaaacatggtcaaaagtagtttgaaaaaaaaaacgaaaattgtgttcatttcttgtatccgaaaatttgtacatgttcctggttttgtgcacgtttgcaaaggtgctcgatatgacgatatgtcctacacttttggaagtactagaagctgaagtttcgtctggaatcaattgtttgggcacctcctgaagctaagataaagcgataacgcttgtgcttccggccacagaaaccagcatgcagattcatctctcaccctgcctcttttgtgtgtgtgtgtcggccggagctagcactgggcaaattaaagaaaacaaacagaagcaggcgcgcggcgagcgtgtttgttgcgcacctgtcgatgcggttgcggagcttctggaggaaccgctggttgtcctcctcggcgacgcggaagacgcgctcgatgaactcctggcgctcgccaacgccgagcttcctcacgtccacctccttgaaccgctgctgcttgccgccgtcgtcgtcgtcgttaaccccgcccacggcggcggcctccgacaggatggcggtgcgcacgcggctgtaggtggggaggcgctcgatggcggcccatcgcagcgcctcctcgtcgtcgtcgacgcggccgccgcggctgcttgtccgggaccgggagccgtgctgcggcatgaagacgtcgtcgacgccccacgcctccatgcccatgccgcggccgatgctccggctcatccgccgccccgactcccacaccttctccatcgcgctctccatcgcgtgtgtgactgtgtgtgtgtctatatatgtgcgcgcctgtctcttgtctaccggccggtgtcgcttgatcggtccaggccgggcaggcagcacccggctcccggcaggtggtcgtcacgccgctcttgccttgctcagacgtactgcgtccgcgcgctagacgcctggtgttgccgtgctaggacggagctcctctcaggcaaggccgcaggccgggcgctggctccttctgcgcatgcatgcacgtcagtgcggcagttggtggtggtggcggcgtgcgagctgcatgagtagcctggattggaagggaggagagaggggggtgagaggagtgagcccggaggtggagtttatatatatgcgctgctgcgggtggcgcgcggggcggggaaatggccaactgaaatttccaattgtttttaccaggcctaggtcgcgtctaggagctacgctgtgctctggttgggttggtggggactggggggcggcggcgaagcccttttggctttcgcaaggaagcagggaccggaggacgactcgcgggggcattttagcggcgctgcacgcggttgacccgagtcgaccgcggtgggtggacacagccccggccggtgctgagtgctgagtgctgagcgccccacgcggtaggtggacacacacagccgctgctgagcgtgagcggtgagggcggcggatgcgtcgtccgtggacgtggctgcatcatatcggcagatcagaaccagatggcagcgcatttttgcgctgtgttgtgttcatgcgttgactgttgagtgatgtgttgcgggagcgctggtggccggccagccgatctagccgctgctacacgtacggtaggaggagtgccgtaccgttccacttctagcggtctagctagtcacttcgtctgcattccgacttcccagcagttcagtggttacgtgtcaggttttggcgcacatggctgcctctcatttcgttctgtgtggtgtgggcaggccgtgtgtttcatgacgcatcggcctcgctactcgatggccggccattgcagttttggcgagttacttatgat

SEQ ID NO: 632 - DNA, 1630 bp, Zea mays
  misc_feature (1)..(100): optimal_loci_31621_G1, chr1:194488362..194489991, Cluster 4
aataacctgtttggatgtcgatattggagcacggaattgagaattgaaattagctttcctaaattatgtcgtttggttgcacacagaattaagatttgaaatcagagacccaattccctcaaattggactataactagaaactcactctgccaatatcgaacgtcacccctctgtattgcgtggaattagaccgcacaattccaaactctaattcaacgacatccaaacaatagaattgtaattacatctcatttcaatatcatatctgatttggcattgaacccaatttaatttcatatcctccaatatcgacatccaaacaaagcataaggctatctctagcagagcccttaaatggatttgcgcgctcgcaagctactacagatcattccagcagaatgcggatgagtacgcggaaaattagcctaaccaacgggttatctctccttgtccctatacgcgtccataacactcatgtgaatgtatacgcatctgttacactcatgtgaatgaaagggttgctagagatagtctaagtaacttaaatatagagtacacacaattacactctaaaccctaaaccataaatatagagtatgtacgcttgcattcatcctatacgcgtcggttacactcttgttcgttgcggcttgttgcgactttaatatggctaaggttatggcttctaccatattttgtctttatggattgcatctacatcagtttgaatatttaagatccctttctctaccaaatatgctttttaaaacccctatcaaccaaagctaagctctaaattcaccgtataaacacaaaataaggacattacgtcgcctttagccagtcaattttggggcaactacctacttgcttcggtggacgatgtgcctcaacaaggccggtggatctcgttgggacgatggaaagcgcctatcagagaaagaagaaagagagggagagcgaggaagccgcatgcgaatcctccgtgtcaactgtcacgtcgtcaatggtgcgacaacacttgtaatctcacaaataaacgttttgctgggaatgacgtgtcggcatcgtttgaccaatactagccaatagcgcgcgccagcgcgcgcattgaaattatagtgtgccataagaagataatagtgattattatgtaatatggttattataggaagataatagtgatcattacgtaatatggtcatcatagaatgtatcaacgtacgtacaaacaacatgtcttcaacaacgttaagtctacgatgcatagacaaaatatatttggatactgttttccaaataaagcataaacatttgtgttagacaaaagtttgtgcgcataatgactaagattaggaacaccagcctcatcattttctttccttggacaatagatcttacaggaaaaaaaagcttggtcaattcatgtaaaatgaatgtttttgtgttggagaaaaaaatgaaggtcacgaacaacagtcatatattttttaaaaaaatagcgaagatcagaatatatatataccatgtttttcctgttagagattgctgaaccggtgtatggtgagatgactaatgaagtaggtgctcttcgagttgctagtataactatttgcttgattcattagt

SEQ ID NO: 633 - DNA, 1763 bp, Zea mays
  misc_feature (1)..(100): optimal_loci_320642_G1, chr9:136389490..136391252, Cluster 4
tcaaatttctttgaccatgatttctattctatttccctaactttacagtttttttttccaacccacgtcctggtggctagcacaggggaggaggtaccactgtaccaggacgtgccctgcggtctcttcatttatttaggagtatagggcagcacagggtcactcgaaatcacacaacccagcacaggattatgatcaatgtgaaccgcgtatgactgacggtcaactcagcgtaatttccgcggcggagtacccacgagaacaccgtagcaggaatataatatagggcagcacagggtcactcgaaatcacacaacagcacagcagttccacttgccgctcccaaacataatctacacacatcgttgtacatcacagtaaaatttcaacattttatttttactggtcatgtgtatgtccgaattccgatgggcaggttttagggcggcgcacatgatcactttggcacggttcaaaacacggcattattagcgtggcgccatactccaaaggcatcagttttgggccatatgcgtagatcactgatacgaatacgatggggatggatggggctgcctatacatggcacaacccgcgtcacaggctgtgcttaggccagtggcatgaaacacgtacgaaatatgtccttgaatatgaaatgggtagccatttattagtttttggaaagacatgctgcagacattgtcatctacaacgtacatcgtctcgaacacacgatcagatctcggtggtgcaataaaaactgtgcaaagctgatacagtaagctaccaaaaatattgtgcaggatcgcagcgggctacggcacgaatactgcagcagcagttcggccaaggaaaaagacttgttgtctcttgtcgttgccctgaaacgatataaattaaagcacgagaggagcagcaggtcggccaacgcaaacttagcggtaacgaatttgtaatgtccctacgatgtctgggccggtgggccacacccccacatggtatccccaggctgacaaccagaaacagtagttgcacgctggaatagagagagaaagagagtcgagtcaaagagtgttgtcgtgcacatactacgaaactgctcctcacaaacacaccttgatgtcacgttcagaaaacccaggttgcttttgtgctaaggctcaactaatggacaggtaagctgaatttggagctttgcataccctatagtactcaaggtcactgctgtcaaccatcatccggtgttctgatttagattcacatgactaaggctagtcgcaatggagagtttcatagccttgttttttctaagagtatcgtgtcatatataatgaaataaagcataggtagaacacccactactatagtttcataggcattcaatttcataaatcatagatagttggtaatcgtaccaagagagagagctttgttctctcttcttaaaaatgttggaacaccatcgaaagtgtttattgtggcagcttattaaatgcaaataaaactcttatagaattccctttgagactgacctaatagtccaatattagctagctacatattagttggatgttgtttagatccactagctaaagatagatgcattggtcgttttgtctctaatgcccttcttcttctagttatatttgctattgatacacatagataaaagtggtgtgagggaagaagtgtttttttttcacaacatgtagatgctattagctgggttaggataactgatggttattagctagacatag

SEQ ID NO: 634 - DNA, 1969 bp, Zea mays
  misc_feature (1)..(100): optimal_loci_321023_G1, chr9:138238700..138240668, Cluster 4
tcgagagactgtccgtgttttgactgtcgtcgaaaaccccctgtgtggctctagcagagatgggacggcggcgcaaccggacgaggacgcttggaccggctggcggagaccgaccggcgaccgcccctggcccatcaatccatcatcataccacgcacgctagcctccaaccgccacgattcgccacctgcactgccacaaggccaccacgggtccacgacgcgcggcggcaaaacaacacgggccacaggcccacagcccacagccgccgccgagccgagccacgcgcgcgtaccggttacgcttcgagccggtggagtgggcgcccaccgcaccgtagggcggcaggatcgcgtgctccggttcgcgcagcgaccccgcgcgcggcgcgtcggcgggacgcgatctcgcaggctgggtctcgggagtggacggtgggatctgttcgtagctgatgcatgcggcaggctccactttttctccgtctggaactggttatccaaacaaggccggaatggattgcagggtgtgtgcatcccttagatccctatattccagtaacgccgacgagattatgttgcaaagctggcttcttaataacaattgtccatggcgctaaaagggacaaaagaaaacaatggaacgaaaggaggcaggtctttgcatatgatctttgcttctagaaccaagaggtgagctgtccacgggacaggtggtggagggatggagagaggataataataggccccgcgggtaggctaggcctcatcttggccgctgatgagtcatcacacgatatttcgttctctggcgcctctgattccacatgaaaaggacgaatctgattccacccagcgagacgtaaccggccggtcgagataaggtgccatgcaaagacatacaaccggcgagtgagcgagcggtgctgaagcggaacgtgcctgtgcgttgggtggttggttgatgacaagtggggcagccgctacgaaagcgggatcgatggcgtggtgccgtgggccggggaatatggcggtttgatttgatccttcagtgatcttctgaactggaatactcctatagtatagtagttgaggtctggcgcgggtgtcacttgtcgcgccggccgcatggcaggcccgaagggctcaggctcaggctcaggctcaggctcaggcggaaagtccagtggctgtgtcatcgttgccgccggatggatggtcctctctcttgcaagttgcaacgacggctgagaaccacacattccacatggagtaggaggagtacacgtacacctactagtcagtagtctagtcactaggcagcgaagcgagtgtgccagacgagacgtcaagactgtcggtcaacgacaaccccggccagtgcaccttttctttccttccatgtttcttacttttgcttctgctctatggaaaaaaaaaaaggttgacgcagcactacagcccgccggaaagccttaacgaaccagccgatcgaccttgagtacttccttcgtctcgttttttcgacaagatgaagaagctggatattcataacatgaagtaaactttactgtattagttacagaatacatttctatataatttttaaatgtatatatataaatatatatattagttatagacttgattaaatttgggtttaagtcccgttctttttacagacgaaggaagtaaattcgctgcggctgaccgggaggggatatacatacccctctagcctccaacgcggtgctatcattcgctgcggctaagctctatcagactttctatcttaatttttattttaactctattttgtaaataatgtgcacggcctggtggaatggcctgaccggaaggtaattcgctgcaccatgtagactatagagagagcatcaacttctcgcggtaccatgctctgctgcaccaccgccagggagaagatcccgtgaatgaacagcagcaggttt

SEQ ID NO: 635 - DNA, 2103 bp, Zea mays
  misc_feature (1)..(100): optimal_loci_321094_G1, chr9:138688154..138690256, Cluster 4
tcgtatctgtacaactaggtacggtgctagataccgaaacactccgtattgattggagttgattgattgagtttaaattcgtatcaaaataaaatcattcataaatttttttcccaatctcttcctattcataaggtatataaataacctaatctgatttgcgcaactatgtggcctcactgatagatatccatggctcttaataaattccgttgctcccgggttcacatgctctcgtcgtcacagtctgcgcagacgtggcaatacggtagtgtttcgggtgggggcggctttgatgaatgagacgatgtgaagcatccatccatccagccttttacaatcttgatgatgtgatgcgcaggtggtccagctcacaccggagccttggagtataatccccgcatctctttaagcatagcagcccagcattcccgtctgaacagatgtgtggagaaaaagaaaagaaaagaaaagaaaagaaaacgtagctccaaaggtgaaatatttatttattatgatctaggatcacaaagtgtctacagatttcaaaacagttggagctacggcacacacaaaacacacacagcaagacaggacaggagaagcttttgtgtgtgagtcgcgtgaccccccatgtccttttccctttcccttttggcacgacctcggttctgctggcgcggtatgttttttttaggggaaacaaaatggctgcctggctgggatcgaagaagccgggctaaacatgtccaattgtccgttcctgtgtctggatccatgcatcaaggtgtttttgaaatggatcgggggtggtgttctgcttctgcctgctgacactcatgacacccggccttgtgcatgtgacacgcccgctcagggcgtggtagcgggcgtggttggcgaggagggcggcggtggcgtctgcgcattgtgcttgccggagaagcgtcgcggctatcatcgttcgttcgttcgtcgtcgctcccggcacaaaagccccgctcccagatcaggaatgatggtcgctgggtgacgcgcgcagtgatcatgctgaggagaaaaaaaggaaggcgtggacccccccaccccccccagtagaaatagaaggatgcttttctgcgctacatcacctagtacgtagaagttaccgttggtctccgttcccagtggaggagcgacaagtagagtctccatcttcgtcgcgtttgccattctactttgggcccctttacactttcttctacctgttgcttttcaacgtacgccatagtttttttttttttgactgcccgtccggagcttgttgagagtctatccatgcatggtgacgtgacgtcaagaccttccagccctccctccagctgtgtggaccgtgtacggggcctggcattattcttgtctgtgtaagctcgtgtgtggaggaattattcttgtctgttaagctcgtgggcgaaggaattattcgtacggtacaagaacacggcaggagaatctcgtgtagctctcgcttcacaggcttgggcggtgcggcagaatggcgaatgccaatagacacctctctagccgattcatctctgcatttctcatggcaggtctgtaaagaatagatatggattacacgctcagatgattccgagtaaataagtgaggagagagagtcagaggcgggcctaggatttggaaaacgggtatttgaaattttagtggccacatttttttaacaatataaatttgttattcacggggaacaaataattatccatcaggtacatatatagtataatttgttattcacagatatgagtatgaatataataatatatttattggtaatttttttatatgtatggatataccgtatccagaactgttacccgatgaatactgacatgagtacaaatctatacctacgaatatatatatatatatgggtatgtttatggattgaatttttgtctcgtagttatggatttgtaaaccatatactcgtgtcccaaccgcgcgattgctatccttagtcgcactgtagggaaataaaaaaaagccagcaaaaggtgaagtttggactaaatagctgtaaaacggtgttattttatgttttta

SEQ ID NO: 636 - DNA, 1696 bp, Zea mays
  misc_feature (1)..(100): optimal_loci_322306_G1, chr9:145067154..145068849, Cluster 4
cgtgcagtcctcccgacatggggcgctcgctcgctcgcgtgacggccgcctgtcgccagctcgccgtgccatggatgctggacgctcccacgctcggcgtcgcgggcctcgcctctgtgccggctgcgcgcgctgtcatgccatggcatgggcgccaggctcctgccggccgatacacgaaccgggggtcgggcgttcagcacggccggcagcaaaagcccccgcgtcagttcctgcttttgtggcgccgtcgtgggggcagccgagcatggcagtgcagcactggcactgcagcccacccaggacaggtgagagttgggatcggtttgtagtcacgtttcaggtgaggccgaacgcttgctggactgtgttcgcctgcctgtgcgccacttgcctagtgcttactcctgcctgcggaggcatagtcgcacaagccctaaacctaaccgtaacacgacgttggacagaccgaccggttttgaaccgaggaaagccgaaagccgtcccgtcccgacctgtttaaaaaacagcaaagcctgcgaccgcgctgctaaacctgtcttctccccagatgcagaagaaagcaaggagtagggttcaaatgacaggggcagcaggcagagtaaacaaagcggcaataagttaagcgcacggcacggatgatcatcacgatgcccgggcaggctccaagagcccggctcgagacggcgctttattgatcagtcagctagccctctaattaattatttattaatcagtcagctgagcgcgattaaagaacgcggcctaaatcccggaccggcggcgataggagcggcggtgggggctcacgagacccggaccggactgcgggcagggcgctgggagcgggcgcggagagaagagggcgccgcaccggccccggaccgcatgcacggggggggggggggaggcagcgtgcttggccgcgcggcctggggtctgaccggtcaatgtggtccagaggggtgtcccagcgccagcgcgatgccaaatgtgccagatgccaacgccatccatccgcatccacgggctgaggcagacgcaggcagggatcgaggcgaggagctgtcgagctgaggaaggggatttctcgatgctgccaaccacctttgcagcctgccaacgcccggggcggctcgctttgaccgtgacctcacgcaccggccacggccggcactcggtcgcttcgctttctgggacgggctgtccggttcacggtctgcctctggcgttgccgcctgcatgcaaactgtatctatcccgtccgtctcttcctcccttttattactactttttcttcgatggctggaggtgaatcatgggatgagacgacgggatgagggagggacgtaggcgctcgggcttgggcgtctgggcaagaaaatagtgacgccacgagatgtgggccatgggatgaaggggcatcggcagcctgattggttcctttgccgtgcccgtaggacactcgttaggcagcaagtgaagtctcgtggctacgcttcacgaaatccccggctagggtgcggtggtgtggagtgtggaccacatgaaactgaagaaagactacagacacgtctataccgcacggtcgcgcgcatcaccatcagactacagacatgtgtagcgttctgttatagaaaccacaactttattttggtgaaaactcctccatcta

SEQ ID NO: 637 - DNA, 3016 bp, Zea mays
  misc_feature (1)..(100): optimal_loci_323167_G1, chr9:149451670..149454685, Cluster 4
gggagcgggagtctaagctccaatgtccgcagatgggcccttcatccgcaggcccttgttgttgggctaacccaacttctttcaagtgtgagttgggctaggttgtagtcttgtagagaaacagagcgcactgtccaatgggacacatcagaagaaacggccttgttttgctgggccaccaaaccaaaatcctaagctccttacagttcgacgaggcaggagcttgcacatgcaggttgacagcgacaagtcggtaacatctttataataacaattcacctaattcagtatccacacgtccgattcgaactgaacgcggaggaacgaggacttcaattggcctgataaataccagatgccatgttaaccgaacgcagtggtggtggtagtagaaggaccaacggtcgagcaagccaacacgcgcgcggctaccacacggacggtgacgcaattcacttcacggcgcccagcagagaagcaggccagcagcagcagcagcagagccgtgtccgatccgtatgaacagcgccttcgcctgtgcacgaactggctggcgcaggcggcatgcagagcagagcactagagcaggtgtgtaaatgaggatcgccggggttgagttgatcagaccggggcgtatactccagtaaacgccgccttaaaggccgcacccaactcaggcgagcgcgagccaccgccggcctgcctgcctgcccgctgtgcaccaatggcgactactaactccccatatatattaattgccccatgtagagtagagtaggagtacgtgcgtaccggcgcagcagcagtctacgtactcgtcatgtagtacgtattatatactcctcctcctgtatatcccaccggcccgccgaaacgacgacgacgtcagtgtgagacgacaagacaacacagcaattctggtgacgtacgtacgtagcgcgtactcgatctcgtctcgatcgtgtcttccgcgctacgcttgccttcggattccgattttgattaaaatttcacaccaccgtacatataccatatggtaacatctatgcgttcagtttactgcgctagctctcaagtcgtttcaggtcgacgggcagcagagatgctagagataacaggatcatcattgccaacatttatgcttgtacagctaacagctctgctgccaacagttctatggagatcgagaagacaacaaacctatatgccatgtcgtcgccttgccacgtctccggctcgatctccatggcaacagggcgctcacctcatgatccatctcaacagctgctctctctgcgtattgaaggacgacgtcatttttgtggaccgtgtgcacatcacagcttacattagattagcttgtaagttgaaaccagccccccatgcatgtatgagtatgacaggaatccatgcacagctgctgatcaatcatcgtgcgcacggcagcctaatcggattaggagtgcgtacgtaccaactacagtacttctactccaccgcaaggaaaagccggcctgggtggttgtgctttcagtgaaactagaaaacgccagcgtgtgttgcaatagaacgtgctatcacgtatggcgtgtggtgtgtagtcatctgcataatttacgacttgaggttttattcaacgaccgagacttctggtctaatatgtcttaaaatggaacttcgtgtcagtaaaatatggtcagaagaattcgcttttgacttgctaattgctaacagtatccatcaagttcagagatctaaataccaaaatttctagagcttataaaatccggatgagataattgtacaatatcgtgtcggtgcccgagacaattcgagtgacctaaataacagtatccatcaagttcagatatctaaataccagaatttctagagcttataaaaacccgaatggcataattgtacaatatgcttaaccgcttgttaagctgttaactttacccttccacttctgtgcataaaagaaggctcgtccttttttttttattttaatacgaacagtgcaccccttgttcgcccccgggttgacaggcgcgcagcaaaacagggaagagaccaggcagagcagcagccagagccaagccaagcacacgtgcatatccttcatattcgccccccaatccacatacgccgcaacctcgcgaccggtcgtgttgcatcggacggcggggagcgtttctagtggccagcgacctcgccattctcagcaaaaattaaagcagccacgttgcgtaggggcgggcgcattgaagcagatattgaagggcagttaatgggaaccggtgcacttcactcgggctgcacgacgttgccaagagtggtcgccgtccacatttccccgctctcccaattctactaggattcgacagttttttttctttattccttctcgatcgcaaggaccgatggttgcgtatatatgtcctttcaatgtactagtactggtttacaggagaaaattattctatgctaataaatgtaatttttccccccaattttcgaaacgaaattctagagagaaatgtgagcgatagaatttgagtttcgaatgacaggatgcttgaaaacgtccactttgaatttgcagacctaaggccgactactcagcctgtgaatttgcacgggcgagcatcgatggctctcggcgtttttgaatcctgatcttgaagagaagctctgaggtagatgccaaatcaccgaggaaaagccaaaagcctgccattgcgtccttcccaaatatacagtcgtttatacacgttctttcaaaagatatagctacagattctgggtggccatggcagtatggcacctgtatttctcatttcccattctgtattttttgtcccgtctgacactattacacatgggctgtacgtagagcgcccgtccagctcttaaatttacgtcaatcaataataactagagcagaagcagaagcagaagcgggactttgtacactcctttggatcttcaaatgtgtggaactaccgatataatt

SEQ ID NO: 638 - DNA, 1604 bp, Zea mays
  misc_feature (1)..(100): optimal_loci_324071_G1, chr9:153433473..153435076, Cluster 4
acaatgttgaacagttcctgagcaggaaccgatcttggactgccgaacggccgagctgtggattcgtgcggcgtcttccctcctcccgtcatctgcatgcaccttggcagcgctgataaactggctgccgtcagtacttagtgcagcgttagctctgtgccctgccgtgccgatccgatcaacggactgcacgcgaacatgcagcggaaccttgagagcaacggtgtaaactaattaatcatcaaggaagtatctgaattccatacatctcttctctgcatcgtcgattgtgttttgttggctgatgcctgacgtgggtgctggtttttttttggccctcatgttctgaatttccggtatcttcgtcaggaccatatactagaataatatataatagcactcatctatccggatcataacaacaggagcactgtcgagctataagaaggtcacgaccacattagctccacagggcacacggtcaaaaaccatactagtttgattttctgaatctttcttttatttcagaaggtgacaagtctcttctatagtgtattgagaacctgcctgccgtggtcggaggggaggagaagaatgtttggacacgcatcaagattcaagagtaacggctcttattcatcttcaaaagctgacaagcaactgagggggcagatagttgaattgggctcatccggtcttcaaatggatacggaagtcctcttgtcaacgtaagagcgtatagagttttcaattcagtcgctttgcacatgacagacagacttggcgcaaggaataccttgggaagaagaagaaacatgcagctccaataatccgtcgccatggcataggctaagttcatacatgcttctttatattatcgccgacatctgtatatcattatccataaaccatagtagtttaattttctaaccccgtttttttttatttcagaagggcagaagtctcctgtatccagaacctgccttggtcggaggagggagaagaatgtgtggacatacaccaagagtaacggctcctctagtctccatcatcttcagaagctcacaagcaactgactgaggggggggggggggggggggggctgtcttcaaatggatacacaagtcctgttgacaacacataagcataataaagttgtcttccggttgcttgcgcaggacagactgggcgcaaggggaaaaacaaacaggcagctccaaaacgattggacatttgttcttgcactgacagtttggccgatgttgctagaaccttgtcctgcaaagtttgaagccccaactcgaggttctcagtttttttttcttcttttggtgaagattgtcatgctcatatgctgatggcatttggacatgtcagcagaaactagggagcagcctctgacctatttatccagttttcatcgttgatctctccgtcctcctccaagctgacgtacgacgggactgcaactgcaaccgcaccagcatccagcagaactagatattgaccatccgagccgagactgcctgcaaagctgacctgaccacctgctgctatcgctgtaatgacgcgcaggagctggcggagatcccgctggacatcac

SEQ ID NO: 639 - DNA, 1415 bp, Zea mays
  misc_feature (1)..(100): optimal_loci_324072_G1, chr9:153435110..153436524, Cluster 4
tgtacaggttgaaacccaagaacagctggactcgtaaaagatagaggtagacgaagcaacggtcactgttaacacgaacgagaaacaataataatactaagtcgtaagacacgcggctggtcttaagcctaattataaatcgcacgtagctttcggcatctggagacgatacgaacgacgacagctaggttcctactcgcctgggatttgttgcgaccggagattctgctggcagccgaagggaatcatggagggctgtaactgccaaaacgacagcgcgcgcgaggcagagctagaccatcgttgtactcatcgtcgtcccgtgcacgggcactggcagatgcctatccatatccatcatgcatgctgccaacacagaagttagttactcaacgtatactatatgtgttacttatgcttgcagatttaatgggtggaagtgcaactgatttagatcatatgagctatcattgtgttaaacatcatcattattatattattattatgtagtacgtacgattctattgttaacgaaagggtccagagtccggatttttcagatcaaggacgtcgttttccaataaccttggtctcatctcattctcatgcttaccagttgccaccgccattggtctgaattattgggaggccatattaggctgtcggctaagaaacggcccaacatgccgccgccacttcgccaaagcccaaagggcctgccctgttcgctgggccgcagccgacaccagccgcccatccgtccgtccatctcagcccttgcgagctagggttttgcccgcgtgcacgcctgagccatatataaacgacgccgcactgcgtctctccaaacccgtccctcatacacatcgtcaaagctgcgggcgtggtaccggtagatctaatctcctgttaataagtatcgatttcgttttatttccttgttttttcggatcccaagttgttttgaggtgatgatcctttccccaaattatcgactatgattatactgtgcgatttttcgagctcttctcttcggagaaggcgctcctaagccagatgttctgatcgaaacaacaacgcccgcctcctcctgaaaacatccttctttgtgcacccttcttattttgttctttttttttgttgttgttgtggttttgacgatggagatgaggatcctttccccagctgatcgactatgattatactgtgcgcaactgcgacgcctcctctgcggaggagggtcccaagccagaaatctgatccatcatgtgtgctagtttctgcatcgattgttgtaaaacatttggaatttgaaaggtaccctaaagcaaaaaagcaggactttgtgctctctctttaaacagtgtccccgtaaactttaggtacataatatgtatgtccatcgttattgggtg

SEQ ID NO: 640 - DNA, 1731 bp, Zea mays
  misc_feature (1)..(100): optimal_loci_324308_G1, chr9:154756453..154758183, Cluster 4
tatggtcgataagtgacgtgactgacacgattggatgtaggcttaggctagcatggtgggatatggtgtcaaaacgtatgaacaaagttgttttaaggttatttgaattagtacaatgttgcacgttgtgatggcacacaaattattcaataaaatgttagtgtgcaacaattacatgaaagcgaacgacacatatattatcatcgacctcaatatctcataaattatttgtcaacagtcaatctctactactataaaacattaatttacacgtgctttagtagaacactaaagttggtttcacaatcagaatagcataacatgaagtccaacttttatggtggaggatggtacaaatctacaaaagagaattaaatgcaggtacaatctcaagaaaaaagtagttcgtgaagaagacatatggtctatctggtttatcggtttggtgtttagttgttttggttttaacagttctctaaaaccattgcgttaagtacaatcttggtcaaggttagcgtggtagtggcctgctcaatcggagtagttaaaacctgtggaattttgttgcttttgagtaatgaaatttggttagtagctttgctagatgtactgaagcatagaaatgagtctgatggacaatctcagttgtcttagggcttgtttgaaaacactcagtttttttaaaatagtttataaaaactgaggtagttccgagcatactaatgtttgtcacagtttatagaaactagattattagtttcttaaaaaccaaaaaatagtctccattagctaaagatagtttataaaaactgagctggttcaaaatattattaaccaggttttttttataaaccagcttctaaaaactggagatataatctggatttttaaaaaactaggtaacaggccttagttctgcttacttaactttctgaactatgtacgcttgttacgagctgagcatttcggctcagaacatcaattctgcatgcagacaccttgacatcaattctccaagaagtcggttattggaagcagacgagaggagggcgagcggaacaatgccactgctcttgccaatcgaggagaagtaccagacaagggcgacatcgacgacaacgacgacgacgacacgcgagatcgcctcagaaatctcgcaaccacaaggcagctggcctgctgttctgacgacagccattgcacgcaccagccagagaagttgaggttgcgccttctcctctcgggctcgggctcggtaggtatatgcctgcattcccattcccaaccaggtctggtctggtctgctccggtccggtcttctctcccgaccccgacctggcctcctccctcccctctccagcagagctctccctccccctccccctgaggtgaggtggctgaagtcgggggacatggtttctttctccgcttcctaagattcctcttcttccccccaacccaccacctacaccttttgctgcgccgcacctgcacggccgctccatgcgccgccgtatctcagtctcaggtcagcatcaccaaccgcagttccacctcccgaccccagccgcaatctaggaggagggccgccgctctcccctcggccgcatcgcatggtaaccaccaccagcagggcaggatgttcaagcttcaccgccaccgctcctccgaccgcgtcggcgagcgcttcgacttcagattctccaacttccgcgccgtccaggttggttc

SEQ ID NO: 641 - DNA, 2464 bp, Zea mays
  misc_feature (1)..(100): optimal_loci_325381_G1, chr10:4745473..4747936, Cluster 4
ggtttattctaagctatcaattttaactggttatatcgatggtttcataagattgacaatacaaaaaaaaattagtagattcatttatgggatcctctgcagtaacatgactagatatatctgtcggccgattactgacgtgcggagctggccgggcgcctgactcgcatgcggacgttactgttgagaaattggttccatcaaccaagcatggttcaataatgtaacaaagatgaaagatgggaacgagaattatataagaaataagaagagaggtttggttatacatgttattatttaatttgtccaccaccatgtgcatgcagcatgtatatattagataagacttggagacgtactagtagacggatgacaacgtccgtccggatgttaattaattagccgcagcagcgttcatctaggtagcattctagcaagtgattataaaatattccctccacaaaccaactttttccgtaggggggccgtagcactagcagagtcgaagtgccgaaccgagacggtggcctgcagctgcaagctcctcgctccactgcagctaattaatcttggtgtggtggtggtggtggtgcccgaggcgctgcgctctactcctatttataaacaggagacgcgcggcgggacgccgggacgtgcgttgtctttcgacccagaaaaaaaaaatactagtaatagaacgctgcgtaatcatgctctgtttgggatcctgctgtgctgccatcgtatctgatctgataccgagtctcaattaaagcctgaactgactgtaatctatatatatatatagacacaaaaaataatatcgaaacagtagaaatcggtaataattaaagcctgtgaattagttttcagaaatgacggtacaagactaaagtcaagcgaacagtaatcgcgttgtctacattgtccaaagaatccaaggagtatagtacaaagctgcctgcctgcctgcgtctctcaaccagtgtccatcctgctgcatgggcgcggggcctgcctgacgcacgttgaccaaggcgtcgtccatgccggcccagcagcggccccacggccactacttttctttgcacaaaatatataaaaaaaaatacataatcccacggccacatatattctttttttttaagcagacggccacatctattctatgcactactgcactggggcgtgaatcccacccatgaagcttgggaacgagcggcaatggtgctgtttctgtgtgcttttggcattggggcaagcatgcatgcatttggaacaattcatcccatgcgtcattttagtccactctctctactatcgggtccgagtggcatctagcaccatgagtccatgaccatgagccatgctgtgtgctgctgcttcttcccctccgtccccttcaccaccgtcgtctgccatctgcgcttcctagctcccactactcccactattttaactttccgatgcaccacttccttcctgctgcatgggcgcagtgggcactgggcagcagtggcagtgtcagtgtggcactgagcttagcccacgtacggtcggtcgggtgagagggggagctagctgccggggcctcgctcgtgcatgcatcgctcctcgctgcgcctgcgctcgccacatgcttgttgccgtcgtcgtcgacgcggcccagcgatagagatagagagagagatgacctgtggtgcgtgcgtcgtcagcgctggctagctgcaaggaccagcaccgaaaccagcggcgctctgtcaatctgtgcctgtattctgatgagctagccactcgtcctctgctctggtcgacttttcatccctgctctgtcactgtacggtccggtccacatcgacccgcccaacggctccgccgtgcatgccctccctccttcctccgtacgttgtagcctcatggcggcggcggagaggacagagggcgcgcatcgcatgcagatgcagcgccagcaggcacgcacagagaggccggccctgcagcagcagcagcgggcacgcgcggcgaggcaggcaacgcacagccggcgccaacgcaagctagctgcctgctgccgtgccagtacgacggaagaaagctaagctactacgactgcatgatctgcaacagctgccgacggagctgtggcgcttctgctcgctcgcgacgacttccacgaccactcgaccagagagagagagagagagagttgtgggcgcccacacacgtcatcttaccatgcatgcggcgctggacttgagcggcggccggcaactactacatcgtgcgacatcactagcaggtaaaatatctacggggggagcatgcgatcgcgcaaaaaggagtttgttatatacaagactcctcccgcgactaattaatcgtgtcgctaattaatagtggaggaggagagtcctagtgcacgctaatgccggaggatatgccggcaaacggtttaccgtatgtg

SEQ ID NO: 642 - DNA, 1764 bp, Zea mays
  misc_feature (1)..(100): optimal_loci_326987_G1, chr10:13026995..13028758, Cluster 4
aatgtaatttattgcaacctaaatttaaattatgtgaatccttgaatttggagactaccactgcaagctgatccattttagctgagaagtcattactcctaaatgaagttaaaattgagttatatagttcaagggatgacaagttttgatattcttagattgatcgccttgggcgtggatgtttatttgttgttacaacaatatagactattgagtatgctctcattttttatagggtccataagtttgcaccacacaaccatttggttttatctgtcgtcatttgaccttgatggaaaggagtgagatgaactatggaggaattcttatgttatggatttccatttaacttcatcgtacttgcaagccatgcaatatgctattgttgttattgccctttataatttgtgattggactatactgtgtatttaaagcggtatgccacttcttctaaatactatccaaccacaggctgttattgccctttatatcaaacgatttttatattgataattagtacttcaatggttattcatttaattggaattcaaacaaggatttcggtaaataatgagtgtcaacttttgctttgcattcttctatatagtacaacacacattgtttcttgcatttgaaagttgttggtctcatgtaggacacagtggcgccaaggttccaccatggaacaaatttactagaaattttcattttacaccatatattattgtatatgtactagattcatagaattttgcaccaccagatttttaatcgtagctctgctcatgatcccactattgcaaataatgtctgaatatttggtcaacttgtaggctgtaaaggacttgaaccaaatatttttctaactaaaattcttttgcttagatatgcgccaacaacacaactttggagaggcatacttcatgtgatgggtggtagcaaggaggatagccatggctcactatcgccatcacctcttcatcatggttgctgctggtccagactatactgtggttggattggatggactaccacagttcagaattcaaatttactttgttaaagcgaagatgcatgccacttcttctagagcaagtgaatggggtatgatttggatgttttaagtctctgtttgatgtgatgactcatgctcaatgtattatgaatcttagtgtacactatctaaactaaaacaattgaaattgctgcaacctgtaatatggtgataacgatttttatattgataattagtacttcattggttcttcattaattggaattcaaacaaggatttcggtaaataatgagtgtcaacttttgctttgcattcttctgtatagtacaacacacattgtttcttgcatttgaaagttgttggtctcatgtaggacacggtggcaccaaggttccaccatggaacaaatttactagaaattttcattttacaccatatattattgtatatgtactagattcatagaattttgcaccaccagatttttaatcgtagctctgctcatgatcccactattgcaaataatgtctgaatatttggtcaacttgtaggatttaaaggacttgaaccaaatatttttctaactaaaatcttttgcttagatatgagccaacaacacaactttggagaggcatacttcatgtgatgggtggcagcaaggaggatagccatggctcactattgccatcacctcttcctcatggttgctgctgctccagactgactctgcaagttctatctctctgct

SEQ ID NO: 643 - DNA, 1539 bp, Zea mays
  misc_feature (1)..(100): optimal_loci_337594_G1, chr10:80038894..80040432, Cluster 4
tagtagcaagacgctgaaaaaaaaacccaaacgaacacgcaaagtgtcgctgccgctagcttcaggatattatgatccggcaataatacatacactcgatcgtacacccagaagaaaaatcataactttttttttcatatgggacttgtatttcatgcttattacgtcggccctgtataggttgtgacgtagcgctgtattattacgctaaaaagcgagcgatcgagtgagtgagtggcagcagagaggtacgtacgcacgcacggtggccaggtagctaagctagtagcttgtgggacgcgcatgcatgcatgccatctccaatcccagatcgagaatatgtacgtgatttgacctacaataataataatcctctagctacacatcgtcatcgatcggcacgggaataatcccccggcacgtcacgtttttttccccatcatctccgatgttgtcgtagctgtgtacgttattagtacgtacgtgctgtatgagagagagagcgcgttgtatacgcatgcaaaatgcatctcgatcgcacgcgctttgcctttgctttgcatgtcgccggtagtagtaggtatagtagccaggcccggccaagcgtagtcgtcgacgacgacagccgctagctactagctgcttgtttcttgtggctcacgatcacgaccacacgtacgtctctcaatgatggatttgcgtacagtactctggtatttcctcatcacgtagtatatatgcgtgtcagctgcttgtttcgtcttaatttcttggccagccattggtggttcgatcggtgttaattatctcgtcttcgtcgtccgcattattatttgtgatggcccatcacatatgtcgacttaattaattatgtgctaaagttcttgtggctaaagatcacgtacgtacgcacgcacggctcaattggcatatgcatactagcttgttggcactagcttgtctctcatacgacgtgccaaccagggttatcatgtcatggccagtgatcgatcgtagctcatgcgtgctcgggaactggatcgattgttcagcatttgcatatggtacgtaaaggctccttcgttctgaagctgctcatagctagaggctcggatcgagctggagtagaggcccggatcgagcgccgtgaagagagatagagagaactagagtctagagatgagctagcagggaatgaattgaatcgatgtgctcgatcggtttgcaaccacgcactggatcgacctgcacattcgaaagagctagctaccagctttatttgtccgatgcaagttgtttttgtaaagggatcacaaagagaaacaaactactagtttataaagtttctccaaacttgtttcctttttcttcgcctatcagatatcttcctctttggatacgttcctgatcgaatagagaggaacgtacgaacatgcatgtcttccgcctgttcctcttgcttgcttccttttttcttttgataatggaaaaaaaacatgttccagccatttgcatcaaggatgtatatggcttcatagc

SEQ ID NO: 644 - DNA, 1666 bp, Zea mays
  misc_feature (1)..(100): optimal_loci_338629_G1, chr10:85636916..85638581, Cluster 4
tttgttggattagttcacgattgattggatcgtttgccttttttaatagtttgttgattgacatgtttaagcttaacaatcaccgtatagatgttagagatcacagaggaagatgagaaagatgagatcacgaaggctgcaattgagttaaaaattgctaggatagaaaatgggtacatagctgaggtgtccactttcaaataggttcctgattgggttctacagttgtatctatttatgtactccatgttttgttttgtgaggggatgcgataatcctgatattaatcatttgtgtgctgcgagaggcgattgaagttttgagctttgtgttctttatatgcagaactatgacgagattcaccattttgcgattcaagtacaccttcttagtctatgctggccaaagttaatgtacaccatttccatagaagtaagatcacgttcacctttttagaattatctattgcaagttatgtttgtttcggtcatttggagttgtacttgtcatcacccatttaaactaagtttgatattgtgagatattgagatcgatgataatatatgttgttcgttttcatttaatcattattatgcactaacattttatcgaataatttgcgtgccgtcgtaacgcataggtattagactagtattcttctatacgtaagaatataacagtacgggtgcatcgtcaaacaatgcggatatagttctagctttcctatagctagttatgttaaccaacacgctactatagagagctggtcacatgactgctaattcgtcaagaaccccagaccccagtagtagcgattgtacgtcatcactgtcggctcgatggctctatgctgaagcgatcaaaatcaacaaggcatgaatgaagaaataaacaagctagttgcgtgcggtgtgcacatgacctaccgtacattggaagttaaacggccaataatatatagggatatcgtggtacatggccctgacgcacgagtttgttatcatctcccgtttcgttaatatatagtatgtcacaatgtgtctttttcttctcaacctgcaagaattgacggcctatctttatatatatatatatatacgagtatgatatgaaggcactttggatggatgttattggtgcagaattgaactttagtgtagctgtatccaattttgtagtagggcctgactaatgccctgtttgaaaccactaaaactaatagttggctactaaaaattagttgttagattttaaacaccatcagctaataccgtaactaattattatatacctcacagctaacaatcagttcattagctgactaattattagctctaggggttccaaagacagcctaaacttttagtagtctctaaagtaatctgtttggttccagtaactaaactaaacctgagtaaagagcattaattagtgtgaataatgactatattacccttattaataatagttgttgcatgttgtacgaagaaagtgggggaggacaagtggggtaaaaatatttctttaatcccttttagacaccctcttagcgactaaagaactaaagtttagccaccctactttagtaaccccgtttgcttctttagaaactaaaagttactaaaatttagtcagtcataccccaaaccaaatagggccttagtcc

SEQ ID NO: 645 - DNA, 1532 bp, Zea mays
  misc_feature (1)..(100): optimal_loci_338701_G1, chr10:85901537..85903068, Cluster 4
tgattagcccgcctaaccacaacaaacatgaagaaatcgatgggaagaagaatacacaaatgctagggagcctttgacttgttctatggatcgatcaggaacagctggatcggatctataccttccacactgcatctcctcagaaacaacagcgctgagaagaaagaattcaaggtcgacttcagacagtttcagaacagtagacctgtcccgataaacgtaccatccgttttttgtagcgaaagtgattacctctcatcctaagtcagatcagggaaagcactctggtgaatcttgggtgaccaatttgcaaaactttggaatacatgacaatataatgtttgaaccttctggggttataaaaaatgatgaggaaaagaatagaaatttcattcttctgttgtgtcgttgacgcagtagttttatcttgacaaagttgatgtgttgacgcagtagttttatatcttagacaaagttgacgcggttcttcatgctgcattgattagacattgtagaaaaaaaaaggattacgaagccaaaccaaacatggacatgtctgcatccacaagttctgtgcgacatgcccacacttttataacataatttcaaagaaaaatacacgccatgtataaaatctaaggcatacttgtagtttttaattggttatgtccttattaattattcgtcctaattaaacccacatactgcaggagtcttgaatccaatcccaagctaaatattgctgaatttttgtttctgccatctgtaataaaaatgccctcttggcggcgagcacgtggatatcggcggcggcggtgtgggctgcggccggcgaggcccgatcttggacggccaccagtgagcggcgcaatacttgcagcttgcttcagtgggttcaatgaccattatctgctcctcacatccgtcttcatattttgttagcgttgattatatctactctatgatatgagtcatcttagcatcttgcagaggcttcacttcctccgacggggcatcttatctttagaggaatgttacgaacttgattagtgagcgtattttggttggttcgcgcgcgaatcattcatcatagaatgacccttctatgtattgtttgtcattcatagagtttgtgattgttggtatgggctaagattaagtggtatgactgcattagctagctcagtttgttggtcgtggcggcaatttttttttctgatagggaggttataaaggtccttcaatttcggggagaaatctctaggtttgacctttgctagctgtaccttttgttttctgagtattgttacattatttattttaggcttatgatcattttttctgtaattttcaagcaacactagtattaacaaaaaaaagttgaatttctcaataacatttttttcttgtttgtacaaaattagatcaaaattaaggcgaaatcagatgctagaagccgctaatactcttactgttgtacatacacacagttgatggcgggaaaaatagctagtatattttgtaagaggata

SEQ ID NO: 646 - DNA, 1607 bp, Zea mays
  misc_feature (1)..(100): optimal_loci_342630_G1, chr10:108461476..108463082, Cluster 4
ttggctagtcaggataagtgtaacaccataaaatcctaattctgtgagtttgcaagaattcacccaagttttagataaacatgttttctaacaataaattggaaacaagtttctcatataaaagttatccttggttgaattttatattctctaaagatttaaactaagtaaagattatatagttatgattttacataaaaataaataataataatcattatatttttaaatgcattgtctcaattaaatgatatgaaggagtccttaattatttaattgtgtgattcattctttactaaatgtatgaattctagaacatttacttgaaacgatagaataataatagtaaaagatatactttgcatcatgctgtgtttttgtttttgcattcaaatatgtggatctcaacttcaaaactagattcaaaataggaatttgaaaatagaatagaaaaacaaaaacagaaaagagaagaaatggaaaatgacatgctctcaagctaacttttttcagcccaactcgccttcccgctggcccgagcctgcccaggcgtgtggacctgctcttcgcgcggcccagcctcgtgctcgctcgccgcaccatcctcgacaagtgggctccactgccctaggacaacaccgcacgcgaggggaaatcagacgttggaaggtgggtccactgcatcagccgacctatgcttaaacatcgtgcgccattgaccgatgtctgggtccgccgtggtagatccatttcccagataggatcataacaaattgagcaaatgacaacaaacttcatccaactccgccgattgtgtatggccagcgtccgtggcttcggccatataaagcatgggcactgtgcgaacccctcccatccatcgcaagccaccgcccgggaggaaggaagaccaccatagtgtgtggagtgcgaaaagcgcatagaggggaggagaagccaccgacgccaactcgtgcagttatcgttgttgcgtcttcacagaggggttgaggtggaaggatgaggtacaccgatcacgcgcgtagcacccttacaccatggggttgattggagtcacctctattgctcgctgggggtcgagaggagatccaccaccatagaatcgggttcacatcgctgttctgccctcgggtgtgaaaccaagagcttcactcagccgcgcaaaaggtgtatgtaacttctcttgggcggatttgcggtcggggctaccaggattgcttgtcagagttcaccccacccgctgatccgtagagcactgtcgaccggcttgaccacgacgccaacggcggtgagatttcttccccagtgtttgccattgtctcttcctcacgtcaaccacgtcgggtcaaagcattgcaagtcggggcgaaggttcgcgcatgtcgacgatggcttccaccacgggaggacgggcgcgccgttgtctgggaattgaataaggaagcgtgtcctcgaccgttgatctgtctagtgatggtagagattagatcttcaaaataacatttcgaccgatgtaaatcgaggtgtaggatcgagatcgggttgttcagtgcatgtgcactcgagtcagccgagtcaatttgata

SEQ ID NO: 647 - DNA, 2293 bp, Zea mays
  misc_feature (1)..(100): optimal_loci_348674_G1, chr10:141472112..141474404, Cluster 4
tctatgtcgactttgtcaatttaaactatatgttggctcatcatcctttcaaaagatcagtccccccccggtgggctagctagctctatgtattatacgtatacagtaatgtatggcctcttccgacaggacgggcagagcgaagccacaataataaaaattaaaaccaatgttaacgcatttcgaagagatcagttgacgaatgagcttatatattattattacccatcactattcaccttaaaacgattcgtatgcatgctaccagtacttgtgtttgtgggcggcagttgcgcagaggaatcacacgttttccataatccagcaatattcaatcatgcaccgacggtgagtataccataaactacaatatctaccgatgctgatcatgcatcgatcgccctacgaccaaaaagaccatttaaaaatattttaattacagctaggttttcttccccagaagctagggaaaccaccaactaatttatgacacatgggcagtacggcatggctagacaatagtcttggtttttataaaaaaaaatcaccacaccatatacaacggtcactgaccactaaccacctgtacgtacatttgtacatgtcgcaagggtagtactgtatagtgtatacaacggttgcgttgccagaaacacacgggcatgaaggtcaaggacacgaggtaatgacaccagaaggaactgaagtgtactgtcacacactctctttctcacacacacacacacgcacacgcacacaggccggctcagaagccaagaagggacaaagaaaacacttgggaaacccggccatctcgtcgctgtaaaaagaaggctaacattttacatgcatgcagatgagatgatggaggtcgttaaccttttcactcgcggccgcggagctattctattttatctcgaccgaggccaggagagggggcacatgcggcgatgcccccctacacaccgtcaaataatttggtgggctagctcaggaaaaggacagatgagatgagagtgccggggcgccaaccaatcatggctgctgatgtgattatttatgcctgctcagatcaaacgctctgaaagcctgctgcatgccttcaagcatacatttccagcaacatactcagactaatgttttttttcttttatacttgggaaaaaagagaaaaaaaaagggaaaggaaaaaggaaagaaaaagaaaagggtgatgtaaaaccatcgaaactgtcggaaggtaggtagggagtgaggagaggaaagctccgcgggaacatagacagctacgcctacgctatgccaggtgcaatatttgatgaattgattggctgcctctgcctgccatcctacaaaacgatagaacatgcagcgccgatgcgacccgtacgttgaaaaagatttgcagcagcagcagggagggacggagacacagtcgccggccgccgcgcctgcgctgcgtacacacatacattatttgtgcagatgcaggctataccagctagctaggctagtaggctactatgcacgcagcatatatcggaaaagggtctgctcagtttgatctcagcaagcagcccttcagcttcagcgcacatgtgtatccaaaccttgagattttgtagctagatagattgattagttagccagctagctagctaccccaaccggttgctcttgatatgttcatatgtatatgctagtagtagtagctttgtagctttatatttggatgctactgggggctcaaagtagaaaacgtacccaagtgtcgtagctgtagacccgtggcaaattaatgtaatgtaatataaaccctgttggtgttgggggatgtgaagctctctgaacactgaagatacaacactgacagtgctatataaattactactgttaccaaggacatgagctgtggattatatatattcttgtgcatgcatgggcgatcagtcatcactcatcatcagtccacactctctgtacaacgacaagcgagataaaaacaagctagtagtagtaaactttctagttaatagctagagtgtgcgagtgattatattacatgtatgtaatcatatatagtagcctagctagctagggcacacacagggtgatgtgatgtctatagaccagtttttcttgacagccttgagaataaaacgtgatgacaacagaaaccaaacattaattggaccagaggcaccaaaaatgaccaccactgcacaatgagaggaaatggagatcgagagggctactgatgaattaatcaccaaattccgtccgttcatggtcg

SEQ ID NO: 648 - DNA, 1831 bp, Zea mays
  misc_feature (1)..(100): optimal_loci_349453_G1, chr10:145475529..145477359, Cluster 4
tcttgtgtgtcgtcgcaacgtacggacactacaggcatataggtgttggttcacaaaatataacgtaaatgacaataataatcattcacacttgagtactagtgataaaaaatttaaatataatggtattaatttatagtgtggtatctgattatagttgactcacactccagcatcataataattgtggcgtgcacgtatattatttgttgtggtgtgaagagccttgcgtataagcagataactaaagtcgtacgtataccaccaacatataccaactgaaccgtgctgtgcgtttctattaattaagaaaacgaagtgtgcagcaaagtacgtacgacgacgaagaggaaaaaaaaaaagaaaatatggggattctttcgttgccacttggctgtactagtacggtggtgacggcggggctgggcctggggcttgttgcctcctgcgatggcatgctgccacctgcgactgcgagccggcaatcctcgctggcagtgccccgttgtcaacgcgccattggtggcgccgtcgacttcggtgccgccgccacggactcgaaatgcaaaggacggttgcgcgtgctggcaacacagtactactagtccgcaacgcgatcgagctcccacggctcgttgagtgacccgtatatttaccacaagggcctagcggggcccggacccagtgggccagccagcctgtgggcccttgtaagttgggttagatctttccctcccccctccgtcgcgagagatctagaaaaaagggcgtcacgtcatccgtggacccggatgtggggccagtgcctgccactgcgtctggtcacgtccctcgtcacctcgtgtagtcgtgtaatatgaccgggccagttgcgcctgcatgcccagcggcctgaatcgtacgtgcgtgcgtacgtatcttcgactttgagctggtaatatggaggtcaatctaaaaaaaaatgtttgttcagttcgagcgcaactaaataaagaatttcatcgtcattttgaagtttccaattgcatctctgcaggagaagttttgggagggcccaccatgtgcgtcaacctttcttccttaaatatgctgagaaatcccttcaagacattgaaggcacctcttcaacttatctcttcgatccacctttttcatatatataagcaaggcattcaataaagagaataaagatttcaatcgtcatttgtgtctctcgctttcactctatactctaacacaataaccagacaaaaagatagagaactacatacattacatttctttgaacagtcagaccaggctgtttaccacgcgtttttatgaaatagtcttagtttcatcaaaaaaatcggttctacaaaaaatgttacggctaaagctattttcgtcatcgctcaaacgcgcccgccttctaatcgctccacgcttccactgccgcttcttttcaattctatgttccaaaatccaaaggcatgtgcctttaaaaaaattaatctcgtttatctgttatcggcatttatttatgttctgatttctaagcaagccatcacttctcgaacctttactgtaccgagcaacagaaaatcacaaaacgcaggattaggaaaaccttggtcatgggcaggctcgctgtcactgcagcggcttcacaaacggagctcgctgctacgggctccagaatccagatgggccagtacaagaatgcgtgtgggctcagctcctaacctatattcgtccttgatcggccggacaagtacagcccaacggtccaacatacttggggtccaaggccatcagcggtccagagagcagaactggtgaccggcatgtg

SEQ ID NO: 649 - DNA, 1512 bp, Zea mays
  misc_feature (1)..(100): optimal_loci_36925_G1, chr1:222975913..222977424, Cluster 4
ctgcctgcggcctgcccatggcgtcaacgtcgccgttttgttcctagctgagaaggaaaggctcctgcagttttcgcgtcctttgctttcgcgtgaggctgaagccgttctcgaggggatgtcttctttcgaatatactagtactacacttgcagctaggtagctgcccagtggaatttgtttgtagtctgtggcatctcactgctatcagacactgctacaagactctctgatgacgactcaacattctgcgtattttttatgcgtggtcacatttccttcggtggccgatcacccgttttgattcttcagtggaaagatgacttctactgatggcagcaaattcgccggtttctgacccccttctagagttcagaggttcgctcctgaagaaaaataaccgcagagacactgcttaacacggtttcgtcgctggacatttgctgtgcaagaattgacgttttctggaactattggccctaatgcgaatttgttcccttccgctacgttcggctgctaggcactctaccaacgtgcgtaggctttcatagcctgagatttgctcgtaaacagctgctgtcaaatcccaggtgacaaaaagcacgggtttgctgcgtgtccaaatgcagcagttccagctgcaaagcttcctctagctgtttcgctggagaaacctgcagaacagctagcgcggcgtcgtggtagtcccgcacgcttgttaagtgctaacggaatcgatgcttcgtagtactactctattagtcttccaaaaattcggtgcaggattaattcacatgaacagaaacacacggaattgctttcagatcaaaatccgccgcggagtatatataacaaaatacaacggcaaaaaaatatttcttcgttacgtacgtcgcgaaacatttgttctccttttcatcgccattattggccagttgacaagtctagctggtacgaacagaaaatggcatagtgtttgttttgctgggtggcaataaggttgtgaaagaaatgcatggcacaaaacatacggaatatattcgcccaaaaaacttaaactttctgtgtgtaacaacgatatttgcttcggattaaaattcggccgtttagactgctgcaacagctatattatttctttcgtgcccacaattgtttctgtcggtttctttatcaacgtctagccttttaatttcctgtgcggccctaggtagctagcccaggaacaggtgaccgatcaaaccgccgaccaaagctatatattcgctagggaaaatatatgtgctggtaaacgatcgccgccgcttcgctagctagtgcatcacagaatcaaaggcacgggagtattcttgtcctcctccacggctcgataagaactcgtatgccatcctgcctaaattctgaaaccgatcgagatcttcgtactaaaacctgcgacgtcgacgccgcgggcggatctttgggcaaagcagattattccacaaggatacctgcaggtctcttccacgccttcaa

SEQ ID NO: 650 - DNA, 1933 bp, Zea mays
  misc_feature (1)..(100): optimal_loci_37020_G1, chr1:223312156..223314088, Cluster 4
tgttactaacgaaaggatttacaattagacaagcggtggacagcaaatgtggagatatatcaggaggccgcggccggtgtgcaagcctagtattagtaagcccagccgcacatgcataccatcctagttggcctttcttcccttgattcagatccgggctgcgcgtagattgacaaacacgttccgcatttccagcagggtacagctcttgaagcctctttagtgcccgttgttttcgcatgaaatgaaagggtggaataaatttggtttggattccttcaataattactataagttttggagatttagaattaatcctgatttgttccagcagaaacgaatggaccctcattcagttcgtcgaaacacgcacggccactgcacccagctgcttaaagaccagaacgcaagaagctccctgttttcccgttcgcagcaatgtgtgtgttcatgttgtagtagattctgtcatgcaatagatagaactctgtgcgtcgcgtcctcgtgtaggatcagctgatgctgctgactaccagccagtttgttgggccgtgctcgccaaccccgcagacaaaccgaaagccgtcgtccacgacctcacggaccgagcggcccaagtgggctactttcggcccaaggggttttgcggccgacacgctggctttgccagcgatcggcgtagatgctctcgccgccaaattattttgcgcacggtaattctttcatttgggccgtatattcttcaagtgggctgaaatggttagatgcttacaagttcgaccagtcaagaccatgtagaagcacatgcaaaatctaaagtctgcatgcatggaagacccccgaccgacgacgacaaggcgtcacacttttctataaactaggaaaaccttagctactaaaccgaacatctgattttgtataaactaagaaagtcttagctactaaaccgaacatctaaattaaattgtaattgcaccgttgtgtttctcactacaaatcttttataacaagacacaacaactttttttcttttgtcgaggagaggtgatggtgttttaggtctgacaaacaatgtttcatctatggaaaaaaaaaacatgttctcaatctcaagacatttggctttgatatcatattaagttgcatgcaccaattaattccaaccaaaagattaagctgatagaaaaatatagacatttcacttatattatattctaacatatattatattctaacagtatcgtccccgctttatacggttgcatatatatagtccagatccgtagatgcctccagcttcaatggtgtggcgaagatacggcctaaaccccctaggcagcgcccggccggggctcaccgctcacgggtccggccagccactcgtcgccagccatacacacttgccggtcgagccgccctgcctcctctgcagcaaaagccgagcgcggtcgatgatccctgtctccttcccggccggcccggcccctagctagccccccctagctaggcttagcaagagctgagccagtctctcgctcacacacgggcagcctcgcctggcgtagccaatgagccccggcggtcgtgcagcggcatggctcgcgccaagctttcatctcatgtcccttccctgccggcttcccctggcctggcccgccagctagctgctgctgctgctgcttgcttatccttcctcgcaaaagaggggactgacactgacgcgcgcgatcgaaaacgagagccacttccgcgcgttatctgctcccctcgcaatgcgcccgcctctttcccgcgcggatcggatagaacgattgctagcgtcgcacttgcggattagaaaataggcctcgccacacccgtatccggttccctcaatatagaaaaacttacttcacctgcgaggctaagatagcccactaacattatgttaata

SEQ ID NO: 651 - DNA, 3368 bp, Zea mays
  misc_feature (1)..(100): optimal_loci_4160_G1, chr1:21691937..21695304, Cluster 4
ccttgtagaatacgaattccagtatccaaaaaggaaatgtactgcagctttgaatcggacgatatctgtgtaaaccatatatatgtttaacaaactagcagtagaaatctataaccaacatttcttccttaacaacaagaagggcctgcctagccatcttcttaaggctgcattattccattccggagctttcaaagagaaaaggtggattcagctttgacaaattcctaagtttcagatgagaatagatttcagtgcaagccaggcactacaaacaaggtctactttccttgggccatatgtgaagcaactgcattttggactctttgatgagtcgtccgtctccagtataagcaaagattgtttttttttcaagactatggaacgggttgttccttgcaatcaagtatgggcttaaccaaacaactaaatcgaacgatctcaacagactggagcattgaatcccaagcttatggagctttactctgtgctacctttttaaaatggtactaccatcctttgttccctcttccctgtacgcatggggcatggcaaacccagtgcatcaagcaatgatgaagtcgttctcgtccccatggatacaaggggtgcacaacacaaagatgaactccactactccagaataatgcgatggacgacgtaactgcaagcaaggtgtaggtttcgcagaaggcggcttatgaactcgtggataattaagggcagctactaggaactgcatgtctggcttcaagctgcatatggacatacagagaagagtcaagttttgcgtgcgcacacgcttagctgttgccaattgagatagatattggaaactcttgtcctcgtctggaagtttctgcgcgtagctagctgttgccacagcaaaaatgctgatgctccttatctcaaagtcactcgcattcttcgtagtcacgccgcgctgatgcaaaggcgcacgcatcatagtgcgtaaacaactattccagccgtgcacagcttagcatatcggctggagtatgagtgcacatatatccatcccacaagctctctctctctcttttttaatgtagtattcagtatgaagccatgtaaaggtatgatggtactcaagtcctctttccttgccacttctgcatgatagtacatggtgattaaaaaaaggacttgtagtttgttaagagtgagagtctgttagacgattgagtacatcaaacttgaatgctcacgttcagtgagtaaaggtgccagactacggttcagcgtaccatttgctgtagttgtacagtacgtcaaaactgaacctcccagtttactgcttgctatgctaccccagtacatgagatgagtggcgaactggctggcttattcaatgttcttgcgctggcatgggcatggcactgatcaatcaaagtcggcgagccacatgctgtaacactactctgactgactgactccatactagctttagtcatttattaaactactgtgacactggatggataaaacactgcagatcttcaggaaccatctccagtccagtgtaatggtccacacacctaagatgctgtcacttttacggtctgcaacagcagcagcagcaacaacagccagataccggccggcctttgcgcacatgcaccagcacatggctgaatgccaataggtctccgtatttgcaaactagaacagatgtttttaggggagtagatacggtttgtaaattagctaagacactaattgattgaaggcataaaaaggaaggatagtagaacctccttagaagcaaaggggggaggacaaaagaaaaaaggtacacaattgtgcagagaggggaaggaagggaacagtgtgtgtggggtgtggtgtgggggggccttcacaaagcttaatctgcaaataatggccgcctttaagtggcctaaagctgatgcttgctgggttttggagcctcgcttgtgacgtccaggcaggctgcactgcaggccaaggaggctggagacggacggctgcagctgccgcagtcgagctgctgctcctggttccggtcgcaaactcatcaggtactgctgaaaccttttgcaccctctgcaagttcagatttgctttgcattgcattgcggtggtggtctggattgtgattccttttcttcggggtcttgagatgctcggccttgtgagctttcgacactgcctttgcttctccttgctttttttttctctctctctctcctttctatttaaggagcatctctgaatatatcagcttggcaactggatgcagtgcatttgagttgtatataagctgtcagcaagatgcagctctgctcttgatcttctttttctttctggttgacgagcaatggacggcccttgcaaagcaatcacaggcccaaagccacttttgtttgaggagatctcctcctctctttttttgttgtgtttctcagtatttagaacaaggagaatttcgtgcatagggattactctcttagtcctaaaataaatgtcgctgctgcattcgtgctggttaaactttttttttaaaatctaactattacgttcattaaaaaaaattagtttgttataaaaaaaatagatccgatgatgtatctaacaatattaagtatatactataaatgatgataaatttatatatgcgtgcacttcattacagttgaaagtgtctgcctgttgaaaagcgaaaacgacgcttatttttttggtacggaggaagtacaatctttgtgcgttatagaccaacagatgaatacccatccacaaccaagagttgttgtttttttcttttcttctttcttccagcagagcagccggtagatttacagagcaaaacatgatacgtcggtggtgtggcagcagtttttgtgacgttttcatacgcgaattacaatactagaatagttccacgagagttcacgattgttgccgcgtccttgtcaccgggatcgtcgctcgtgccgtcatctttcttgcgcgtgcttggtggccctgccccggtagaagatcgccatcggagaatatctgcatagcttctcagttactgatggcctcctcttgcaagaatttttccatgagacgcgggagttgccgagcccgagatgtatgctaaagccgacgatgcctgcggatcatcagagggctctcctcgcctctcctccgactgcaggcggttggcagaatttctccgggaatcttgctgctctgctgctgcctgcagcctgcgttagacgtgagtgaaaattggcacatgatggctagaaccatatccttaactacagtacccgcatacacgcgttggaaaattaagcacacatgtgctgtcgggactcgggagtactaactgttag

SEQ ID NO: 652 - DNA, 2269 bp, Zea mays
  misc_feature (1)..(100): optimal_loci_4168_G1, chr1:21715707..21717975, Cluster 4
tcatacgtgcatgcacttgcgctggagccaaacaagagtatagtaggcttctaaaatgaggcggcgcatgcaggcgtcgtgtagccgtcaccgtgaagatgagcacactacgggctggagctcgaccatcttgcaacttgcaaggcagtttggggctgcacacggaggagaagcggaaacgaaaccaggtgcgcaggtggcggtgtgccctgctgaatgagccgctcgtactgcacgccacacactccatcagttcccgcccgtcgaactgcccgccttaattaaactgcgctaggagacgaccgacggcccgtccgtgcgtgcgtgcgcccaaccgtggggcgcgcgggccacggctggcgtcgcgtcctcatccacctgccgctatctctatcctgcagccgtcacgccgcccgctacctgaaacgacggcggcgccgcccgccttcgccgtttcaggctttcaagcctttatgccatagtgccagccagccggcgtcgccctggcttcttcagcctcaaacactcgcaacaagccaccagaaacttgacacctgcgagtagaaacgtacggaaacttgacctttttttcccgatggctggctcgaccgagagcactcatgattcataaacggagctatatagtactaggctatagcggtgcctgccagcgacaacgaaaacgtgaggctcacattgaaggcaatgtcagatcttttaatttggtggtagtggggagggaaaaaaaaaacccagagcccaatcatcctcgtcgtcttggaacctccgatcgcgtccgatcatgtcaagcgaaaaagatccgaaacagtgccgcctgtgtacgccgccagccgcaaaactgaatccaaccaaccacacagaagaatgctctcgctcgccgctacgctacgggacaccgccccactttccacttgtaaagctgtccggccgggccttgttttctttactccccacaggccacaggccacaggggggggcagacgagacgagacgagacgagaggacgcggccaccagcgcgttatccgaaactcggggggtggggtacggccaccaatgattggcttcttggcgaagtggaaaatcccgtcccggctgcgcacgacaggaccggggatgacgactagactagcgtgccgtgccatcacggtccggtcccaggcgcgcggcgggccggcggccgttcagaaaaaacgagctctggccccggccacgccgctgggctcgatccgcgccgcgccgcacgcacgcgaggcgacgacagccgaggacccccgccacgtcccgtctgggcgggcggccggacacgcggcggcggcgaaccaaccagccaggagaggagctggaaagagacgagaggagagacccaggggcgcacgagcggcacgtcgttttccttcgccgcgaccgcgagggggataagggataccgcgctactactccgacgccgcatcggattcggccgctagctttctcccccggcagggcagccgccggctcgccgcacatgtcctttcgccagcgtcgcaggcaccctggcgatagggatgcagtgaactcttcagtttcacggccgcgatagcgtttggagatgtataatctccgtccattttcaggaacggcatgcaggtggtaatatccccctgtcaaggattggtcaaagaccacagcgatgactatacttgttggtccttccaataagcacatgcaccctgttgagtttcagcttccacaagcacgagcgcgggttctttatttggtaataaaaaacagcaatatatttcttttgcaacaaaaaaaaaaagaacagcttgtcagagccggctgtcctattgctcttgtctgactgggcccgtgcacggtcgcgttgggggacaggcccgaccgcccgagcataaacaatcagggggctaatcggtgtcagaaggcctaccagcggtaccagttgccgttggatgctcaaaacacagctagcttggcaaggccaaataaaaggccgtccaatcggaaaagggaaaaaaaaagaaaagagatcaattgtaaaaccacgcctcgttagataaggttaacaatcagacagttgcgtcgcgcctcgtggagcgaccacgggacatgtccggttttgttttgctctaccatgtgttgcctgggggctggggctccctctctgacgcggaaatccactccgtgaccgtgaccgtgaccatgaccacaggtagtaataccggccgttgctgccgtcgtaacgc

SEQ ID NO: 653 - DNA, 1427 bp, Zea mays
  misc_feature (1)..(100): optimal_loci_42422_G1, chr1:250297187..250298613, Cluster 4
gattctcggtcgacatctcgtagcattagcactaccaccttgcagattttgttagattgcttgtaaaaatgtgaggaaacatgtggtggatggattaagagcagaggggaggaaggcggcgtgtcaggaacacaagatatggttctggttgctctttgttttttttttaaaaaaaaaatctgatgattctgttccctcagaacggttgatgttaacatctagtctggttaacagtaattttctcattaaataatcgaaaaggtctataacagaacattcgctgctgtcattttatttttatgccgcaattatcagcaagaataagatgcctcgcagaacgtagatcaatctttgccgaaagtttcagtctgatcagttgagcactgagatccctaggccttctctattgtactgtgccttatctgatcagctacattcttcagcatttcaacgttgccatttcgtaattttataattaagagtggcacaagaaggaaatatgtctatatctacctcgtgaagcacgaagtgcctgcatggtctgccaccggtggttttcgtccaatgccgcttcgttaggctatggccagagatcgtgtacatggtgtagatatagagcgaagtttgaaatgtgaaatgaactgttaccgtctgtttggttgggagtgcgcaggcgtgcacccgcacggtccgtatctgcgttatgcggatcatcaaaacaagtgttatttgattggctttccgtcacctaaaagctgcatggacggaaaacgagaggcgcggccaggctccacggggacgcagccaaaaggcatctccgtgtgtgcaggcgctgccacaaaacaagaatacttttaaagttgtttttctagataaaaccttatgcacagatcttgtctatatataaggagcatgatttataatatacggttcaggctaccaccgtgcagcaaccaaacatatggttagagatggtttagaagggactaaactaaaccgttagagtaatataatcttactaaatcactgacaaaagatatatatatatatatatataattgtttaaagtagtattatattaaaacaacaataaacgataaaaacataaaatacaaatacataatatgattatactaggtacattttaaattttaggtgttttggagtgggaggcttgagccccacccatctcaccaccagaaccgtctttgtcctgtcccaataacatctgagagcatctccaacaatttcttaaaatgtggtcccaattatttttttggacaaaaagtaaaatccaacatccaacggactctcatccgttcttccaaaagctttgactgttaggctcccaatcactcgtcgttttcccgttcccgcgtcttttgccgatttggcgcttcttcccatctcccccgctcttcttatcg

SEQ ID NO: 654 - DNA, 2433 bp, Zea mays
  misc_feature (1)..(100): optimal_loci_42513_G1, chr1:250888021..250890453, Cluster 4
gactactgtttgtggccctagctcagtcagacgggagtaggaggctgcagttggactaaacaagcaattttgccccgtatcatcaggtgcacaaggtcattatcttagaagactgcaatgagagggccaggcataattgagatgagatgagatgtgtgtgacatgccaccaccagtaccgacgtctcctccacagaacagaaacaggcatccggcggccggtagcgagcatatctctgtcgtcgtggactcatcctggacctgggactccggctagctactcgcagttgttttatgctgctctaacctcctagtgtttggtgccggggcattttcctaagctactcgcggatcacgcagctaccggactggctactcttcttggcattgggcgtagactatgggagagggggaggggggtatatgtgagtgctgacagctcagctgcatgattcgtcaggtttcggggcttggaagtcatgacttgctgctgccacatgactgaccggaggtctgcaggccacaaagaaatggaggaatcttgcgtagaaaggtcgattgagatcggagctgacgagctctagacttgtagcgcatgcacgcagcattggcccttgtgatttccagccttccaggctcctatcaacgtcctacattggcacctcatggacatcaccagccacgcatttaaaagtgcccgttaactaaaagattggttctgattaggtgactagtagcaatttctggcaggtgacaggtggcttatttttgtagtttctttactgtaggagattaagtttctgtggatcaaagaatatctttccaactacaccaagctacgttgtttggcatggctgcaaagatagctccttgctatactccatggagaagaagctagagccactcgaactttaccaaaatggggccttaatgagctacgtacatggatcgattgaggtatttcttttttgtttatttcttgattcttgataacacgcacgcagataaagtgttccaaacttttgtctgctggctgaataaaaaatgaggttggctgggctagcttgtgccaatttttttacaggatcgtgtattgctcgaggcagagtggggacggcaaccagctttgcgggcataaaaattaaagaaatgctgtgggaatcctgcgtcggaaagcaggacctaagatcgtctcaaaccttccaaagatgacgcgccgtctcgaattctcttattcggcttccgcctaatggcatcactgcatacgtactcaaacattcaagcgacgtctgcttttgctacgtgcgtggtcttttctttaaggtatgatacttaattgcaatccatgcttatgatgatgatggtcgttcctgctagttgtcgtcaccacgtattaatgattttccagtgtttggccatcggctcctcgagctaactggccatttttagcttagtttattcgatggttatctcgctttcttcccaaagttacgcgtagggaaagcacagcacgtgtggaaaactcagcccgcgctatgttaatttggcaacctaaacggagttacagattgcggcgcaagtcgtttttttaggctacgtctaacagttatcctatctcattccatattatacatcttaattttaagctccattttacaaatagtactatttaacgtgtaaatcagagttttatgtgaccatatatacagtcactacatgaagttacagattgtgggtgtcgcccattcttatctatctactctttcgctgacgtaaatttctcccaacgcgtgctttgttaattagctggttggttcgacacatcagcaactaatcaagcaattggccaaacaccaacgcctatttgaaaaggcgctgggacctaacagcaggattatcctagtccacctcaacaccaccgttgctagttcgttggcgctggtacggtacgtaaacaaagtcacgctctttgcacactgctggaggccgaattcaagtagctttcttacccatctaatcagtcctctttttttttaaaaaaaggaacgaaaatcgtgtggttttggccttgctttaagctgagcttggaccgtacggaaatggcggtccggccagcagtgacgactgacgaccggtcgaaggaaggatgccaagattcggacgtttacgtcgctgtctgccgatcgatcaggcctctttgcctcttcttttttttcccgttttcctttcgaagggaaaggttggtcggtaacctatactacgatatctctggattaaacaatcaacaaagtggggttggataacccgtcactgctccaaatccttagacgtaccagtgatccaacgggcatctatactgttatgcagagcgataatgctagctttttatccgtttggtcacgggtggctagacctgttagtaacctcgtcacca

SEQ ID NO: 655 - DNA, 2019 bp, Zea mays
  misc_feature (1)..(100): optimal_loci_43565_G1, chr1:256293759..256295777, Cluster 4
ggaacaacgggacgaagcacgaggagggtggatgggaaacggaagaggacgacggctcgattacgaggatgagagagcacgcgagaacatggagcgaatggagtccctctattttgcatgtcgcgatgcgatggggagtgtgctgggaagatgaatagttacagtgcacgtctgcacgagcggacactcacgtgaaagcttttcagtcggcggtgaaatatcatagtagtactcgttagacatcatgctcacaacacaagcatggcagtgtctccctgcttaaaaaacacggtggagcccatgctctgatctcgtttttctacgaaacagtcgacgcgattttatacttggatgtgtggagcgtggacaatgtgttatcgtcttaccttcttatatacaaggttgtgggaaaaaaaaaagatctcaagtctactgtagaggtctccttgatgcaaatatggtccctaagaaagaggtcaccaagatgcatcgaaaatctattcattctttatcttcatcgagctcgagctagagtcaagtcgtgatcgtgcagggcacgaagggggaaagtgctagaccaataaggtgaggggggccgaagtgggggcgacgcatctaatcctatcgtcgaccatggcaaggtgagctcttcgctattgcatggtctaggttggcggtgtacagctgaatgcggacgtggacaaaatgcaaagggtagggtattttaatctatgttcattatctaaggcataccgcaactataaaaaaaatccatttctgagacttcgtctacaagatttttcctaaaatggatttttttatcgttgtggtgtggtgtgacgccgataataaccaacgtttttcaatgtgtttctgataagtatagtaccatttctagtgtccaagatttttcctaaaatggattttttttttatcgttgtgttgatccgatggtttgggtcgctctctgttcactctctagaatgtgtcagactcattatctttggtctcacagttgataaaaaagcatcgtgtcgaacatgacacactattcatctagagggacccactgtcaaataacagtttattataggaacaatggcaacagaccatggactttggtctgacgatgatcattggacccgtccaacgagagttggctgctcgtaggtgagttctacgcatgccaatagacctggaggttttgattcgatggtcgttggactcaaggaagtcagactatacgagcatatagtcgttggatgacaaaaaaatatttaaacggatagtaacgagcatatagtcgttggatgacaaaaaatatttaaacgggtagtaaacgtggctgcatcggaggaatcagacccgtgggttatggttcaacactagggcgtgagacggtccaacatctcatagttgagtaggttggtttcacaactagttgagctttgagatcttataaatagatgatgtgcaatcttggggagatattctggatttccaactaggtatacatcctagtaatcccaagaaaacatctctcactcacatctagtgatagtgatacatccttagtgagattgtgagttttcctattgatttgtattgagaccttgcatctagtggcactagtgattatattgtgttgtagattctagttactcttagtgattatcgccacctagacagctttggcgcaacggaggatcattgcgcgacatttggtggttgttgtcagcttcaatcatcaaattataagggactcatgtggtcatccttattagtctgtttggatgtcgatattggagcacataattggggatttgatttagctttcctaaattctattgtttagttacacacataattaaaaattggaatcaaagacctaattctctaaaattggactataactagaaactccttctcctaatctcgagcgtcacccctctatattgtgtggaattagaccgcacaattccaaactccaattcggtgacatccaaacaatacaattgg

SEQ ID NO: 656 - DNA, 1957 bp, Zea mays
  misc_feature (1)..(100): optimal_loci_43588_G1, chr1:256490670..256492626, Cluster 4
ataagtgtctgatactagtacgtaccatacagcagatagatagatattcaggttccttcaaatgagaagtgcgagagcgagtggcgtggtcaaacgtgggggctcaatcaaaccgaaaccgaatccagcagcagaatgcatgcagcgggttggttcgtggctgtagagatggatggatggaggatcactcatccatcacctgatcgaagcagaaccgctccccaaaaacaaacagcagcagcgtcgctgccttccccttctgttaggacatgtccaatcggcatcagtcgcgcaatggcacctcccaaaactgtagtatccaccttgactggactggaactcctttccaccactgttcagttgctctctctgtccagatcggtccacgtcgatgtgttcatgcatccacccatcacatccgtgtgtccaccgaccatccactgcgataccgagcatctctcacgcgcgcgcgtgttggtgagcagtccatcgtacatgacccaatgcttcattcgaaatttcgaatgagatcgatttcacataaaaaaatacatgattctctctctctctctacttaattggcttgtttgtttgggacgtaggaatacaaaacaaagggggagaaaacaggaatagaaaatatcggaaattagaaaactacaggattcgaaaaggcttcaacacttgagaaaaaagttatacgaatgaagttcagtcaaacttcaaaaaaaaaaatcgatcagtgtatataaaccctaaagtaacctttttttttacagcgagagtgaagctacgtactgatactgtacagcagtgtgcagcaggtttgggcagggtgtaattgaagccgccgagccatgtgttattgtttggatgggagtgcagccccaaccaactcgcgcagcaagagtagacagtagtagtagattgccagaaaaaggctctgggctttccgtgggtcaggataggcaacgagctagtacgcgcaacacggcgtgcggcagccgctctgaactgctgtgcctgtgctggccctcccctgagactgacagccctggccgcctggcctttcttgagattctacacaccgagctcaggctgaggcagccagctacagctagcgcctagcggtactggtgcactagcatgcatgccttcccaggcgcgccaggccgcagcccgccggccggccggccggcacgcatacacattttgcatagagataggagcagtagtagaaagcagttaagaccatctccaaaccattcactcacatttttctccctatctttatttactatattttactacatcatcataaaatatactttctcacatttttttgggatattttcaaccaatcatcctatccagctccctctatatactataatgtagttatttaacaatttttcatcagtttttgaagtttaaaaaaattacatactatttatactaccataatatacattggtatcaagttaccgtacttaaaaagaattaatataataaaaatggagtaattaatatgtgggagaaggttagaggtctcccatatatgggggcaacctccctccccatgtaggccttattcagttataattggatcgagtaggatttaaaggaattaaattctcttctagtcaaaattaaatagaatgagaacttcatttaactcccttgtaaccgaataagcccatatagggcacagtgggggaaacccttggagagtcctctcccctatagtacaccagaaccggatatggggtggggggaggtatggggagctcttggaggtggtctaacatcgaacatctattgatccatgagtcatttttaaaaaaaatatacttaactaaacaaatggaaaatgatattaatttttacaacttcaaataaatttattataaaaatatatttcaaataagtttgcattgctgatgaccgagatgtttta

SEQ ID NO: 657 - DNA, 2843 bp, Zea mays
  misc_feature (1)..(100): optimal_loci_4384_G1, chr1:22634409..22637251, Cluster 4
cacggctgacaacgagctgcccgtgccaatccggccgaccagcacgacacctgatctcggttctgaccgacagacatagctaggcaggcaacggcgcatcccattggacagaaccgcatcattttccaccgggcttaggcatgattacccgaaaagcggcaggttgcatgtgctgctttgggttagatagatcggtcccactggccagtgggctccccactcactctcgctacggcgactggccgctgcttcccgccggcttcgagtccgaggttagtcatggcgtacatacgctgcagctgaactgccggccgccgggctctggggttctgaccacttttctccagatagtatagggtctaggttagggcaggattcacgtcgcagtcttttagtaagtccgcgtgcagccgatcgaagttacctaactatcgagcaccagcacgaggaaacgatgacggagcgagctgtcgtccgcggtccggccttcttcctccggtcgagacggtagcgcgagggccgatcgagcagcgtgtgcgtgcgtgcatgtcagcaacatgtaggcatgtagtagcgtactacgacgtaggcgacggtgcgcgcgtccgttatagtcgtctacggtctgcggacggagtaccgagaaggaaggggagaagttgcggcggtaggcaaacaatgcgggggagagctcgcgcaggtcaactcggccgccggcgacgaacgatcgaagctgtccgaggccggccggccggcccgtcgatcgccgcccgcctcacgtacgttccggtgcgaggcgattctgaatccggtccaagtcgcagcaggaccaaaaaaaaaaagaacagaacggacgagttaaatgaatcaaatcgattgacctaataagccgaacccctttctgctctctatcttttgtcgctcgatccgcactaaccggcgcttaaatcaaatgaggcacgcgcccgagctgaccacctcagaacaatccggtcggtaatcacgccaactgttaggtggacgccgctagccggccgggatagtggaacgaccgaactgagagcaagcagctgatgtctgatgaacagcacatggagagagagagagagagagagagagagagagacggataagaagtggtactgctatatacggcatacggtgtgattatccggtggctaaccgtcctgggcgtgtggttcgcgtcaacagaaacgtggcggttttatttagccgagtattgctatactatacggctataccggcaccacgcagtcccatatgattagcctggacagtcactagctagtagtagtcatcgtgcttaacgctattaaccgccctgggcgtgtggttcgcgtcagcagatacgtgacgacttgagaaatctggcccgatcgagcgggcggcgagcggagaagtcaattccaagagatttggcagggtgggtttccggcctgcctgcctgaccaatcgaacccatgtacgcacgctattgctcgggtcgggtctggttcggcttggacgacctcgtcgtcacttcgccggccggcgtactcccgcaggcgacccatgtccgatccgcctcggtcggaaaaggcgtccgaggccgggccgtttccactacccgcgtccgcgtgcgcccccgtccgctccgccggttgcgttggaagtcacgggccggccgctctcgttccggtttccggacgccgccgcccgccgctgcccacctgccgtgtgctcgcacgctcgctcggcgcccgcgcgcgtccgtccaacgccagcttaccgaacataacggccacgggtggatggatggatgcgtccatccaaaatcacaggccgcggccgtgtcgtcactggtcatgcggcggtcacgtgcgtattgcgcggggtggtggggaagtggaagtcagcggcgcgcggttgcgcaacggcacgggatgatgccacccaacggggccggaattcctcgcccgcacggatccgcccgccagtttgcaggggacaggtggatgagtaggctgttcttctggagaagacacgccccgcggcccgcgcaacccagccagtcacgccacgcttctgccaatcacgtcctaagcgaagcgacaccatgtttatttagccttttcaggttccaaacccttttcgcctattagtttgccttatattacataactgattatttgacttttcttttttcctataaaattgtctgttttctttgcatattactagtagtttcttgataatatctctccctttcctttgcatgaatggccgtaaatcactctgatgattgattcgttcttctcattggttttcttacatggccggtggactttatccgtagctaaccttagcttgcaacaaattagcacgcaataaagagtcgttccacccccttattatgcctgtaaactgccacaacacttgcttgtcaaccaaaaaaaaaaggatatgacaatactggccgtgtttattatttagaggatatgtatgcaatactgtactaaacaacgcaacgaactatactacgtcgtacgttacgacacgcgtcggtatctacctggtaggtttagcatattcgagttatgaaatgaggtagcgatctactgtcccacatcacaaacaacacattcgtttaacataagatttactgaaagcttaaaaaatatactcactcagttcaagaatagatcattttttgaattattcatcgtcaggtttttttacggtttactgaatttataaaaaaaacaattaattgtgataccatataaacatacaatgaaaatatagtttataaggtatataatgatattaatttgctgccatga

SEQ ID NO: 658 - DNA, 1524 bp, Zea mays
  misc_feature (1)..(100): optimal_loci_44030_G1, chr1:258434456..258435979, Cluster 4
ttttagttactgcaaccgttgttgctcgtattataccactgcatgtttaaatcgcccccttccaagttataaacatatgcccctattaattatgtttcaggtcaaagggccatacttcatagctatttgccccacaatgtttcaagtgaaagggcctaagagtattggagcactctatgttacctgcttggcgtcaactattcaaattttactctagggtagtagataattttccttgtcgagttttattttggtatatgtaactttgtaattggtcctaagcgtattggagcactctaaattaacaggtgcttgaagctaatgatgaagttatacaacttggatgaataaacctttgttgtagtgacataaggagtttcgaaactgcaaggaattttaaatttgaatatttttcagtgagatgttaaggttgataatatatgcgttttcgtttttaatctttatgcactaatattttgtagaaagtagtttgttcaccattacaacgcacgagcacatacctagtctaatgattaaaagcggaacagcggggggtcggactcggacctccccggccggatcctgtaaaccctagctgcccggcgatgagttgcgtgctttgctggcgtcctggctcctgcccatgcatgcatcgcacttgatgccctttggagcaccggtgggtgctacccattggcgagaccagtccggcaaagcgaagcattggtcagagaatgaatcgacgtggcttgcacactcattattccgatcgatcgagcgaccgcagcagcatacttattacagcgcatggtgcggagcagagcgaacacaccgaattatctgattggattattgggactccataatgacttggtttgcagaagaagtgctcaacaagccgtaaagcaggcatgatgtcaggggcgcgatagttgttttgtttccttaattgcttgagtgtacacggggtaaaggaagctgcttgtatcctgtgcctgtgcgcggcatcttgaacgtacgtagctagtgctgcaaccacatgtgcatgtgtgtgtgagtgaatatatataaacgaaaacaaataaaaggatcgacgatgcctgcttggtttctcaaaaggagggaggaggaggaacatctgtattccggagacgcgctggcccaacttccggttcccaaggaacatttttatatcctgcagatgggaataaggtagcttgtacataaaaaaggaacaatatgaagtactataaggtaagagtaaaagagaaaaaaagaaagaaacgatacagttattagattatacggtttatagagtaaattagaaatagaagatgaaacaataggatgagtaagctgctccagaaagcctaaagtgatctaatagaatcatgtgcattcaatgtacagatatattatgtagaaaaaaaaaatcttgggctccaaacgcaatggtaaccgctgacttacttcgccgggacattattatggacaaatagtgtatcccgtgtaacttggggtcta

SEQ ID NO: 659 - DNA, 1655 bp, Zea mays
  misc_feature (1)..(100): optimal_loci_46788_G1, chr1:273700982..273702636, Cluster 4
tccttataaatttacatatattcaagttttgaaggggataccatatatgctatataagacattatgagataaattcttggtagtaacttattttagtagatccgtcgctgttgcagtgtgccgcgggaataaaaaaaccgagatctgggatagttgtcggtggactgttgtcggtggcggattccccggcggggcccgcctgcatttgcctgccgagggactcgtgtcgtcagacggtcacgtggttcattggctgcgcacggctggggtctgtctgaggccgttgctcgcgcactccgagagtacgagtgcactgaaccccatgcagattcggaggtagagtgccgactgccgagagacctgctccaccgcgaccattttcattttctcaccaaaagcctgccaagaatagaacggacggaccggatcaccaggggaaaaggccgagcgtgcttgtgctcagcgctcatcggacagcgctttgcggagcgcactgagcctggatgcaagtggcatgagtgcccgacacgcacatgcttttggaataccatccttttcctctcaaaggttgaaaaaaaatcgggtactgagatcgttttctagctaacgaggataagagtttacaacgactaaggccctgtttagaagggttttattttaaaaattgcagctttagtttttcagcttcaccttaaaacaacttcaacagattggtaagactgtgttcaagagtgtttgacttgcacacagactccagcttttataatactattaatttgtgtgagtttccttaattactctgatgattagcgggtgaagaaagagacatgaatttgtgagtcatgtaaccaatggtatgacgggtaatttttattcaacttcacgagaatgtataaaaacaatgtttttgaagcgccctttgaggagcctcaaaaatttcataaaaccggtctccagtttcatgagacagggcctaaggccttctttgggagagcttcattttaagaatttcaagtctatttcagtttctatccaaataggttcagctccacgagctctagcttaaaaaaactaaaactagtggctagttttatgaaacttttgaagctcctcaaagggtgcttcaaaaatattgttttatacctcctcatgaagttgaacaaaaattacccaccatgtcattggtcacatgacctactggttcatgtctctttctccacccactaaccatcaagggtaattaaagaaaatcacacaaattaattgtatcatagaagctagacactatttgaagccaaacactcgtgaaccccaccttcccaatctattgaagttggtttatggagaagctggaaattcgaagctgtattttttgaagtgaagcccttccaaacggggcctaaagcaaaacaaaggctacaacaaaacctatctctcctttaggacaactggagagccaggcgcggggttgtcgcggccaaatgcacgcacactggccacagtggcggacctagaatttaaacctaggggtagtcgagaataattttttgtataatttggtactacatatatctaattttcatccatttggtacataagtacattattagaaaaataatcaaaatttcttataataaggttgtaagttgcataga

SEQ ID NO: 660 - DNA, 1793 bp, Zea mays
  misc_feature (1)..(100): optimal_loci_47351_G1, chr1:277502356..277504148, Cluster 4
gcctgttctccactccgcaaattctccacttcgtaatacttacggtccctttttaaatcggtcatgtatatatagctcatgcactccgtttctgcaatttttgtaaactgcatatacgtctgacagagtacctttcttcagtttcagttactatcctactctttttgtcgtagaggttcagatgtaattttaaaacaaatatcattgagcagcatatgggaccaccatttataatgatctatatctcgtcaagtctgttttataaacatctatatatagctcaatgcactctgttttattttttttaacacagttgaacactggattctgcatttttggtaaactgcatatacgtctgatagaggagatttcttcagtttcagttactgtactgttttttttgggtgtagagattcagatgtaattttgaataaatttcgttgagcagcactctgttttattattttctatactgtatgctctcctcactttacaaccaagtttgaacacacggttaaaaatacaagcaatagtaacaattcacctgtcctgaatatggagattccagggatatttttatctgtgtatcgcccatacactttaaaaacttatgttcttgtttgcaaacacacattatttttcttttgtattatatttactgtgtgcatgtggtctcaataagattttattttctatcttgtttcatgttaaaaggtagaaaacgatacacctcagttatcaaaataagtacaaggggacgtactgcgtttacagataaaaccaaccaaaatatcacaagtttatatttgcattactctcatattacatggtcctgccatttaataaattttaactgattcatgatgagccatgtccagagccgtccgatgaggaggagcgtaagaggcaggaaaggaacagaaaacagagagaataccgtgcaaggataaggtctgaagaaacaatagaggaaagggaggtgaaaaataaaagacagcgtgaatacagagcaatgaagaaggcagcgtcagataattgcaacgaagatatattgggtatatttcaaataagatatattgggtatgggtttgccataatccatcgattcaatgtaggaataaaagactgcgatgaacaagatcaatcaccaaatgttaacgcgtgttcggtcctcatacaatcgcctagagtcaaggaggaggtgtacctagatgattccatggactggctacatagaaatgacaactacgtccgaggaaatgcacgtacctataatgaatgcactgatgaaatggggagtacactcatgtcgaccataggtgccatgtcaacttttctaatatgaattccttcttataggtggtaagcgactcatataatattttcaggacatttgtcttcgtccattgctggttctaccatggacaagctcactactataattataattataattgaactgtgttccatgttggctaatgcgtatctcctctgttagcctctccaaaatctggtattgaatcgcaaaatctggtctatcaaacacctccccgtgagctaaacgtagaccctagcttgaccaactatgccactgtcttatttgagtccacccaaactgaggctgatgtttttggtaagctgattgactgacactttttcccaaagcacctgaattacattttagtaacatacatttcaatcatataccatttttatattactactgtacaaccaattttatacccaatatgtgcccactactagaaccttccaacaaggacgagcgtaggagg

SEQ ID NO: 661 - DNA, 2018 bp, Zea mays
  misc_feature (1)..(100): optimal_loci_48075_G1, chr1:281158909..281160926, Cluster 4
gcgtgagaagtagcaatagttggggatgaagacatgcttctatctcattctatggaacaaatcactgaatagcttttacggttaaaatgaagtttatattttatttaccgtctcatcccacgaaaccaaatgtccggtgtatgccacataatcgtaccctttatttttttttttgtcttcatattccttcgaatagctttatggttccaataggttataggcctaagataaaggcagaatgcatcatcaatcttccgcctggcctgtatacccagacttctaattaccttttctcctttaccgaaagtaaaatatgattccgcacctaactgattgatctgatttctcgaaagcgaaagcgaaaaagtcaaattagtattagcgcccacccaaggcccggtttcatctttcgaagttcaaatgcagcaaagaacaatggcggtcagcgtgccccctgattacgttctcacggtcattggcgacggtgacaacgatcaaagttcaaaggcacgcgaaaaaaaggcttcaggttcgtttcgaactactaaaggcatcaggccaatttctgcttggctggaaacaaagggcaattggagggagcgagtttacaaactctgggtgcgagaatcaacggccacgtctcacggccccgtgtcccgtgacatgaaagatcgtgtttgttttgacctgcgacgccgcgaagcatgtcttaagcatacatacattttgaaaggagactagccgtgtttgattttgaaaaggtgtttgtgctaaattttgctcaagcatagatgataaaatacatcagctggatcatcccggcacatcgaacatgctgttttttttttgtccttcttgttgattctagctaccgcacgacgccagtgacatggccgccaacaaccacggtcttgttcacaactcaacagctccactccctccatcctataatatagtagtcttataccccatttagatatcaatattggagcatataattggaaattggaatcaactttcataaattatgttgtttggttatacacaaaattgagatttgggaacagagacctaattccctaaaattggactataactagaaattctctctctctctctctcaatacaaaaactcactcatctgtattacatagaattagaccgcacaatttcaactctaatataacgacatccaaacaatagaattggaatcacatctcatttcaataccatgcctgatttggtattgaacccaattcaatcccatgccctccaatatcgacatccaaaacagagcgttaggtgttcacgttgttcatatacaaaatgtcatatttagaaattcatatatgttagaaacgttgcaaggtgacattctactataagcaattaatgaaatatatatatatttttttaaaaaaatattattaaagtgtttagcaagaactcccaccattccttaatttcaaacaatgatctatgcttaattgcttatataattgttataacaatgaggatgctggtaaaagaagaacacatgtgctttcacccacttttcgtactcggaggacacttcttaaatttaatagctatcatctgtatgcatctatgattatatatttcattaattagatagtgttttatttaatatacgacattgttttttaaacaaaatttaaacataagaaagttatttcagttatttctttgaaacgtccctcgaattcaatagtaattacatggaaccgtagatgacaaaactgtttaacgtttgtagagtaaaatttaaaatagagaataaaattaaggaggacacataggagttgccggtgacggcacgaggatcccagattccaagatctgggcactctagtagccagggtccaaatgccagcgcctatacagatacacatcgaaagtagccagaagcatgcatacggaaacggacattcgggccctttctggcgcctctggtctgggtctgtggactagagcactcggccacactagtcgagcgc

SEQ ID NO: 662 - DNA, 1621 bp, Zea mays
  misc_feature (1)..(100): optimal_loci_50185_G1, chr1:291722316..291723936, Cluster 4
ccttttcctcggttttacttttcaggtctagagaccataataactgtgaatttaatggcattagaccaaacactttgaacctgttgcccaataagtagcacaccctcatttttctcctcttcccttcttactctacccttcctactcttcccttcttctctaccttccacttctttctctaataaaatgggggctcatctttctctcttcctctcctttcttctctgtacttcacctttatattcaatcccccctccccatccccattagatccgccactgccacaaatggtgaatcataactcttaccataaagatccatatgctaatgagtttggcattaagatcagtgaacgttttgggttcaatttaggcatggattctacctgctccttgggtaggctgaatggcttcaatttaggcatggattttacccgctccttgggtagtctgaaacccactcatacgtttttagcaaaaaaaaaacagtggggagaaatcatgcccaatatgtagataaactatagagaaaaaagaacaatataaagaacaagaggtccaatgtcgctccgcttttattgcaacagtggcttttggagtattttaaattgtcatatcacccttctttgccatagttaatatactcatgttttgggacaaactcctgttttataaattggggaaactctttgtgggtttgataactaacaccagtaatatcttcttgcaacatatttagccttttatattttacttatgatgcagctcaagtataatgaaactagtagagagaacggctgcttgcctacagttgcacagtggaatatgaatgactgatgagtgatgtccgttgaattgcttattttgttgcagattatgcatgctacaagattacttgtgttctgattggcaccatatagcaacattgaggtaatttttaggactaatatatactgtaatttttcaaattctttgcactactattttttgtcttgtgctgtccagaggtgctggatagggtgtcggaataggcgccgcctgatctagtattttataaataaccatttattttgtgattcggtgaaaatactctcttcttacattatttgaaaacaccataggataaacaatcaaagctggagattgcttgattatatggttgcatcaaaatttgtatctgtatgtgatatatcatttctatgtagttgtaagtgatgaccactttcaacaaccaaagaccttgtcaacaataccttcgtacgcctcttgagtgaagtcactatactcaaaagagcaagcacgactgcacgagcaaggtggactacgagtacgagaggcaacagagagccgacgccggaggcgctagcgcgacgatcctctgctccggcgcccgcggcctgccacgggcctgcacgaatcggatctgacggagccaatcttgggccagatatggggcacgggccgtaagctggaataactagccccatcgcccgacttccaggaccgatgcatacatatccgtgggcttcagatcgcgactcctggcaggcgtgcagagcacgagcgacatgagttgggctaggagcctaggactaggagtcgtacctccacttgatcggtgg

SEQ ID NO: 663 - DNA, 1421 bp, Zea mays
  misc_feature (1)..(100): optimal_loci_50820_G1, chr1:295263677..295265097, Cluster 4
tactcaaatataaaatggaaatcgtagcaacgtctagtatataaaaacaatagtagtgtgtttgggaacaaagttttttttctgcgggattgaagcaatactgcagtatgagcaatattgtggtattatatgctttaaaatgtttagaaaatcatctgaaatctctgtatactaaattgcacttgtttgtagctttataaaatttgatctcaaccaaagtttttctaccatccacgcttggtcccgctcttgcccattggtgaaaaccggagcttcctaaccctttctttctctagactagaggacgccacttgccatcttgttttaactttgagaacgaaaccaccgatgccgactgctgcagtactgtttgtgtttgcttcatcgtaaatatgaagccagtttcgaaataaatgggtagattaaggctatttttgggatggctttattttaataattattgtttcggttttccaccttcatcattaaacgactttaacagattggtgacatagggtttaagagtgtttggtttgcatatagattacaacttctgtaatacaattaatttgcgtggatttctttaattatccttgatgattagcggatgattaatgactagaaaacagtcataaaacgaataaactctgaagtaaagctctctcaaacagaccagtttttaaagtgtttggatgagagttgtgttagggtaagataaattacggagtaacttttggtggcgatatgattcaaaaaagtcgagaagacggtgtcaccttcgtctcatctcactttgacatcaaacaaacacatcctaaaccaacaatcttccgcacggagtcaagtcacgccacaagtctaaagccggcgcaaagctcattacgaacggtccagtccagatctcgttgctttcggcctgccgtgccgtcccgtcctgcatgcgggatgtttccctacgtttcttcctgcgcgcgcgccatttgcgccacagccgtcatccgtgcgtggtgcttgccgtgtcgtcgtctgccacggcgcgcgcggggccggccaggaacggcttgcacttccgtcgtttgcaccgcacacaatgcaagtttggcacacacgacacgacacgacacgtacggccgtgccgactgccgccacagacggcatcgccagacccagacatttgttaggcggccctgtgtctcacttaacacgtacgtgcaccacccccattgagagtttgagacccgtctgtctccgcttctctgactcacagccctttgctccgtctttttcactagtattttttttctcactcgatgaaggatcgaggcatcgagcaggccacgtaaatggtagccaatattttttttgtttaataattttagcctactttctaactcagcatctaaccactcacatcacatata

SEQ ID NO: 664 - DNA, 1960 bp, Zea mays
  misc_feature (1)..(100): optimal_loci_52052_G1, chr2:1694346..1696305, Cluster 4
ccgtaaaaaaaagaaaccctgatgaaccagtcttgttccgcgtctccgacccgccggatcaagctagctgatcgaatcggatccctgcactgcacgctgcacggcgatgacgattggcgaatcggatccctgcacacgcaccagcggactgacctagcgcagttgcgctgtcggattcctgtccgtccccggcccgcacgcacgcgcagtggctgccggtcaagtagtggatgtggatgtggatcgatccgacgccaaacaaagccacggcgtgtccgctacccgctctgctcaaagctcaagtacctagtgtgtggatcctatcgtggtctgcaaaacatatcgggtaacgaacttcacagatgacgtgatcgctactaatagcatgtgcccgctaactacccgcggtaataaaaagatttatatatattcagatgccgcagcagcgccagtagacagggggggggggggggggggaactgaaaaagaacacgggtagtagcaacaaccaatcttggtcgatgcggacgcggcaggcggcagcgaatggatgagatcgagatggagatggacagggcaggcgacatcagtggcgtgtgccggacggacggatggcgactagatcgacgctgctattagtaggcttgcatggggacatgacaagtgctcaatgataaattaaaatctatcagtatcaatcaccaggggggtggccagtagactgagcagtatctgtttatgtagtctgagcagcagcaccacctaaacatgacacttcaccaacccctgcgtaaaagaggggtggtcggtcataaatgcatgtgaataatataaaggttgaagatgagcacaatcgagaaccagcataaatataatgcagtttaaagagattcatgacatttttgtaacactctacgtcctctactattcatctctactattcgtcgattaataaaatataaaggtgaagataattacaaactcattaactaactcaacatcatgacctcctagccaccttaccacttgatttttggtacaagttctagcttattggtttctaatccacctctgtaccggttcttgagtgtcgtgcatgtgaatcttgtcccccccatctttccaaaatggcacccctttacttttactacactacttattggagcgaagatggaaccagtccttgatcacccttcgtactcatcaatcaacaagatttccgatgcatgcatggtgatcggccaggggaaacgaagcggatgtgggggccttgacctcacgagaggcgaagtccccttggcaagttcgacgaagacaacgtcgcgaggtagcgaaggcctacaacgaacacacccatagacgagtctacgtcagcaagcgaatgcctcacactaaaccccaacggggagtcggacgacttcactgctccggtgacaagaacatgttcacggaggcgatatccacggccctgctgagaggttgcacctccaaccagctggcgagatgcccccacctgtcaacctctcttgagggtataaaacctcgtacaattaggctaataggtttactatactcctttatagagcatgtgaggagagagtttacatgttagctagtccatgggtccggtcagttaagactcaacaaccacaatcttattttaaccatagatttgtaccatacctaccggagggggtagatatgttatgtcgcttctttgcacactagggtatatgccattggatacttcatagttgataaacggtgcaacaatctgcacatccagtgtaagccatatagattacccatgctaacatagcgaacatacttaagctaaaacagctacacaccttcttcacaagatcttttagttgttttctaccttgtaatttgcaagaccaggagtatttggggaagaaatatttatgacattcattaagagtacaaatatgcctcacag

SEQ ID NO: 665 - DNA, 3121 bp, Zea mays
  misc_feature (1)..(100): optimal_loci_535_G1, chr1:2904407..2907527, Cluster 4
  modified_base (2836)..(2836): a, c, g, or t
  misc_feature (2836)..(2935): n is a, c, g, or t
  modified_base (2837)..(2837): a, c, g, or t
  modified_base (2838)..(2838): a, c, g, or t
  modified_base (2839)..(2839): a, c, g, or t
  modified_base (2840)..(2840): a, c, g, or t
  modified_base (2841)..(2841): a, c, g, or t
  modified_base (2842)..(2842): a, c, g, or t
  modified_base (2843)..(2843): a, c, g, or t
  modified_base (2844)..(2844): a, c, g, or t
  modified_base (2845)..(2845): a, c, g, or t
  modified_base (2846)..(2846): a, c, g, or t
  modified_base (2847)..(2847): a, c, g, or t
  modified_base (2848)..(2848): a, c, g, or t
  modified_base (2849)..(2849): a, c, g, or t
  modified_base (2850)..(2850): a, c, g, or t
  modified_base (2851)..(2851): a, c, g, or t
  modified_base (2852)..(2852): a, c, g, or t
  modified_base (2853)..(2853): a, c, g, or t
  modified_base (2854)..(2854): a, c, g, or t
  modified_base (2855)..(2855): a, c, g, or t
  modified_base (2856)..(2856): a, c, g, or t
  modified_base (2857)..(2857): a, c, g, or t
  modified_base (2858)..(2858): a, c, g, or t
  modified_base (2859)..(2859): a, c, g, or t
  modified_base (2860)..(2860): a, c, g, or t
  modified_base (2861)..(2861): a, c, g, or t
  modified_base (2862)..(2862): a, c, g, or t
  modified_base (2863)..(2863): a, c, g, or t
  modified_base (2864)..(2864): a, c, g, or t
  modified_base (2865)..(2865): a, c, g, or t
  modified_base (2866)..(2866): a, c, g, or t
  modified_base (2867)..(2867): a, c, g, or t
  modified_base (2868)..(2868): a, c, g, or t
  modified_base (2869)..(2869): a, c, g, or t
  modified_base (2870)..(2870): a, c, g, or t
  modified_base (2871)..(2871): a, c, g, or t
  modified_base (2872)..(2872): a, c, g, or t
  modified_base (2873)..(2873): a, c, g, or t
  modified_base (2874)..(2874): a, c, g, or t
  modified_base (2875)..(2875): a, c, g, or t
  modified_base (2876)..(2876): a, c, g, or t
  modified_base (2877)..(2877): a, c, g, or t
  modified_base (2878)..(2878): a, c, g, or t
  modified_base (2879)..(2879): a, c, g, or t
  modified_base (2880)..(2880): a, c, g, or t
  modified_base (2881)..(2881): a, c, g, or t
  modified_base (2882)..(2882): a, c, g, or t
  modified_base (2883)..(2883): a, c, g, or t
  modified_base (2884)..(2884): a, c, g, or t
  modified_base (2885)..(2885): a, c, g, or t
  modified_base (2886)..(2886): a, c, g, or t
  modified_base (2887)..(2887): a, c, g, or t
  modified_base (2888)..(2888): a, c, g, or t
  modified_base (2889)..(2889): a, c, g, or t
  modified_base (2890)..(2890): a, c, g, or t
  modified_base (2891)..(2891): a, c, g, or t
  modified_base (2892)..(2892): a, c, g, or t
  modified_base (2893)..(2893): a, c, g, or t
  modified_base (2894)..(2894): a, c, g, or t
  modified_base (2895)..(2895): a, c, g, or t
  modified_base (2896)..(2896): a, c, g, or t
  modified_base (2897)..(2897): a, c, g, or t
  modified_base (2898)..(2898): a, c, g, or t
  modified_base (2899)..(2899): a, c, g, or t
  modified_base (2900)..(2900): a, c, g, or t
  modified_base (2901)..(2901): a, c, g, or t
  modified_base (2902)..(2902): a, c, g, or t
  modified_base (2903)..(2903): a, c, g, or t
  modified_base (2904)..(2904): a, c, g, or t
  modified_base (2905)..(2905): a, c, g, or t
  modified_base (2906)..(2906): a, c, g, or t
  modified_base (2907)..(2907): a, c, g, or t
  modified_base (2908)..(2908): a, c, g, or t
  modified_base (2909)..(2909): a, c, g, or t
  modified_base (2910)..(2910): a, c, g, or t
  modified_base (2911)..(2911): a, c, g, or t
  modified_base (2912)..(2912): a, c, g, or t
  modified_base (2913)..(2913): a, c, g, or t
  modified_base (2914)..(2914): a, c, g, or t
  modified_base (2915)..(2915): a, c, g, or t
  modified_base (2916)..(2916): a, c, g, or t
  modified_base (2917)..(2917): a, c, g, or t
  modified_base (2918)..(2918): a, c, g, or t
  modified_base (2919)..(2919): a, c, g, or t
  modified_base (2920)..(2920): a, c, g, or t
  modified_base (2921)..(2921): a, c, g, or t
  modified_base (2922)..(2922): a, c, g, or t
  modified_base (2923)..(2923): a, c, g, or t
  modified_base (2924)..(2924): a, c, g, or t
  modified_base (2925)..(2925): a, c, g, or t
  modified_base (2926)..(2926): a, c, g, or t
  modified_base (2927)..(2927): a, c, g, or t
  modified_base (2928)..(2928): a, c, g, or t
  modified_base (2929)..(2929): a, c, g, or t
  modified_base (2930)..(2930): a, c, g, or t
  modified_base (2931)..(2931): a, c, g, or t
  modified_base (2932)..(2932): a, c, g, or t
  modified_base (2933)..(2933): a, c, g, or t
  modified_base (2934)..(2934): a, c, g, or t
  modified_base (2935)..(2935): a, c, g, or t
gtctattctgagatcagcttgattcgtatccagattacgcaccagataagcagcgtgttgcggcgcttgtttgaagtcaacgctcaggccgatttcatgaagctgacaggcgctgatgagcaaatcgcggcttattgcttcaagatgccattcgttttccacctgatcgaagaagttagccgcaactttggctacgcgctgtgcctgatcaatatcgatcataaagcggcgttgaatattacgcagcgtacggctgcgaatatcctgctcgacggccagatgcaacatgccgtagaccaggccttcacgcagcgcaccgcccgccagggtcatacactgaatattcagttcggtaaaaatggcgatcaggatcgccagaccactcgggaacactaacgcacgttccagcgtcagcccgtcaatctccagttcctccagccgaccgcaatgaatggctcgctgtttcaattgctgcaacttttccagggtaatgcgttcatccatcccctgtgccatcatgatttcctgtaacgcctgcacggtgccggaagcaccaacgcacactttccagccgtgataccgtaattcatcggcaaccggacgtaacacttcgcgtgccgctttttctgcagcatcaaaattttcctgccccagattacgatcggcaaaatagcgttccagccaggtgacgcagcccatcgacaggctgaacaacgaggtggtttgtgcacccgtgccggttaccagttcagtactggctccgcctatatccaccaccaggcgctgatcggcaccaccagtggtgtgagcaacgccctgataaatcagacgtgcttcctcttcaccgctgatcacctgtaccggacaaccgagaatttcctgcgctttggcaataaaatcacccgcattgacggcaaggcgtaacgtcgccgtagcgacaacgcgaatttgcgagggaggaatatcttgcagacgttcagcaaacaggcgcaaacattgccaaccgcgctccattgcttcattggagagggcattttcgctattcaggccagcagccagacgcactttgcgttttattcgcgtcagcgtctggatgcttccagccacctcgcgcacaaccagcatatgaaaactattcgaaccgagatcaatggctgcatacagcgacgaggtggaacccatactcttcatccttcaatctgtctctgtgttggctgcattctttcacctgaatcacttactacagtaagctcatcgggattcattctcttgccatcttgatacagtttgaatgattttgagtatgacattttttatttaacctgaacgacgacgattacgcggagcgccagtacgacgcggaccattgcctgtgcgcgggcgcgtgaggcgcagcggttttggcagatcggtcatcaatgcgtccggattgtatttgcttaccggaattgagtgaccaatataggtctcaatagcaggcaaattcaatgcatactcttcacacgccaggctgatagagtgaccgcttgcgcctgcgcgacctgtacgaccaatacggtgaacgtaatcttcacagtcatcgggtaaatcgtagttaaagacgtgcgtcactgccggaatatgcaaaccacgcgcggcaacgtcggtggcaaccagaatatccagatcgccacgggtaaattcatcaagaatacgcagacgttttttctgcgcgacatcgcctgtcaataaaccgactcgatgaccatctgctgtcaggtggccccagatctcttcacaacggtgtttggtgttggcgaaaataatcgctctgtctggccactcttattcgatcagcgtttgcagcaaacgcattttttcttcgttagaagggtagaaaagctcttctttaatacggtggcccgttttatgttccggttccacttcaatatattcggcattgtcatctgctcgaacgccagttcacgtacccggtacgaaagcgtggcggagaacagcatgttgaggcgctggtttgcaggcggcatacggcggaacagccagcggatatctttaataaagcccagatcgtacatgcgatcggcttcgtccagtaccaccacctgaatggcaccgaggttaatgtggttctgcttggcgtagtcaattaaacgccccgtggtgccaatcagaatgtcaacgccgctttccagcactttcagctgtttgtcgtagccatcaccaccgtaagccagacccagcttcaggccagtagcttccgccagcggttctgcgtcggcatggatctgcacggcaagttcacgcgtcggtgccataattaaggcacgcggctgattcaccttgcgatcggcaatcgcaggatgagagagaagataatgaaacgttgacgtaagaaacgccatcgttttcccggtaccggtttgcgcctgcccggctacgtcacgacccgccagcgtcagcggaagggccagtgcctgaatgggcgtacagttatgaaacccttttttttcaagggcttctacaaccttcggatgcagggcgaagtcggaaaacttctgttctgttaaatgtgttttgctcatagtgtggtagaatatcagcttactattgctttacgaaagcgtatccggtgaaataaagtcaacctttagttggttaatgttacaccaacaacgaaaccaacacgccaggcttattcctgtggagttatatatgagcgataaattttttcacctgactgacgacagttttgacacggatgtagacatccaacggggcgatcctcgtcgatttactgggcagagtggtgcggtccgtacgaatctctagatccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctagagattcgtcaagatcagcaatttagctatatatgaagaactaacatgctgcctgccacgcagagcaaagtataggcttcgttcaactcaccattctttgaaggccacggactggtattgaatctgcaaatccatcaatcccaggaatagtctgttggtcataaaatttgtgtgaatgaa

SEQ ID NO: 666 - DNA, 2077 bp, Zea mays
  misc_feature (1)..(100): optimal_loci_53706_G1, chr2:10464137..10466213, Cluster 4
ggtgaacttgttctacgaagttaggatgctctttctttttacagctgggatgctcagttctaacatgagcgagaagaactattacgattaatagaggtgtgaaatagttaatctgttttttctcttaaactatgccctctaatttcttgcctagttgttgggaggtgcattggattccatggaaaccactcaggtgcagatcacaggtcttatctccgcttgtttgtggcccttgaactttttttcagaacagtagtcagagaaaggtccacgcattcacttgcgagactagggctcaaagcttgcttgtaatttttgatgcgctgcaatttttcccatgttttttcggttctaatctttgggattgggagaaataatgcaggctgtcttttggtgctgggctttatcatcttttcactgcaaaaatcttgtggatactgcaaagtgcaaccaaagcagactgggcctcgaattggagtatgcagatagaaagctagtaaatgattggttattacactgaagctgcagatgccatagcaagctgaaggttcgccctggtgatctgaatctgatcccatgccatctcatgatgagatgcaactttttaacataataatgtttgcctaattcacatcattaaggtagaatgatgtcctaaggcttaacagcaaaacaaaaaaaatctttggatatggtgcaatgtatccgcgtggtacgtgcaaagccaaaagacttttgctggcaagcgtacatgtcttgttagttgctccaggtcagccgtcaaatttttaccatacttcttttattttaattttgttttctttgtcacgtatacaacgcttccccttttgtttttctggcacgccaacaattagcaggagatttttcaagaacagatgcttttcagaaacagttggcaggaaatttctttttttcacgacatgttaaaccgctgttgtgcagtgcagaattggccttattcttgcgtttaaaaaatgaagaattgatctcaatcagaacaaatagatcaggcaaagtactgaaaactctggccaccaccagtagtataggtcagataaaaaggaaaacaaaaatgtctactttttaagtgattagctacagtttatattgaacaggtcagtttagatgaagaacggaactctttcagaagaatcggataaactttccatgactcgctggcttcttctagacaaaaagttagagcttctagaaaatttcagactagagaagaaaaggccatcaaggatagatggaggtgattcagacttgagagtgagaccaagatcatgcctatctacacacaggcattcctttcagcttttttgctaaaagatgctaaccgaattctaaccaggacacaccatcacgtcaaatcaaaccagcggaaggtcctctagttcagtgttcagaggtcaagtttgttgcaaccacaggattaggacaggtccttgctcgacagcgactccagacctgacctacgaatgaatggatgaacggcacaatcagacaacagtgacgagttcactggtcagagtcagtggtacagcggcaaccgctgtatccttcgccctaagcacaatgcatgcggtcgccaaaagcagattaggagcaccgtaaagcagacgctttgcacctaaaatcggcaatgattaggccggcaaatctgtcattttgtggccgatgcatggtacgtgctccgaattttctttgacatgcatatttcagggtctatttgggagggctacatttcaaaatttttgaattcgtttcagcttctttcatctaaacaggtctagctctagctttggaaaaaaaattgaaactagagaccgactttatggaattaataaagctccttaaaggatgcttcaaaaacagtgttttcattcctcctcgttaacttgtatgaaaattacccagtatacaattgattacacaatatactatttcgattctctcgtcacatccactaatcatcaaaaataatcaaggaaattgatacaaaatcaattgtattacagaagttgtagtctatatataagccaaaccttctcaa

SEQ ID NO: 667 - DNA, 1628 bp, Zea mays
  misc_feature (1)..(100): optimal_loci_54314_G1, chr2:13542011..13543638, Cluster 4
ggtggggtggggtgggtacatacacgcgcagccgcagttcgagacagaaacaaaggcactgcccgacttgttgctctgctctgcgttgcgccgtactaggccgcagcgatcagcgccgttcggtagcgtgcacgcgcgctgccatacgtcagcagaattatcgagccggacatatttgatacctggcacaagtcgtctcttggaagtgaagcagaagcacccccccagcgagccccggcgccgacggcgtgtcagccactcaggcagccagcccggggagttgccatgccatgccatgccgtgccgagaagagaaagaaacgaccccggaaagtccccaggaatccaggcggccgcggagccggaggagacgcggacacgcacggttaacttatccccgggccacgcaaggcccgccaccgcagcgcggggcgccaggacagccattccctggcaatggtggagccatcatggcgtcaaggcctcgctcgacagaaccccttgtttttgttttattaattatctgtcgcttctgggtgcagtcggtctcatctcagcgcgccaccgcggaggccgccggagagcgagagcgaacctgcggtggcctcaggtgctccggtggttgcttcacttcacacgcgagtgctggaagggaagctaaggaacgccaggcaggcaggcaggcaggcggccgctagaataaaatttcgatgcagtgctggagcatttgattatttgctttcgccgtagactactactggcgtcgtcgcccaactacccggcgcagccgccatgaaatgagcagcacggcatggtcgtctcgtcctctcccccatcgcatttcgcaacaaaggtcttccacggcaacaggagtcgtcccacccgttttttttttaactctggggcacaggtccaaagcgaccagattttagccggctccgctgcctttacaagcgtcccgtccgtgccgtgtgcctgcgtgctttcaagtttcaactacacatggcgttgccacaaaacatgcgtaaaacatgcgtccatccatgcataaaacatgcgtccaagccggtagataccgctgctagctctatgcctctccatccatgcataaaacatgcgtccgtttcttactccatgctctatgcctccatcaatggatggatcgaccgactgaccgaggttgcatcgcatcgcattgcagttattatgacgatgatgatccgagccgggtgcaatgatagatatatagcatatgatcggatgcatatgcatgcccccggcatgggtgcatgtttcattcacctccacaactggagctcccctcctttcctggctggatctctccgggaggggtcccatacggccatacccgtccgccggaacccacagcaggggaacaggcgtctttccacgcgatcatggaggccggagccaaagcttccacgaataatgcacggcaggcatgatgattggccagacacgccgcgtagcttttcaaataaacgccccccggcgggcataggctcccgacgaggagccctttcctcgcaaccgcggtgctgtccagccagatcagtgcctgcccatgcatgcttccactcctgtagcggcccgagaaagaaggaagga

SEQ ID NO: 668 - DNA, 1893 bp, Zea mays
  misc_feature (1)..(100): optimal_loci_54847_G1, chr2:16543703..16545595, Cluster 4
tctctcactccatcagtgctagcacaaatgcacaatggtaacgtggtttccatcctcatacatgtggatactgtagagatgttattgttgttgttacgctgttgctacggatacgagaggacgttcgacgacttccttgactataatcgatgtgttcatctttcgttgcgctgcttgtcaatgcaagtggtaacaatgcaggatcctctgctcgatagatacgctagtgtgtacggtatatgttctctgacacgtatataccatacccacgccaatgcatgtatgagatgaaagaaacatcgaacgtggcagacggaaaacctaccatttatagtcaggcttctttgttggacctatgcatgcgcgccgcggatccacctgttgacttgaaaaacgaattaaaagaaagtgaactaattaatgttctcgctaatacaatcgcattggcctgccggcattgcatggcggaggagatcttgacgtgcgatgcgatgcgacggtggaagtggaactgtacttctccccgatccagtgcgtacgcgtttgagcgaacggccgagacgacggcattgaaaaatcgaacgatatgggcacaacgacaagcgtgcgtatagcggtataggaataggttgatggcccgtcgcagtatgtacggtacggccggcctccttatccagatggagcctgcaccggatggccccacaagagccttttgacctgagcctcctcctcctcctgtctgtctgtccaaaccctaatctcgtgggataagcagcatttgggaaagcttccggcacccacatgctccggccggggaccaggccgcactggacggacgcgagagcgagttgagtacttccggtcgatctcacctgcgaatctaccgtcgccgtcgcggcaccacgatgccgatcggagctcaggcatacacagacagctgcagagagcgcgttctgtggtagtgtgagtggcaaccggcctggctaagctgtagcccatctgcctaggccatcagttcaggcatcgcactttcctctgccgccttttgttttgttcgctcgctgcgtcgcgctccggtctcgttctaaacatgtaccgtaaccgtatgatgtatccgctgctgggtaactggggcacgtttccctcgagatttttatggtcattaaacagatgacgatttgcagggccgggtcatatgcatccatgaggcagcttattaaccgtcaatgaaactgactgctagctccatgtggtcagacgtcgtcagaggatgaaagagttggcgcgtgcatgcccatgctagcaagcacctgatcgcctggatggctcgtagtttaatttgtggaattgttgagcggctattggagattgttgttggtttctgtcgtcgattgtgatgggctcgtgtactgattccacgtgggatattcatgaagagcaactatagtgcaactgtggctatttggagtgcctcactagtgtggtttttactatgtcctaattgtgggtttggtgattgatgtcaattagcatgtgaaccacatagcttggactcgccacaacgaggtcgtagattgtcgacaagcaactgaacctcggggatgattctttgtgttcgatctcttgcccagttcggtttcatcgttatcacactcacattaatatcattgtcttgtatgatagttaactaggtcgtattcttttctgctataaagtgagtagttgctaaattgtgtgcttatgtaaagtcaaccaagagatttagcaactagatttgttaaagaggcttgcttgttgtgaaaatagaggtagagtaaatattcacttattatgtgtcatctcttatactaattaactttgctctagtgtttttgtggccttcaattcatccat

SEQ ID NO: 669 - DNA, 3154 bp, Zea mays
  misc_feature (1)..(100): optimal_loci_54865_G1, chr2:16649703..16652856, Cluster 4
ttagctgcggcggtgaaatgagaagcgtagtaaaaaataaaaaaaagtgttttttatcttttccgcctcaggtgtttcctcccctgctgttgcgtttcaggggagcagggggtagtgtcctgcatgcgtgggggcagtctgaggccagagggaacaggcgagctgctgctggcagttgggcagcagctccgtccctctctctctcgcggtccacttcccttcccatgcagcgatgcgcaggcgcaggattctctgcagctagcagcgaccctacgtgcctgctctgccctctgctcccgggctggggggattgggaatcatatcatagcccatttgtcttggtgcttatccatccggacggccgtcccactgcggcgcggcgcagcctgctgctcttggttagtgcctccggattagagaggcgcaagttgttgcaaaaaacgacatgatggccggtgcagtgtgatcgagtagcgtctcgctgtcaccctcttcccagccgcgccaaccctggggtccccgtaacagtcttcaccgctggtggatcccggccccaacccaacccatcgggcatcggctttacagctcctccgatacaaaggaacagataattgtgcgtgcctgtggactctgacctccctgtactgtgcccatgtcaatgcctggcctggcctactaccctctcaacaacgggcgcgcggggtaataaaactgtaataaagcctctcgagtcgcgaacagatcgaatgggtcttggtcttgcttgttttttccctgcgcatgcaccgcctgcaggacgtcgtgccgacgacatgggcgcggtgctcggcatgtcggcaccgcggtccgcccgccccgagcatgccaccaattacggagtcgtcgtcgtcgtcgatgcgtcatcgccggagtggtcttcgcgcgcgcgcgcccggtggaaccggccggtgcaactcttgctgcgcgaatcgagcgagcgtaaacgaaagcaactccctttgacatggagggcaagagggccggtgcctttcttcgagtcagtcaatgacaatatatggccatggagatcgactttcaaaccctgactgcaataacacgctgtccgccgccgagcgatgggcattggactattgtgctgggtgaagatcatgctggcgctgaaggcaacagtgccccctggccacacactggacctcaaggctgcagctccatgcaggcagtacgagtagtaagtagcaccacactcactaccagtggcagtgagtgcgcaggctgtgctgcgatggattggcgacgagatggacgccaggctgctccgcattctcgagtctcgaccggcctctctagcctcacctttcccctgcataccgctgttcgcagagtgcaatcccccattggctggccacggctcgccagagtagagcaggccggccgggcgcctccgcggtcgacacgcgcgcttgccgctggcccagcgcgcagcaggatggccacgcacggagcgagcaacctgcactgcaacaagccaacaacctgcacaaacccaccgatcggattggattggactggaccaccaacagacgcagcacggcagcagggcctagcacgagcagccaccacccgtttaaggccagagacccagagacgacagtgcaggggaggcacatcgcatcggcgtcggggcgtccgcaggcacccactactactctccctggctctctgccctgtggctgtgactgtggcaggacagggcagtgctcatcatcagtcatcatggcatggtgttcggacgatctcagtaagaaagcaatgcaatcatcgcgactctcgccaccaaaaatgcactcgcggcgcataccagtttcagtcaaaacacaaacacggacgagacctcagttccgatccagtgggtggtaacaaacaaccaagggcgtggtcgtttctagcggtccagtctgttcgggccctcgttccagacggaaacaatcagcttggtttggacttcgaccgtttcattccggactgttcgtttctatctgaattaaaaacgaatctggtttggtttgaagtttctccttcctttataggctcggtaccaatcctggccgcgtgccctctggatcgaaccttggcgaggtgagacagcaaagcatcacaagataataccaatttgttgtgaaacaagtgtttatattcctgcttgaaacgaacaaccatcatctgttctacagtttttattcctgtctgaatttcactggagaccaggtttcagtgaaccaactggattcacttgatccttgccctggaaggatttaggccgggattgaaaccgttggaaacgaacgggccccaaaggcatgcaaggcagccggaaaacacaggcttggatggaaatctcggcgagttttcccgcttcccccaaaggcacgacctggcttgccggcggccaccacgtaaaacccgtgcacaggctttaatacggttggtcagttataccacgtgaaagtgaaaaccctcatcaccttgtgatgcacccgtgcctatgcatcacaatgtgtgtttgtaggatgccgacagtagataaggccatagagatgaaccagtgtagctgcctctgcatgccagtgctaaatggctaattttgacgagtatggtttggattgattgattggatgcctttattcgatcatagatagccctatctctataggtggggtaaacctatcctgtggaagggaatgcagcggtttaatagctcttccaaaatctgtgcgaaaaatacatacgattcaaatttggttttggctgacaaaacagttttggccagcttgaaccggccaaatcttgcggaggttgtaatcttctttttgttcatcttgacttcaaattagattgaacagcacatcaagtaaacggactaatatctacatcacaaaaaaagaggccagcagggcccttaaacggaaaacctagaccattatccgtacatgacaaagacgaaaatgctgatgtaaataaatgtgtttttcttccttggtgtcagtttcccgttggcccaaaaagaaaaaaccggcccacgtaaaaaaggttctcacttgcagcccgcatcgctcatgccgagcagcggaggccggaggggttatcggcgcgttat

SEQ ID NO: 670 - DNA, 1637 bp, Zea mays
  misc_feature (1)..(100): optimal_loci_55390_G1, chr2:19196958..19198594, Cluster 4
taacataatgggtcgttacttcttgacaaaacatttcacaaaatggtagtatcctgtttggatatagatattggtgcacagaattggaaactagaataaattttcctaaattctatcgtttggttgcagaactgagatttggaattagagattcaattatgtgaaattgtaatataactagattctctctcccaattcagaggatcactcctcggtattacgtagaattagaccatctaattctaaactccaacatagtgacatccaaacaacggaattaaaattgcatcttattttaatactgtgaccgatttggaattgaaaccaattcaataccatgtccttcaataccgacatccaaacggaacataagggttctagcttcttacaaatgatgtcagttagcagttacatatcgattataaccattctcaactctcgctgctgtctcacatcgccatcgatcggtcactccatagtctccttaacccgatcgagccgcgatctcagatggcccatggcatgcatgcgccccgcgacacgttggtccagcagaaattaatatggccggtgtttgtagatatactggtcggcatcacaagatcgaagtgagcaaggaggaagaatgcatcacatggcacagctgcaggttgcttggcatatgctgggatgtgtcgacgtacgtatacctgggacttgggaggagtaatgcattcagttccacttccaacgtcccctctgctgatccgcccagcatgcatgcatgctcctggagtcctcctactagatttagtttggatttggcatcattaagaagcaagctagcggcaacaacgatcaccagattaatacttcgtttttttttgttgctggggacgtttgtactaaccgttgacccgacaagagtacagagataaacgttggtttctgcgacttgtcgactctagttgcaaacacgaggcacgatccatgtgcgaaaactatcgaggacacctgacagtcttctgaatcctcccgatggtgtcccccctctaccctaatctcaccaacaatcaactcgcccatcccttgcagtgatttgacatggaatgcaaatgcaggatcactccagaaactacggacaccggtgccaaccagatgaggtcctggaaagcaatcggcccgttgattgtctgaagaattggcactcaggtcctgtggtgacagagtcattcactgacggctccaccaagtctacagcaccaaattctggacagcaagtcggctgttttagttgcgtctcccttttggtgtgggagggaatgaagacgtcgtacgtatctgggcaacgtggggaggagtggagaactaggggcgcgcgcgccgaagaaagccgggggacacggccggtcgatcggatcggatctaccgtgcccggcggcgtcgttgcccactcacgctctcgtgccgcggccgccggcttcgtttgaggatcctgcttgatctgctgccgcaacgtgcgactgtgcgagtccgggttcaacgacaggtattaaccgcctggacatgggcttctcgcgaccctaaacccacgttctctgctgggccagaatgctacgcttcgctgggccaagataaaatcaggaccgggcgagcct

SEQ ID NO: 671 - DNA, 2566 bp, Zea mays
  misc_feature (1)..(100): optimal_loci_5735_G1, chr1:29190279..29192844, Cluster 4
tagtggtgatgctgatgcgcgcgaccgtgccgaatacagtagacgtgtgtgtagtctttttctttttccgtggtccacccacagcccagcctgggatttcgtgtggcgtagccccaaagaccgtgggatccatcccagcccaacgagtctcctctcctaccggcacggcaaaggaaccaatcaggctggcgatcccctcctccgtcccttcacaccccacctcccagcagcggcgcctgtgtgtgtccgtccctcctcccgtcgcatgccatgattcacctcacgccattgaagaagaaaaagggagaagagacggacaggatagatacagtcagtcgcaggcggaaacgcgaaagcgaagcgaccgagtgctgccggccctcccgcctcccggtggtgagtgaggtcacggtcaaagcgagccgcgcccgggctgcagctgcaaaggtggttggcagcatcaagaaatgccctcctcgatccctactgcctccggcttggtcccgccgtggatgtggatggatggcgttggcatcgcatcggggacattggcatggcgctgggacacccgccctctggaccacattgaccggtcagacaccacgggccacgcgggcgagcacgctgccttcccccgtgcatgcgatgcggacgcggatgcggtccgggtccggtgccggtgcgcgccctcttctctcccagtacggtagtacccctctggctctggatcgcgacgtcgcgtgagccccccaccgccgttcctgtcgccgatccggattaggacggctgactggttaatcaattaaagtgctagctgactgaccgataaagcgccgtctcgatcgagccgggcttggagctccggatcagcatctgcccggcccgggcatcgtgatgatcgtccgtggcgcctaacttattgcggctcgcttgccaccgcttttgtttatgcctgtttgccctgtcatttattaagccctagtattagtttttttagggccttgtggctttctgcctctgggggagcagaccggtttagcagcgcggtcgcaggctttggtatttttttagtaaaaaaaatatttcttaattgcggcagggcctcaaggaccgtgtagtagctccagtcgtagcgtagacacatgcacgcacgcgcgttgtggatgccgaaaacctgaaaagaatctccaaacaaaacaaatgcagattggactgctgaccgcccaggtcggcttcccccggttcaaattgggtgtccagccagtaagcactaggcaagtgctgcggacgaactgtccagctggcgttcggcctcacctgaatcgtgactaaactaatctcaactctcacctgtcccaggaacgctgggctcgctgcaccgcccggcagcatttccatgcctggctgcctgatcctggttcgtgtttcgcccggcaagaccgcaggaactagaggcgcccatgaccgcgcgcgcaggcgccacagagcgcgaggccagccgcgacatcgcatcgcactcgcacgttgttgagtcgtaaactcgtagtaaggctgtcctcaccgttacacataaatatgtacgggaaaaaccgtttcagcactatacatacatagattgaagttcggaatataaataaataatataataggctctctaacaatgtcaacctaaggcatgggccagcccctcgcgcagtcacgccacgcacgcggtgtcccgcgccaccgctgtcgtgtgcggtgtgccgccctgccctcctccccgccagcagcggcagcggtgcgcactgtgcccaccggacgtgccgggccagaacgtgtatccgcgcctcggtgtcggacgtcaacggagcagctgagccgagcggagcggagcacgcaaacaaagcaacaacagcggccggccgcccccgccggtacagcacactgcgtccctgcgcggcaccagtgagatgggcgcgagcacgctgcacgcgttgcgctggatccgacggatttgactagtgcgggaagccgacgcgacgcgtctccgtcgtctgcgctcgtcgtgggtggcgtcccccactcgcaatcgcacccgcccgcccgtccgtccgatcgatcaaatcgatcgtctcgtaccggggccttttgacttgcggcacccgcacgcacgcttgcgcgcgtacgtacgtatacgtcacgtaccctctacggctgggtggcgttgagatcagatcaccggccaggttttaaattcctgtgcgtatcggcaaggggggcctggagccctggccccgggaaactactgcagagaggaacgcatacgcatttgaatgctcggatggaacggagctttaggcatgcacgttcagcttggctttcttgccctgtagcgtccccttacttttgcctttatgttttcgggcgccatttactgtttaatttttttcccgtctgatgagccatgctaaaatctttgcaccggtcacagactcagagtcacagtctcgtctcggtctcggtctcggtctggtaaaaaaaaagaggcccctccaacctggcgccactgcacgtgtggtgtgtc

SEQ ID NO: 672 - DNA, 1548 bp, Zea mays
  misc_feature (1)..(100): optimal_loci_6270_G1, chr1:32077389..32078936, Cluster 4
ctaagtcgcggtatttgtctgagaaagatggtttaagatcctgtttggtagggctcttcctctaccagtttcagccctggttctggctcctcttagaaaatagctccctccttatttttatgaagaactctagaaagagcaccctgtttggttggaaatatagtttctctcgcagcttctcctacgatgtagcgtcaatgaagagaaaagaaggaagaagagccgataaaggctcctctttatggctcctggctcgtaccgtttttttggagtcctctctcttttctagaaagagtttatgaaaaagtattctctttggtagaatttttcaagaagccgttgaaaaagctcttgaaggagccttactaaaggggcctaacaataagaatcctacgaaaggtcaaacgtacctcttaggactctaactttttatattaatgaatatataatcctttataaataacaagagaaaacatcctccgccattatcttctatctctttctatttgcgccaccgaaaggaaggaaccaaaaacattttcttatgtctcaattactgacgagaagatcttaggttcatacctaatatctataacaatgcttactcgacaggctggatcttgtcaagagtcggagtggaagctgctggtagagtcctacaactacaagcagacgaggagaaaagaaaagagcagagtaacaagggtcattgttgggcccttccaggtgtttgctgataatgaagcccatggaatatacatggaccgaagagcgtacaagaaaagaacacatattggacccgacccgacttctcaagaactgggaaggcccagacggttgccggcatgatcgggacaaagcacggcaaaccggacccccgcaacgtactaccgccgatccgccatccaccaggggcatccacggactgcgtgagcgtgagtgtgtgccattgcatatttgcatcctcgataggccgcgacacagcttaactctgcacagtcgtcgtcacacggccatgattcgtcattactctatttcgacaggtaacgcacgtcttgtacccattctcatttcgacacgtaacgtcttctacccggcccccctttcttaagcggttctcatgagtcaaatttgaccagggaacatcattcaatacttgagaccagccagtattgccgtgttgctgcagagaggttaatggcacgcacgcatgtaccgagctttcggtactggtccactatctcgtctagatcgtcgtcctccctccctgtacacggcactactaaaaaccagatgtgtcatgcttggaacgcgacgtgttctttccaaaccccttccccagaccccacgctaactcctttatttctatgtgccgtcggcccgtcgcgaacaaaggagtaaatcaatccggtacggtgaaaagtttgcaaaaaaaaaaagcgaaacaaaaccgtttcttgaatgtgtgaatactccacgaccgacgcgtcgcgttccgccgcgtgcgtgcctcggcgttggcggtcgttccccgcggaggcgattttg

SEQ ID NO: 673 - DNA, 1909 bp, Zea mays
  misc_feature (1)..(100): optimal_loci_6733_G1, chr1:34615198..34617106, Cluster 4
cagaagtgcaagccatgacatcaaaagttgtcttcttttcattaagcagtctgcaccttcgagaaatgtcggccttcagaggaacttgggaacgactacatcaatccttcggcgtgccgcttctaccatttcctataataaagggagatgtccagccgaccaaagcttaacttggagagtttcagggagttgaggcttgatctcatcaagaatgtactttacttctttagaatcctaaactaatgtgccaatgggggctgagagcaagtccatgatgcactggagctgaacaaagatgtcagtcagcccggatgattgattagtggtttccacgatggtcgagcccgccgaggcagggtcaaatgatagcaggtctaaaaaggttgtaccccttataaggaagacattagttaatgtcagaaaaggggggagacacatatgacttgaggaacatgatgtaccttttttgggattggattaacggtcggctcggggacaaccgattcatgcaagtcctgaaggacgattagggtgtcgatgatctcagctaagatatcaatagcttctaggggagagtgccattggaatgcatgttcctccccactggatgcttcaaggatgatggtctgggaagcatgtgaactgcagttaccaggaatgtgcgagcatcgaatatgggatacagaaagggtgcatacttgatgtgcattcagggcttcttggttaggggacgatgatcgtgcctctttgagaaccttcttggcaaccactttcctcaccttggtttggacccgaggggcaatagtttctaaagttcgtcctctcttaggagccggttttggagaatcaggttggtgttgtattatgagcttcttcatgggtggcacattcttacgggaaaataccatgggagtggtctcagagagttgagagggaaatccattatagtttagaggctcttctccttcctattgatttaaaaaggaacaagcagaatcaacagaaaatgaagatggaggatcttatgaaggtcgtcaagaacaatgcctccccatcaagggcctcgccataaacattgatttactgcaacaacgaccctaaagcccttcgaaaagcatgcgacttccacatttcccaccatgaactgaatctgtcagttgaaaaggtgaatgataggtcagtaggaatgggaatcttcaggtcgtcaaacaaggaatagtattggtgggcggtaatggagtcagaaaagtcagctctacattctatcaatagatgacgatgaaaatgaggagggacctatccaagactaaattgttgagcccctacaattggttggtaggactcataactagacttaatgatcctattagacgtactcatgccaaccgagaggaagccagggcggatcatgagagaatacaagtgtccagtatcactgtcatcagcaaagttgtctaggctgagggaagttgaactctcaaactctacagaatcaacacaagggaagaaaagagggcttttcaggcccttaaaaagattttgaaccaactagatgcatctctagggttcaacctgctgtcagggagactgtataaggcttgaccataaccggtacatcggatctgtctatcagactcatatggaatgacttgcagctaggactgggaatgtgggaatgcatcgttgacagtacagatgagcccactgttggataaaccaatatcctgagtttcttaccactaagcaagttggaagttaacagatggaggaatcgataaacttctcccaggaagagctttctagggccgataggattgcctccggctaagcgatgagccaaagagatataattcttggttggagcaagagaagggccacaaaacatgaaatgctcaagacagagattcaa

SEQ ID NO: 674 - DNA, 2123 bp, Zea mays
  misc_feature (1)..(100): optimal_loci_6805_G1, chr1:34949106..34951228, Cluster 4
tggctctgtccggcaggcgggcgtgcatctacaggcgtttgaactcagcactagaacaacacgatttcgtgcagggatcggagagatcgagagctgcgctgctaactccagtgaccagtgcccatcctcctagctatagctatagctgtaggtcttaaacctttcttgcttcaccgacaagctaaaggctccggcagtccggcgtgtccgcgtgtgtacgtgtacgtatcatctaccggttgtagcacaccagggtttacccgtttcatattcatttaccgcccacggccgccccaagaatgggaaactcaaactctggcgagaaaccgccgaatttcgtcaaatctcgaaataattgaaaatttaaattttaaaccaccagtttctcggtcgggaaactgctaattagcaccgagaaccagccttttgtcaccgagaaactgccttatgtcatggagaaaccattttttcggtaaatttcggtgtacatatttttcaaatttgaaaaaaaaagaatttcggtgagaagccgccgtgaaaccagtttttccgatgaaattcgctgtttttaccaaaaaaatgattggtttttaaaaaaaaccctaaatataagatatatatatatattactatattaagtactagttttaacggtcgtcccgtgttaataattttcaaaaaaaaactcttacatttctttagaatcaacccgcactactataatttcttttctattactataatagaatagttcatgtaaaaaaataagttgaaattatgtataagtgagtgtttaaaacttggttgttggtgccactttcacactcacctaatcaatataaaacatatattttgtgttttattaaaataaaatttatcatattatatatatatatatataaactgtagcaatgcacaagtatatgactagtatgtgtatatataagagtactcagaaaacatttagtattttataacgatttttctagtatttatattttttcaaatttatcaaaatatgaaccaatctttgggaaaattggtcgaaaaatccgacctggcccggccggaaacgagaaaccggcgataaaccttcccgacggttttgtaaaaccttgagctatcttcttctcaccatctatttgaaactctattgtataaatagtgtcatttaacattacgtgtctcctattttaccctatatctactagagacggtcttgcacacgcggtcagaactcagaaggcatccctttacgtttaggagatgggatcgaggagcagatcctgcggcagctagcgacacgtactgctattaccttaccgcaagctggatggctgtgcttgtgctcggctgcgctgactcgctgacttgtgacttgtgcgtgtggaagacggaactcggaaggatgaagcagccagcctgacgagttccatctctgcacggattcgccttcccccaacatcctgcacgcgcggatgcgccgatcgacacaggcaaagtcatcctcacatgtgtgggtgaccttgggctttggaagcagcaacgactacagacctgaatccgtgcgagccaccgccatcgctcttgaattttgtgtttaacctcagctgctcttgcgtcacccacccaccacatgtacgtgtaccggcatctttctttctttctttctttcacacagaattactgtacaacgctgcaggttcggttttaccggtacgcacgtacacgtgacgattagactatactccgggctgaaatgatgctatacgcgcggcttccaagcacatgttactgtactaaaatattactagacagcagggcgggcggttgaccccctcaccctcacgcgggccagttgttggtgtgcattggtaaccccgcattattaaggtgcaggcgtcgtggcacgctggtgtgtgtgtgggcttcggtagctgttgcacgcacgcggcgtggcaagatcggagatcgcgctgcggggggtaattttggctgtgataaacccgtttggtcggttgcgacttgcaggccggtactactgctagctactagtactagcaggccccagctaagatcccaactgtcatcgtcctggatcatcctcaattagaggatctgca

SEQ ID NO: 675 - DNA, 3060 bp, Zea mays
  misc_feature (1)..(100): optimal_loci_6925_G1, chr1:35758165..35761224, Cluster 4
ctgtttttgagtaaattcgtttggtcaatgctctggtttcttccctttcatttatgaattatcgttttcattgatcaactgcacaactaatggccgatagattctagtttattcacgattctgagatgaatgaacaaggatgctaccgggaaagcaagggttcggttatggtgttcatgggagaaaggtaaagatgttgattggctcgaagcctctagtaatccaggtgaatccggtaaatgataatgtattcttgggtctgatctttgtcaatgtctctactgtaaatttggataagtaagcgagatggaagtatgcaaactattttgacttttcgacaagcagactcttctcaagtagaatttttgtggtatttttctgaacatttggaccgatcactggcttttcgtatagcgtgaaggatcatttctttgctactggctccatttgtatagattgtaaggcattataattttttaaaagtcaaagcgtcggaagtgttgagtttatgatccaaattctaaagaaggcagattatgttggcgcggtatacgcaggaaaaatggtgtcatcacggacgagtttcgccacccgatccggcagcggatacgcgcatgctgcgttgcgtcggcgcccgcagcggtgaggcaggtcgccggtcgattttcgtggccgcgacagacgcgccggcccccgcgagccacggatgcccttggagagccgtggagggatcggatccgttccgttccggtgccggtgctgatggccctgacgtacggcggatcatgcactgtaggtagctgccggccggccccgtccggcgattagaggccatgctatcgcacaacttacggtgctcgagcagcagcaggatggcatgcatgttatcgcacaacttgtgtggtgtaacacacgagggcccagggcaggcagcctttatagttatcaaaataaagcataggtctacaggctacacagtacccctaccacacgtactaggcgtggccggtgctcagctcagctcagcacccggccgccagccgccgcacagctcagctcactagttcagtcaccgactcaccggtgcaaaaaaaaaaaaaaaaaaaacagaagatcgggcaaaaggctctgctaaaaaatctcagaagtttgtcttggtctcttggatacgtcatgcgttactggctacgtgcatggtgcatatccggggggttcttctttttgcgctagctgtgtcctcctgtggactcttgtgctagcactgctgcactaccagcagtctacagcaaaagaccaaggcgctgctgtaggtgggtggagcgagcacgggcgccgtcagcccggccggcgccgcgccctttttctgttttccagttccaggattgggttttggcctctaggccgggaggcgacatccagggccgggctctaccaagtaccaaccaaccagtcgaaaagctctgctgcgtccgcagcgcatcttgcgccaaacgattcgacggcaagagctatgctctatcgcctatcggtacgtgctgctgcctcagtactctctctctctttctctctcttttcggcagtggaggtacgtgtcgcgggacacgagagagagagacacctgagtcgagtgcattctcgtggacaagctagtttccgtgtcgctgaacggctgaagggatggatatatgggtgcttgctttttcacccgaaatcacaaggcgcgtaccgtccggcgctgagaaatccttccctcgttcactcgtttcctggaactcttgggatatgcatatgcatgcaagtagtatggaactagtagtgcggtggcttttaaaaagaacaggaggggggcgagctagcccctaccggaaaatgaatgatacgagctgcagcagacagtaaagaaaacaaggccatgggtttttttcgtggctcccgcgcctggcgcatctagaccagcagagagtgatccctcgctcgcccacggtcacggaactggcgggctaacgcgccccagagtagttcccaacacaaatagtgctatgtaaagtagacgaacagagacgcgcacttgactggagattttcaagggctcgccatatttctcccctgtgttaatgtgatggcgtggcgcgtcatgcatgaaataaactgcacgcggcaggggcctcgtcctctctctcctcgagcaggccagtctccggccggtggcggtctgtcgcagtggcgcctccccccgggcggggcctcgcgacctttttcagaccgaatcgattccttcacaagcatcgtgtcgaatccacccaatttaggcctccttcgtttacgtcaatttaactctggactaatatggattgaaattaaattcatatcataatccatatatccaaataatctaagtctacttaaattttttttgttaaacccatcatgaattatagcccaaggtttaggatttttttaaactatggaaaacatgaattctatccataactcattaggtatggaacaaatctatgaaaatattgcacagatttatattagaatccatggatcaaaagaaaaactaactttgagagatacatgaattaaattaataaatttaatcctataataggattgtgtgtgaggtatatggattcactcaaatccaaatttggattaaatccacgtttcctatgtttctatttttttcaaataaattgtgaaaaatgaaaataggtgagagtttatcctgtcaaattccataactccattcggactttgtttacgtaatctaatattcacctcctcaatctatatgtattgagatggattaagattgtaaattaatataatttatagtctaatccatttaatacacacggattgcagtgaatagcgcagtaccaaacaagacctcaaggggcaccggagtcaagtcactctgcccgcgagtcatcccgtgcggtgaaaggcagagcagcagagtgcgtaaccgcagcctgatgcgaggcttgcagaacaaacgaaatcgacggcacacgatcaaaaaatcggcttgcagtgcagcgcccagtactt

SEQ ID NO: 676 - DNA, 1677 bp, Zea mays
  misc_feature (1)..(100): optimal_loci_82622_G1, chr2:185222333..185224009, Cluster 4
acggatgattggatgtgtctagctaaaagaggttaatggttatagtgttagctgagtcgactattagctctattgcatttaaacaatatctaggcttgaaatcaaatcttgttgagggtggcatctcagatctttcttgcaaattaacaaaaagtatgggtaaatctgccgcaactttatacttgtgcctctacgtactgcttttgcgtgagacaagaccgtggcttctgttcgtcggtttgctactgcctctgtgcctcacgacctgttttgcacgctccccgttctcctccggtaacggcgatctaggaagggtgctgctgactgcctgctgagtgtcgatgccgatcagtttaggaagattagtactagtagtatgccgcaaatggcgatggcacaggctctgcatccattcagaaagagagatgcacgcacgggcacggtaatgtgggtggctataggaaggagtacgtggtctgtcagagaagaagaagaaggggggcagaaaggctatctgatcgctgatcccgcgcgaggacgcgaaaaagaatatctcctgccggccgtcgcctctttggctctttgcttagtggggggttggagacatggagtgtggtggtcagtggaggtggagcactggactctggaggccttaaaaaaacaaggactcagctatatgatgtggaccatcggtggtccgcgatgcccacggtcgtcattcagtgaagtccatgggtttctcccgtgccgtggtggcgtttgcgtgcaaggagcattccttttccacggtgtcgaaagcacgcctaacattcacctggaggagcaagcgtatacctacttgctcaagatttcggaatgggtttgccaaggagttgatccgtgcaagtgactgggagctgaagtgcagtttttcaccttgtaccgatgtcactgcatgcgagcggagaggatgggcccagaccgaaaaaaaaaaattggtaccgcgtgcgcatgccgccgccgccgttctagaacgagggggaggaaggaacaaggctcgacgtgtcgtcgttcgtccacgcctagagactcccccaaagtccaaagcctaccgcgcgctgcaagacactgccgtgcccctacgggtctacacgccgccggccgccccgcccggcgcccgcccatggattcgcacgcccgcgccacaccaaaactgggcgcgccgtgcgctccgcatccggatccgccccaactcctcgagcgaaccagaaggcacgccgggcatgggaacccgaaccctatagccgatcgagcgactgctctcctgttcccggaggtggccacggattggccggtataatagggcagctgactcatgagtcctgacgaatcagacgacgtacgtgtgccctgcctgaccggtggcctggtcgttggccgttcagcaccaaacttactcctccgaatcaatgccctcgcccgagtgagctcaggcaacgtcgatgacaccgaggttgtgtcaaccattgattcacgcttgcgcaggccggcgatgcaaacaattgaacaacgctccggtcgcagatttgacatatagaccaagtcttgcctctccaccgaaatagcgggagtcgatcacgaccgctgactcaatgtgtgaagcctataaggcatatgcaatccattttaacggtatta

SEQ ID NO: 677 - DNA, 2798 bp, Zea mays
  misc_feature (1)..(100): optimal_loci_82810_G1, chr2:186201452..186204249, Cluster 4
ggtcccttgcccccgttggccgacccttgtcctcggcgccaggacgggcgaggtcgcagccgggcatgcatgcgcgcgacctcggcggcggtgcccgcggggcgccagctggggctgtcgtgtggtctccggctccggctctccaccaggcgcaggcgggggccgccaatcatgaggacgagcaaaaaagccccggaggcagggccatcaccggccctctcgtatctgcgcgagatcgggtcggccaggtggaggctcccgagagttccagctgcggatgcatggggcctcctccatgcgcgacctggtgtggtggtgtgggtcgacgtcgtcgtcggggccagccaggtcgggcgggctagtttccagagggttctcaggctctcaactgcactgcacggttgcctccccgcgcgtccgttgacacacccggccccctgttccaggacgtgaaccgctcgcgacgtgcgagaacctattggcgcgcagctccgtcgtcggtggcgtgcacgcatgcatgcctcgcaaattgactaggaacaccgtacgtagtgtcgcgagcggcctgctagtagctggggctgcagccagtcgtcgtcggcgcctgcagtgacagctagcaactggtagtacctacaagatatgcgaatgccattgttggatggtatggtcgttttcacggcggcgagcacacacacaaacaagatgtgtccctttgttcaagaacacaccagtggcttccgctccactgttggcagagcagaccgactcgggtgagaagccatgcacaaactgcttcgagaaacacatggatttgtaacgttttgacggctttcgttctctatatgggcgatcgcgaaattgtgacgagtgacgagaacgatggcactagtacgtcctaccatctactccttatctatctgaaggtgctcttcccttgcattgcttttgcatgaccgcgcatactatgttcaggccaatgcgcgcgtatctgtttgttgtccacaccacggacgtgtacgttctggaactcttacgcaacttggagctgcagcatataatgctcacgcacgcatgcagacagtagtgttgcgcgatcatacttactagcttggacttggcgtggcgatatatgtttcgttttccgcggaattaattacaaggcgacagacatctgcagctgtgccctgtggtgcatcttgaagcagatgtatcccagcgtggttcttcggtttagcgagcgcgcgaacgtgtctcggccatcaccacacacacgataggatcaaggacagtttgcgcacacagttcgtgtcaaagataattttgtaaccaggggaaacatgtggaaaaaaacacaattttcttcccttgcatgtattaactgtttcgtccttttatgtatctatatactcagaatccaccctcttcttcttaagtcattgttcgtgtggaccaagttctactgtcttaaactacctatatacgtacctgagcttaaatggtcacctttgatagatgtgatgatcgttagttctgcttatgatattatctctcattgtcacgaacgtaacaagctgaataagctctactccgccccagccccagcatcgatgaagagacagtagaatatagatggatcaagatcactctcgatcggcccccaatgcaacttggcagctaatggtacagtaactactttctccggaaagctcagtgcacagcacctgagattcgaccgcggctcgcatggacacggctgtgagatgagatgagaattgagatgacgtgtgctgatcggcgtgcatggtcgacctcctcgacgtgactctttcaggccagccgttggcgcttagctggaagtgcctgcccatgcatgtcgcgtgcgcgtgccggccactgccatcctgggccagcgcaccagtgggtgttccaccaccagtcgctctcgctcccgatcaacgtcgccgtcgcgcggatccgctcggtcgcgattgaggtcgctccagaacagcccgtcgtgggtctcggtctctcgggatttattgcggcgtaagtgcgcgtgctggtggacgacgccgtgatcgccatggcaactgggtttcccgcgcgccgcggcgtcaggtcggacggacagatagccccgccccgcacgcgggtgcatacatgaacgaccgcgacaacaccagagaccagacagcgtcacatcggccgaggcccgaggcacgccccctcgtgtcatgctgacggccgaggcccgaggcgccgtcgccgagcggtcgatcgtccgccatctggggccccgatagcgcacacggcaggcacactatccgatccgcggtgcaacttgccgcgcccggccggaggggagtggccacggcgcggcgctacggtccaccgacccaggcacccagccgcgggggtcgcgtcaagctgcgtgacgtacggcagccctgggccccgtgtcggcgcatggaggaccgccggcgccggatgggcctcaccgtcgccgtccgcgtattcccgctgccgccggccggccgtccaggtcgcggcgcgggccatgtatgtatggctccatcgctccgaaatagcccttttcgcgcttgcaataggtgatagataacatgcactgtaacgaccgtgcaagctgccaatggcgtgaacgtgatgatggtgaccgaacagttccatgatcggcgatcagcatccggcgggcaccgacctctttgcaacttggtacggatcaaactgtgcgtgattgtccatgcaggcagagggacagggatagggatagggac

SEQ ID NO: 678 - DNA, 1508 bp, Zea mays
  misc_feature (1)..(100): optimal_loci_86108_G1, chr2:206624563..206626070, Cluster 4
tctgcgactgcggttcgggcgatggacatgaggatatcgatcccggctgtctcgcagctgtgcgcgctggcgaccgcctaccggccaccacgatacgatcgcgccgccgatctgtcaggctcgatggccgcggcgggtggccgctcgcgatctcgccacccgcgggtcccccgtgaagctcttcccggcgctacgagcctacgaccaccaaaccggcaaaacctcccttattaatatccgcgcgcccgggcccagctccgatggcggcagctctctcttccacgccgcgccaagtggaccagagggctaactaaaggcagcgagctcgcccgtgacgtgcgccgttcgtcgagttccgtttcgagcagggacacgacacgagacgccatggtgaagctgcagccgcgcggaggccggcgatgcgtgcgctgcgtgcgtgctccttttccctcataaagagcaaccgccccggtgcacggcgggaaccagaagcggccagaacggcacggtcgcatcacgggcactgcattgcgcgtaccgccggaacgtaacagcgccgcccatcacgtaccatcaccccacccgtgcgccgcatccccgtctccggtccggcgagtcgctggaaacggacgggaagttcggtaagcagcaggagtacgtgacaggatttagcatgtggcgtatgccaactgccaaaactcgcaccggacgtttgcaaaagtcaagtagcttgacaaacgagctacggccgctcgccacggaagctgtgcgacgagactgacgactgacaagatatactagctagctagctagctaggccacgagtagctgcatttcacattgatgccggtttccgtagcgcatccggttgagaaattgattccgggaaaaaaatatgcacagaacatcacctcttgttgatgaaccacacactccattaattgtgatttttttttaaaaaaaacacctggactccaaatattttgaatccactcctggtgtccgtaaccaaacaacggcccctagtgggcgagcgtcttcctactctcaatctagcggcaaacactccttcccctacaatgttgtcccctacccttccctgcacgccacgggtgaccgtctctctcccctcatatttgagggaccgctatattcagccgtcactgtgcgtcgtcctctccatcaccacgcctctgaggccgagcactatgcgtcatcttccccaccggtcggttccgacgcccggcactaggagtctttctcgtcgccgctcgcctccggtgcccagtgctgcacgtcgacctatccacgactcgccaccgacgtcgaacatttggagtcgcccaccgtgtcggtctcctccgacatccagttatgcgcgtcgtactccccgtcgctcccgtccgatgtcgacgagttcttgttcttccgactcgtgcaggaagctcccaaccaatctttttaagcatgttccttgttccatatatagttttgattgtagcaataca

SEQ ID NO: 679 - DNA, 1781 bp, Zea mays
  misc_feature (1)..(100): optimal_loci_86770_G1, chr2:209647459..209649239, Cluster 4
ttccagctaatttatttaatttagataaattagacaagtgttgtgtaatttagatacattcaccaagacacaattgaaaaattaaaaaaaatctattatacgctagaaggagggcttgaacctccgaccttgtggttaacagccacacgctctaaccaactgagctattccagctaatttatttaatttagatacattatacaagtgttgtgtaatttagatacattcacagattcaccaagacaaaattgttttttttaaaaaaaatcatacgctagaaggagactaaattgtaatttagatacatcagacgactgttctgatcaaggatgcaaatgcacccaggtgaccaggtataatggaagaggtcagataagctttctatgacgattcactccgtattattagagaaatggagtgattttacaggaacttcacatagattagttcatttttacaacaaacaaaaacaaaataatgttacattctagatgtccgaggccgcacaggagcttctagagctcatatgcacggccaattgtccgtggagctgcacccgtcatttgtgcttcaagaccctcattcctaggctggctggggtaccattgtatttcgggaagctccgtcgtcgtaaccatcgttgccgcaatctccaccacccaaagatggcttctcgttcgtagctaactgcgccgtcaccagcgacaaagaacacgcgacctaactccgaacctgtaccagaactcgcacgtcgtcggatcttgggagcatcacggcagaaagcgacgacgcggttccgtgccacggtcgaagaagggttccgcgcggaaggatgaaccagacagcctgtgttgccgcaggaagctaggatgagtcatgagtggctggttttcaacaacgtcggcggaggaggacgctggtatcgcgcggcggatggaacggaacgagcgcgcgcacacaccgacacacgcgacagcctgcctaacgcgcaaccgaagacaaaaaggtgacacgacggcgcctgagaagaagagcctgtgccgggcggggcgctgcgatggcatggcagtggcaccggccctcgcgcgcgcacgcacgcatacgtacgccgccactggccagaagaaccagtgactcacgcggccaaggccggcccaacccactagcgcggcgggtggcgtggcgtcgcgcgtgcagcggcacgccggcacgttgacggctgcggggcccgtgccaaccgacggcaaacgggggatccctcccctttttcctccccgccgccccggtggtccccggcctcggcgcgcggcacgggttgctttcggaattccgaacccccgctgcggaaagcaactcgcgtcccgccgagcgcggggagaccgcgggatcgggcgcggacggcagggatgcgcgggtggggaggagcccgggcggtttgcgggcgggccggcgggcgcggtgtggccttttcgccttccacaccgccttttcgcgaaattgcacgcggccgcgccgcgcccccgagcgtttccagagcgacgttttgcgtccaaagcgtccgccgagggacaggcccaggctgagctcgatctcgtcggacttcccgccggcccctgcggcggcggcgccatccgcagtcggttgccctcctccatcccggcaaaaccctcccaggaagtacctcgaagccatccatggctttgcaccgggcacagcttgatcttcccacgaattcggtgtcctgtgctccaaatctcacgtctgaaaacgagactagaggg

SEQ ID NO: 680 - DNA, 1586 bp, Zea mays
  misc_feature (1)..(100): optimal_loci_87183_G1, chr2:211486011..211487596, Cluster 4
tccgcttcgcttgccaacacggtctcttatccaaaatttggatcaccagttcaacaataattacacacagtctggtcagatgaaattgatggttattcagctaaatatgactcggagctaacagaactgagacaacctgcacataacaaaaccatatccttggagagtgatgttaccaccatccaagcacggtacctaccaaaaaaaagatgagcaagcaggagagttattatttcagttcactgttagggaaaagggtaaggagtggtagatggatcattattgccaattttgattccaggatcaggatgtggccagcactgagtttccgacatcacacctgggactgggaggcaggcactgacctctgaacctgctgccttccacagctcctccactcatctttctaccgtccttgattgcagtccttccttcttcaattcactcatgtagccatgtatgaggttttttctcttgaattcagtgggacaaccgttatgtttaccttagcccttagttctgctgctagctgatttctgaagttttcgttgtgtatcttaggtgtgcaagagaagagctgtttcagcaacattggtatggcgggttgaggccatcttcagctgatccttcgtcccatccactatctcatcctctgttttaaaatttcaatctgtaaacaatgttatctacaatttcatgtttcctattttactgtgtccactgaagatagtatgagagtttagggttcaattcagctgctttgacagttgacaggcctgtgcttggcaggcgcgaagctgatatcagaaacaagtacagtgcttgctatctttgttgaaacctcctaaagttcagtgaaattatgtcctttacaaaaccacctgaaggttaaattttttctgctactccgtccgttccaaaattttctaagctacgtacctaggtatacattttgtctagatatacagtaaaaacagtgtaggtataaaagatgagtggtccggcatccacagtactggactgggcaaagcatagagggatgcatggacgcatcaacatggggctgtactgacactggatactgaaagcctgtccgtatgacacatgttggtatagggaccggtggtggcctacgcactggcaactttctcatgtgaggctgtgatccttgaattgcatgcgtcgccgtacttggctactgtggctttggatcactgtacggtccagtccaccatgccgtgacgggccatcttgctgacacttactagacggctagcagtgtgcgttgatgctgtgttgttttgctgaatttgtgcgtgcaggacgtggagtggctcaagccggccatcacctgcctgcgcgcggatcctgctcaaagggcatcgtcaccgccgatgccgataatgaactctaatgaccggcggccgcggcggtgggcagcgcggaaggtcgtggaggcgggggcgtccggcgtgatcgtgttcaaccacggcgtcctgcgcgcagtcagcggtggtggccaccgtaccagctcggccctcggcgaacaagtaactggctgccgcccggccgaccgcatttatcct

SEQ ID NO: 681 - DNA, 2852 bp, Zea mays
  misc_feature (1)..(100): optimal_loci_87190_G1, chr2:211507068..211509919, Cluster 4
tcgttttatacttattaaccatgtccatttatttatttataaactaattagagatatgccatctacccaagtgcaatgtcatatgccaaaaatatcgttttatacttatgtcttaaatggccattttccttgcaacataatatttgaattaggccattgattaagcaggctctgccttggccaaattatctgttcgaggctcctcggtgaagcaggactgcaggagggccagctcggctaaacacccggcaggtagaaattcacatgaccacgcgagcctctctaggatgctggcaaaagcaatgcaagctgcaaaagaagagctccgcgcgttatccatgcacatgacacatggagcatggtccagcatccacgggacagccgcagacaaggacaatctaatctgtgcgtgcaaggctgaccggaacaggcggccggcctcggggaaggagaaaaaagcaaaagcgacgagttctgctcggccgtgtccgtgtccttgtgtgtatcagcaaaagtcgccggccctgacgacaccgccgccgctcctcctcctcctcctccttccgtcctttttcacactcgcatctcaagagagcttttgtagctactagcttccgctaggtcgtcagtcatggcgcccgtgcatacatcgtccacgacaatggcggatgagcatcgctcgccgccgccggcagcagcgacccgtccactccaccccggctgtactcccctcactcgacgatgtcgcgcggaggagagatagctttcttttttttctcgccagggtctctagctcgtatcgtacggcgctgctcgccttgccaatgtcgacaagggcgccgatacacgcaacgcaaaagctagctaggagctacttactgcatgcacctgtggtaggcgaggtctgtggtgtggagaaactactaaagcgcttttaatttctagctagccggccggtgccatgattgtggcttctactctgcacatgacagaaccgcatatataattacggtagttagcgcaaatgacaaaagcgcagccgcctatacgcactactcgctcttaattatgcattggaaacctctgcaactttatcaaaggcactgcagcaggtagtcgaaagtagaaactacgtacaaactagagagcgtgttcgtcaggcgctggagacgaaagtttggacagcgtggtcgttagggttataattgcgctcgctcggctggcctcaaaaggcttaaccgtccacgtacgtgtgcgcagcatgagcatgtcgcctgctgcgtcgtcccgctggctcatgcgcgcaactgacacgtccctgcagcggtaacacacctgcagcttcagcgctccgccctctcaaaaggcgcgtgtttttttgcgctgttattgttcgtattagaggagcagtgctgaagctgctgtggttcctgagagtgtgttgtgtgatgagtgagcccagcacggggtaataaaggacctcagcttgctttggttttggcttttgcatctacactacactgcctaggagggagaggaagaagaggccggattccgtcctttgtctcgcgtgtgacgccagctatacgtcgcgtgcgcccatctcgttttggttgatatcatccgttttggttgaattttttattttatatgtagaactatatttatttatttatttatttatttctcgattggaaagtcagagttgtggccgttgggtttttttttttaaaaaaaaaggaggggcaggtgtttgtttggtttcacctgttttatcttggctccgagctgaatatatatgtgtgtgttgtgcttgtgcctactctctccaacgtttgtatagtgaacgtcgtacgggcagcagcatctttcttggttcccggcaagttttggaacgacatcctgctggcggttcgctgttgcatttgcatgcacatgacgcctgcctgattatcattttgcacttcgcgcgggtttccaggccaagcttgtcgttggagaacgggagtaattctgccttggtgttactgttttgtttgtcttttgcaactggtttcagtgtgaagaagaagaagaaaaaaaaaattaaaaaaaaagaatcttggaagtcgttggtgtcgaagagaaacaagacaagacgactgctctggactctggaggccatttctgtataatacacaaatatatactaaaaggaagatgctttcaagtgctaacagattttatttatcatcgaaaggaaggaagaaagaaagaaagaaagatactccagtccagtggattacagtgacgaatggcaggcaccctgcagtgctggctgcaaacagtagttgttactgctgcgccagcggcctgtggcagactggcagtggaggtccgtccaagcgtggcatgattatggcgttgaaaactttagccagggggcccagggcatcagaatctgagacgtgccgtcgtctgcgtgccctgctagacagacgcgcggtgtgcgctactgcgctccgactccgacgcacagtcaaagtggcaggagcccaggagagtggagcgatccacagtccacacacgcgcagggcgcaggcgccgcagcggcatggcattgcattggcaggggcagcggcgcagcgctcttcgcctgccgtcgccgcctctgaatccgaaccatacgaacgcatcggatgctgcgggtccaccactccaccccagcccccgcccgcaagccgcagcctaatcggagtgccggtgcgagggcaggcctgacctgagtgagcttcaccggctcgcgtcgcactcagatcatatccaaccattcactccacatatattttactatgtcgctctaaaagatattc

SEQ ID NO: 682 - DNA, 2166 bp, Zea mays
  misc_feature (1)..(100): optimal_loci_87547_G1, chr2:213808116..213810281, Cluster 4
cgcaggaccaaagcaagctagtgtcctgattacgtgattttgtggatgcttttggtcaagtgtttactgcgacaatattctaagagtcgtgacaaacaatcgacattttcgagaaaagtgccatcggagcccccttcccatgttcatcagcgaaattctaaaattcgatggaccaaatttcgtaagaatagtacttagagtggttagttcaaaaagaaatgaaaaaaagcgaaattaaacgtttgagctaggaatgggccttactggcggcggcgtgggctatcgatcggcctcagcagtatactggaccggcccgtgagagcagctcattccgcccggcccacatagagaacccgtccgtccatccattatctggcccatccggacatgctgctatacacgcatgcgtgatccatgccatgacatccatctccttccatcggcggcacaagttcgttttcagcagctgttactgttatgctccagtgacggcgtgagctaactaatctaaactcgagctgagcaactaacgagtggtccatcgcacatcgaccggttgagacgattaggttaggcgggccccgggcggtgagtgtcactcgcagagtcacatgccccgcgcatccggtccatccacatcaaataatgccggtggttggctggaatacttgcgagctcggctcatcattgcgttggactaggtagaagaagaaggcacgaggagctcgccttcttacaagcacgacaaagcaacctgctagtcttagttcagtgttagttcagagcttttctacaagtgttactactcactctttctatttcaagaagatacaccagccgttcaattggctttaattagtatcggcctcctgaagtgttatgtttcaatgaattacagctgcagtttcaaatagctaattttaatcaaagcgagcatacgacgaccatacagctgatacacactttaattatttcattttattttactttggacagagttgatacacaccaaagcgactggcaggccatggcggtacaagacgagtcaagaggagctgttgttgctgcttcaatttatgcttcggaggaagctaaaaatgtcaggggccgccccagcattaggaggtggcaggcacacaagaccagggatcgcggccgttcggctaaccgggctagctgggcggacggcttcaccgtatcgacagttttggattttgaatttggtaaatttgtaaattttgaaaacgattgatgtcagttttgtataaatactatgaattatttgaagactttctgctaaaaccaaatttcaaaatacacaatgaattttaaacataaaagttttgaaaaaaaataaaaaaaactgatatatcggctaggattactgattagccgctcctcaaagcccataaattgatgtgtatgcctgataaatataaaagtattaaatagtaatactaagatctaacaaaaaatattggttcttaaagccattgtcatcaacctaactcaaacaaatgttaatagatttaacaaaaattggtatgaaagtttgctacgatgttaatagatttaacactaactcgaacaaatttacatatatagaggtctatcaagtatcaacaatgcatatgttaaaggtggaggatgtattgtatcttcagtgttatttgtgaactataaaagtgagacatgtattatatttgaatcatgaaatcgtgtcgtgtgatgcatttgaaccatcaattaaatgtgttattgaacttgttataactatttgaagactttttgatgaaaccaagtttcaaaatacgtaatagatttcaaactaaaaatagttgaagtgtatgactaataaatcgatgtatataactgatctgtcggtggtcgaataggagctagggttaaggggatttttttgtcttttacttgaaatctttttaagttaccacaactaaatgttgttattgaatgtgtgacaacatttgggacattttttgttcaattgttgagacctaaacatgtttttatttgccaaaaacacgagatttgattttaccttatgtgttgttgatttatgagttctggaatcgataaatcagtcatatcgggcgataaattgatgtcaaaccgagtagattaaaaaatggtttaaatttggatttg

SEQ ID NO: 683 - DNA, 1809 bp, Zea mays
  misc_feature (1)..(100): optimal_loci_87703_G1, chr2:214853693..214855501, Cluster 4
ctttgaggaactgctggttgacgtggcgtcagactgtcagcgagcgatcgatctttccttcttcctttcaaggtaggacctcgttggaatccagagaacacaaccgtccgccaccggggaggctgcctgctgccgaccggcttctatccacggacgcaccagcaccacctagcaccgtccgccaccggccaccggggcagggtgggcggccggccggccggcctagtcgtagttgatgccatgtcattctcgccaccagccggtccatcacgacgacgacgacggcgactcgggcgtgtgtcagtccagctggtgccacgcacggcatggtacagtgtcatgtcatgcatgaccaggttcgttagttggttgggttcatgattagttaatgaatttaattaatccagcgtactgtagtgcgtcctaactaataaccgcgcgcgatcgttccggattagatgatgcgtcgtgcgtggttgtgtggaggcagagcagcttcggattaggtgctttaagacatggatctggacataaaactgccacggattattcagtaaccaagcatgactcacacaaacaagcaactaaaactgtcacctacgaccgactagtagtgacccaacaaggagattacaccgctcaagttcgtacaacttggacgaggtgcatgccatgccagcttattattggcagcatatatatgacacgtatgtacgcgatgagcggagagcatacggcagcggtctgcgcacgcaacgcaacggcgcggcagcagctagcgacgcgccaactgacaccgccgcgcgcggcccgatcaagctcgccgtggccgtggtcgctgcttccctcctgcgccgagctgagctcgcatggttgcctgggctgggctgcgcccgtccgtcacacgcttcgtctcgaagcaagcttcggtctctttcaccttcagaaaaaaaaaatggacaaaagaataggaaaagcaataatgtttgtatgtgtgtatgtatataagcctggtcgtctcgtctctatcaccttcgtcgtcgtcagatataacaaaaaataaaacccacaaagaaatgaacaaaaaagaggtgacaatgcaggtgaatagcccagtcactttcacccccatcatgagaaaaaaaaagaatccacacatgaaaagaaaatagaaaagtattggcgcaggtaatacgcctcgtctctttcatgttaagaaagaagagagagagagagagagagcttgctggtcatcactttctgccctgctgccttagcttggtggcctaacaaaggtactcctcctctgacctctcctactacggccagaagcaataaccaaccgctcttaggttaggtgaactcctgcctcgcatcacaggccggttcggttagttaaaaaaaccggttcatcacgtcacttttgcttaactctttatatatcaccctttcacaatcctatagactccactaactctcagttgaactctgcttgttttggtgacatcatcgtttttgttttgcgcgcgtgtgtggaggtgcaacccgtgcatgtaggggtgctcacggatccaaatatttattcgtaataagttagggattttaattattttatacaagaaacaacatcatgttttgtatatgtataactcactagcagttcatatactagtgctagcgacaaaataaatatacacataaacatccttacagtggggctgtcggcgctagaacagagcggtcgcgacgatatcggcgtagaggaagcagacgaacagagagcgcttataacgacacttcccaaaaacc

SEQ ID NO: 684 - DNA, 4319 bp, Zea mays
  misc_feature (1)..(100): optimal_loci_9222_G1, chr1:48546539..48550857, Cluster 4
atatatgcacgagtagctagaacaatgaactcgccatgaatatgatcgatagcctttttctccccctttttgttgtgctgcgagccaacgcgcggtccgatcgacggtggccttgccttgccgactccatggctacgtagtacagtaaatcgtagcgatgctccagagaatgcatgtctcctgcccgtgccaccgaccggcggcggtgcgcaggtgcgaggtgcctgcactgcctcgaaggcagcgggaataagtaaggggatggtttggaaagccacgccgcggcgacgcgaagaccgaacgcgcggggggctccccgtgcgtgcatgtcgttgacatgcatgcagcatgcgcgcgcggcctcacgacctgcatgctccattgctcctgctgctgctcctcattcccccaaagaaaaccgcaccaaaacccgacgcggagtcgcgcgtggcgagtcgtaaactagtgctactagtacagtagtacgtgtacgtcctgctgctcctcgccagctccgctgtctgcactgagccttgttcgccggagagtgaggggggaaaggcgtcgtagtactcgcctatacatatatagcttctagctgcgtctgcatgcaactgtgcaaagtgccgcgggtagcagagctatgcgcgagactgcgagtacgtgcccgttccgcttcatcacccgccggatccggcaaggccatgtgaaaatcgtgagggagtggtggcccgcccgtgatccggccggcagcggatctgtcacggtgtgtcgtgcacggcaggggtacctgccctgccctgcccccctggcagcagctagcagcggccagccagaaaccccgacctctgccccctggagccgcagcttccttcctaaccaaaacgttgtgatatcggtgatcaagagctagagctaaactagctgcttgcggccgccatgcatgctggaccagtagattagacgtacgtacgaacttgccgatcgatagccgtgtcgtccgtccaatccccgatgagacgagacgagacgagattactagaactaactggttccacaaaaccgagacgcctagctacagtagatgagcaagccgtcgccagttgcagttgggcgttggatggagcccacccacggccgcagccgcaccatgcgcgcctgcctgctgatgccatgccatgtgccgatgggcgcgcccaactggccggccgggtatatatgccctcgacatggcattttcgaaccaaacaaaaatcacattccacaagaaacgttagcgctgctgtttttcttgaccggtccagacaatatggaggcgttcccatcgggtcaaccgatggcgcgcgggcaggccgcctgacagtgacagctaatttcaccccctgcttcctgcttgtttatgtcattatcgcgcaatcatcatcatccgtccatgcatcttgacacggccgaccagtagcagcacgtcgtgtcagactcggaacgccctccgcctagctgtagcctgcaacgaccgcgcgcgcgcgtgctggtacgtacgtacgtacgtgtatctactgaactagtggtagtataaaaaccggcggagcgagatgatccacgtacgccatgcatgtgatttttttttctctcctttttgccggtcattgaagcaagttgcgatggcagcaaaggaacatctcacgtcgcgcatgcatgcatatatgcaggaagcagaaacggaatggatcgagcgccgagcgttccgtgatcgtgactcacgggcaaagtggccgctgcgtgcgtgatccgatccgatccggccggcgatggcgtacccgtcccggaaagcggaagtaaaagctgagatttcgtctgatcatcggccgcgctttagtttaaccccgggcggaggagcccgggtgtgtggccggtgcgtccgacctgtactgtacgttacgtattccaccgcggaaccacacaaacgtacggacccaaacaaaagcggcagatcaagcacacacatgcgtcccgtcccgtccaaaggactagtatagtgccgcgttttgtttagttcattttcacttctaagacctcctttggattaaacagagaccacgctccctcagttctaaaataactatcgctatcactatgataatcatcaaacaagattgaattgcattatattttatataaaacattggaaatgtttttgttcctaaatataaatttgtaataaaagtagttttaaggatcatactaattatatactatagttattcaagttttattgcatatatttgatcaaattcaaaagagctatttggcatctgatcgagaaggattcgtatgacaaaaggagtactcttttgtgtacacgtaaaagttacgccggccgagctaatcatgtctctcctcccaatccgctagcttgtggtgggttaaccacgcccctcctcctaaacaatgattcaaaaacgctgctcccgaaggaaaccggcgagcgaggtcacgatcgccggctctcgctcgtgggtcagctcacgtggcccgcacatggtaggtctggtctgggttcgtcgcgctcggaacgaaccgtcagtcttatcacctccgcctccaatggcgatccgcagctcccaaatcgccattaaaaaaaatggtgcccgcttcacgaaccccgtgccgtgcgtcaccatgacctttactaccacggcggcaagcgacctgccggcctttccgtaccgtccaattcagcgagagccgtcctgcgatgcggccgacagccaatcgcctagcgttatacggcgcaggcgctaccggccagcgcgtcgcgtaaaacctgatgcagtcacagtcacaggttaacaactgctccagtgcacgtacgcatcatatcacctcgttactttaaagtcagtctagtctagggtgcgcttggttccgcctctcaaacctaagcagaagcaaagggggcgtatcaaaactttttttttaatgaaaaagcatctctcttttttttcctactacaaacatggaaacaggtttcttcttgcttttctccttttccatcctctcaacaattacccactgcctctggttataaaacatatctcttcggtttttccttttctctctctctttcctaacgaactaaaaggtgacaatggctaaatctccaccgattagatacccacaaatatagaacatttattaaaataacacattacataaatgtggcccgaagtagtgttgattgacaaagatccaaagtcaaatctttacaaactattgcataaagctccagagtcaaactaaaaatttcttgcactgaagagagagtggtccccatggattataaataatgccaggcttctacaaaaatggtgtattaatttttttgcatataaaaagtctatcagactctttaaaccaaacaactcttaactatttttttaacaatatatagtttacattaaattttgcagcaaatttcccacggcacaggactcacaacaacttttccatagctcacaccaaaacaaagcacccttagtacaggacctatgtcatgcactaaattttaattacctataaactttagttctataagtaatacatgcacataggtaaaataaaaattaaactgttttttaaattttagctaaagtagcagtagaaactaatcctttagttttggcaaatataagctaatatgattattgtgcacatgagtctttatttataagaacaaacttggttcatgtatcgaacaatattggactagacttcagtcacatctactttagttaacaaactttttatcctcataaactttaattcgacctagaaacaaaaccctaagagtatgtttagttttgagactcctcacggatgggttaacttcattcctgttttttctctagatggagtgaacacatttctgatatggatgtgtgggttaggtccattcctactttgtgtttagtttggaggtttcgttgtagggtaggaaaactatagtcggtcatccgagaagtggacacacgaagagtcatgagatatgctattgatataatcatctctccaaacagtgcgctcaagtctgacgaccatcgaggtgtgccttgggacgacgatcgatggttggagcgggactcgcagccgacacatgccaagaggcgcacgatgaaagagaaacatcagtggccgcagaacaggtacacaaagggggcgtttggttacttgtatggtcaatcctggctcgtatctggtaagaccgactctggttggcctggctaagtgcatacaatgctctgtggttgtctgatcacgag

SEQ ID NO: 685 - DNA, 1907 bp, Zea mays
  misc_feature (1)..(100): optimal_loci_9657_G1, chr1:51298211..51300117, Cluster 4
caatggagctcaaaggctatacgggaatatcattgccttaggcctcgctttcctttgtggaaggcaccaaccaccaagcgctgtccagacgagaattcaggcaaaaatctggtgaaaagaatggagaggggaacagaaaggaagggactacaaacgcgacaaagccaaaaagccggggctccgctccattgaagcgtaaccagcggtgccactgagtgtagacacacgtgctagctatggtcaaaccgtcaaggtagctagtgcaaaagaggttttccatagtcaccatgtgaagaaactaggatggaatgcatgctacccatgttcttcatcttcatcatcaaagtcgctaatgtttcgataaatggatcgcttcaggaatgttaagatgtgaatataaatctcaagcgcatacttcctctctggaagagtacacgcatggtgatttacattggttgatcgacagaaagagtgggtatatcttaatagacaatcagaatggatctaatatgtgagtatatatgttgcagaactcgcccaaaagtacagatatttcaaataaaaggcatgtagagagcaagaatatatataaatgactaatcgatcttccttaaaaggcacacgcatggttttaaatgatgacaggctagctttatcatgcaagcatcatcagtttgtgcatctggtttattatattgctaagatggattgatggtgtactagcttctatatatcaatcaataagacgcctccctaattaatatttgtatttccccttgtacaattccaactgttcacaaatgcctttgagatagacgtttacttacgaggcgcccatcacttccatctgtcccctccagtgcaaaagagagagacagaaaaaaaaactatccattgtcacaattggacaactgcttcacagttcatacacgagggggtatagttttgttcttaaatgctttccctctgtatctctccagtctccacagaatgcagcatttgtgctcaacgaccccgtctcacggcggtcatgcgtgcatgcatgcttgcaaagttaattttcagctcagaagttagtggtgagtggacaaaatggattcaattccaaatagtgaagcgaaacggccactgtgcacgccagcaatagatgtgcaggaagggaggaatccatgccatgtccaggaacagtagcagcaacacaagcaccgaaaaacaaaacagcattaccattgcccaacaggggtgcctaagctcagaacagcacagcgcattgattgatgcagcatgcaagactgtgctgcgtgttactgctgcagcaacccgactagtcgaaatctaatgcgcgcatgcatatggatgcaagcggttcccgagttaatggctgcatatctctttgcatcttccttgaaaaagggaactttacttgccacagcagttttttccccagaggatgggttgtagtagccttctcttggcagtagaaatcaatagggtaggtacacactacacggcgtgcgttgcttagacaggaatggaatacaagttatcattttttttcaattacaggccgtgtatttaattaaggagaagatagcaccgaaaaacaacttatataagtttatctccaccaacttactcataccattcctagttctcaacctttcatcacacatatttcaaacttcacactgcaaaatgatgttttgtacggctatatacacggtccattgatcatagcctaacatctgaaaaatgtagttatgagatatcttatagccatggaggaagtggttagaaacctgacaacaacgacgacataacacaaaaaatgtattaagggaggccctccaccataaatcttgatggctagatttgcatggaaataaaaatccacacaaaggatgcta

SEQ ID NO: 686 - DNA, 1626 bp, Zea mays
  misc_feature (1)..(100): optimal_loci_98167_G1, chr3:32462224..32463849, Cluster 4
acaaacttagggtgagtgtgttttagctgtgagctatgcaaaaagttgctgcgaaaaaactagtgtgaaataaattgaaagttgtttggttcaaactaatgcgagttgtccactgtaaacaaacttcatattttattttttatatgtactttgtttaactatatctcttaatcaatatatatctaatttaaaaaatgattttatatttgtgttcctaatatttattgataaataaataaatcaattttacaattccatgttaatatttttattaaaatattttaatttcattttttatagcacttaattattttctaatcctattacaatttacatttgccgtatttgtttattaatataacaaatttagataagtagcaaaagcagggttcaagctactttcaactttatactatagaaaaactgtatttttaaaagagctgcagtgaactcctttggctcagcttctgattttttaaagccaaaataggtttgaaaagctgaaccaaatacataacaaacttgcgttgagcccaccgaagatgctgctgcaaaaaaactatagtgttgccgagataaaggcagaaagcactgctgtgcccccacaaattttgtagaggaaatctgcctttccgacgcaagtggaagaagattttccctaacacgtgcaactgcattatctcgtcactttggagggtagcagatcgagagaggtcgcgcacactagatcctagatcctactaccatcttgctgtatgcaggtgtagaagaagtaatagtggatcgtcgctgatgagagcaagaagagacctgaggaggccctgcggcgagcgagagcgatcaacatcggtcaggtcaaatctgaattccttttaacttttagatttggacttgttgggaaacaatcaaaccgtccccctcgccgctccttctctctttcggctttgacttggacatctcacttgcactgtccggacgaacatgcggtagccggaagcctttagctagtcatcatatcatatcatcgttgggtctgaactctgaagaacgcatgaactctgaagaacgcatggaaaaagcttcttcttttcggcgtgttcatttggatgaagaaggagaagaagaaaattaattagaaaggacggaatcacagtcacgccggaaagtgcaaataaagcgcgcggaggcggcatcatctccgatcggttcatcaccaagatggagatccaatcataccggccggtggtgcatgcatgtctcttggtccaagagtagagacagccttggcgaccaaagaggctggggctggggcttgcattgcggtggttaggaagcagcagtaggtgaaacgaaaccatcctgttagagagctgccgttttggctttgtgcgagtggctttgtggtagtggcgcgtactgttgaggtgtcctgctccttcctcctcttcctacgggctatctcactcatcctcatcttacaattcaaactctactgtatatgtctacagtacaaaacagtttttatatggctacggcatgcacaatctgctattcatagcctaattcatgttccctcactagtctcatgcacgccccagctatgtgtttggtttgaggtcaaaggag

SEQ ID NO: 687 - DNA, 1250 bp, Zea mays
  misc_feature (1)..(100): optimal_loci_178978_G1, chr5:35776311..35777560, Cluster 5
aaaaaaaaatactgatcggcccctgagactgagactgggagtctgggagcaacggccgccggcgatccaacagcgagattggcgccgacacggctggcagatgctcgttggaaacatgcgtgagacgagacgcttcggccttggattggatcacagtcagggagagacgcgtgaactccgagacaggaaataggagtactactaccccctcgttatttttcgtgcttgtccgccggcagtaggcaggcaggcccatggctggggatctgcgccgtcggcatcccgccgtgatctgatctcccgcccgatgggtgactgatcggagggcaggcaggtcgagcatcctcggtgcaagggaaagaaggaaacgtcaggcccttctgaattctgatcgatcgatactcctcgatcccttttgctttctcggctgtccgtcttctcgagatcgaggccagatcgtactcctccgtcgacaaaaacagaaccggggtggcgtgtccaattttctcacgggaaagagaaagctgcgtgcccagttcagccccactgttcacgtcgccagttttgtttcttccattccattcccgtagtccgagcctcgcgtggcttcttttggcgtcattttttattttcaagcgttaaacgcgccatgtccagtacggcagtaccccgttgaacactgatctagagtctgatgtcactgagcgtgggcggcaggcacagcagagcgccgcttttgctctgctcgatcgatcaacaaacagctcaactcactacttctctcctctcctctcctcagcatgcctactcgtcgtcgtaggatcggagtagtgccaaaagggtccatgatgattggcattgttggcctggcatcatttcccttggatcgcaagtcgccggctgtcacggcagagcatggcaagctccatgctgatcccggtcatgatgctgtttcgtgccaggagcagacagtacgtgcttagctttctttgcttcccttctccgctttggcgatacggtgatgctctacttgctactgagcttagcgcggtgctcatgtagcgctgtatagcagcatggataatggaactttgctcacatttttaaccttctatccagaaaaaaatatttacatttatacttattgatgtctcacactcatctttggattctagggatctgcgttgtaacctatgacaacaaggtaataacagtcggacggcgtggagcctggtcaaaactcggcaccg

SEQ ID NO: 688 - DNA, 1387 bp, Zea mays
  misc_feature (1)..(100): optimal_loci_101091_G1, chr3:49546008..49547394, Cluster 5
atcggttgcatttggaccgatgaggacttggagcagaaggtggaggtagatcatcatattcttcatcattatcatcaaaatcattgacccaaaccactcttctctttttagtctccagaggaggactctacttggtggtggttatcgaaggtatgagggcttgtttagcatgctgcccaagatggctaggacccacttcttcatcatctttcatcacccaagtaggactccacaaaggtaaataatgttccaacatttgttcaatatgaataattctctaaacaagattgatgacttcgagacaagtaaaagtgaaagagttattgaagatgcctcatgacgaggttctagtaaagaacatgtctttatcaagcatccttcagggcaatcccaaaaagaagagaagatctatcaaagctaagccttggcatctagcttgtttatgggctcggccttggatctagaagtatcaacattcttgacatattcccatgcataatttgccttctcacatagagggggactcggttctgagtccaattaccaactacatgaagagacatgaggcctagagcttttaattcatggatactattcattattgagaatataacatcaatgtgctttagtagagggtctctcatccattcatagagtggtttgagaagttggtggcagcataagagaactctagggaaaaggtctctaagggaagttgaagagacaaatgtggagagcttctagaaacaaagggtaaaagttgatggctcatggaagctaaagcaccatagggtattctcttttataagcgattgaggaagctgaagcaacatagaattatggaatttgaagcatcacactaataaagtggccgagtcctaagctctaaactgagcctctagactcaagggttgcagcaatgatctagggactcggtcaaggacaaattagcacaaatattataattcaaatattattctagaagatttataaaaagagtatcgtatgagtgaatcaattactcgaccaagggatacttaggggctactatcaataatatgtaccataggtacccaaatcaagctccacgaagaagagcctaaacaaaagggcccataggcttgacaacaaacccagggactctgcgatcaagaacgtagggagcccaaaatcttaggggttctagaagagcaaatatggcaaagacctcatcagaataagagatacgtccaagatctcaacatataaggaagacacacttgtaaacaaagaatctaactcatatacaactcattatcgactcaattatgtcactaacataataactgatttggtgcctaccatgtaactgtcgtccctccttgaggcatcacatcacaacattcaa

SEQ ID NO: 689 - DNA, 1050 bp, Zea mays
  misc_feature (1)..(100): optimal_loci_1024_G1, chr1:5223884..5224933, Cluster 5
  modified_base (357)..(357): a, c, g, or t
  misc_feature (357)..(456): n is a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
ggcgtggctagaccgccggcggcgcagccgcaacgccaccaccatggtgaccgagtacagcgacatcgggtgtcgctcgcgccgtgccggtggcgcatcccagacccccaacgtgctaagatctcatggagtactacattgaaaagtatacattttacggggtaaagtttgaatatagtgattgtaatgagtaagctgctacagatagccagcaacgtgctgccactgttctcacggaggtgtcgatgtaaactccattgaggcgtgtaagatgaaacgggagcgagtgctttggtgaggatgcacgaatctgcaaactgtgcaatgatagattcaggcactttgcaatttccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtttatgatgaaaacggtagcgagatgtcttgggtgaggatgcccagaaccctgccaacttgtgcaatgaatgaattcaggcactttgccattcccaagttgtcaaacatgaatcattgattctgctgagatttctcaggcttatcacgatgcaggattccaacaggccggcacggatttatttagggcccaggtaggttttgacctatgctaagaagtgggattggactgggcctacctcgaccgcaagttacgtatgcgctatgggacgtcgacggcctgctaataagcgtgtgtgttttgatcagaagaaaaaaaaataataatacaaagtctatttttacattaattttctcttataatatcatgtcatttttaaagacgccagaatcatcgatggaactgctagcgcaggaggcatgctacttctctatcttatccctattctttctccttccgatactttattcacatataaaaactgttccaagtgccacgtcatttttttcacaaagaacctctcacatctatttaaaattaacctatctcccctctgcgcaacaacatccacgtcccaaaccacacctcca

SEQ ID NO: 690 - DNA, 1202 bp, Zea mays
  misc_feature (1)..(100): optimal_loci_106433_G1, chr3:86829313..86830514, Cluster 5
ttgtcagcaaccctaaccatatgcttctaaattaatttggagtgtcgtggagcgttcattcgaagatggcatatgcggcagcacgcgccgtgtctgctggtgcagtgccggcagtactacatcagcctggggatgacatgaaaccctgcacagcaagcagctcgccgtccatgtccatctatcaatcaatcacattgtaccagctgagctggttgcgttgtgttgtatgtagatgaacgtggtgctgttgacatggacgaaggtgtcgggctgtcaatgccgacggccaagccatcgatgcccatttggcaagcaacctgtcggccgcccggggagttttaccaagaccgtgctatctgcctcagcatgaatacttacttgcagttgcagctggatgtgcgacatcggtgttcgccagtgaaaccatgcagcggtctcacagaacaaaccacctgcaaatagcggtaaggcagcccacggaaactggtttcagaccttcaacacaagcagtagccgtctggatcagagagatcgaatcatctaggaacgcctctgagttttctgacggttcaaattggctttctcattcagagatccgtctgcaattgactctattcttctaatgaaagaatagagaagtatctgaggattaggtaaagcgatctgcacacgacaagtacccctcccgtgtccgggttacagccaagaaacatacatatgcataccgaaagcatgagctaccaagcggcactcgccacacaaacacgcaggagtcggtttcagttacaaccactgctgaaaactaccgcccgacgtcttcagcagcctgtccgcacatcttctccacgaatccggatcgtggaggtaggcctgatctcaggtacagatttccttgcgcccatgtcaatgcaaccaccactctctctgtacttgagcaggacgaaccatgcagcaaggccttcctcacatttttttctgcttctggatctagacgttgttgttgtgccccctcctccctccaagagtgatacatcctctctctctgtacttgagcaggacgaaccatgcagtaaggcctttctcacattttttttctgcttctggatctagacgttgttgttgtgcccccctccccccaagagtgatacatcctctctctgtacatgagcaggacgaaccatgcagcaaggccttcctcacat

SEQ ID NO: 691 - DNA, 1268 bp, Zea mays
  misc_feature (1)..(100): optimal_loci_108411_G1, chr3:99271772..99273039, Cluster 5
cttcgaaaccagagaaaacaatagaagacttgctacaagactatattcaatatttaatgatatattgtagatggagatggatgaaaatatactaaacaaggtgttttttagtgttccagcatgtttttagtcttagcatatatagaaagatataaaaatataatcaccgacctatgttcgactagtcacgactagtctactagtcagtagccgcacgattcgactcgacttctcgactactcgaaacattggtttgcaactttgcatatatgtcatctatagctgtcactgaaaggaatttgagattttctttgtgagcaataggcattccgtcaggtttgtcatctatagctgaaattgaagaaaaaaatgtggttttcttcctaagcaataggtattgtatgtttctttctggtctcacctgcatttatttgtttatttgcctttaattcttttcctacaacaatatctctgcagtaatcggtgacaaatataaaatcctgcgagcattataactaacctcccctagcgtcttgcgatgcttggcatcctgcaccgccacctccttcttaagattctggagccgcttatcaatctgctaaacaaaaaaaacacacaacacattgcactgtcagtggtgcgcaacactatcaccgaccaaccaagctcccactcaattgagtaaggcaggaaggcgtggcatgaagttcacagccaacattcagtgccgcaggcaggtaggctcgcgacgtgacggacctgcctacggaggtcgacgagctccttgcatgagtgcttgaacagcccaagaagctcgtcgacagcggggaagacgggcggggccgccccgagcacgggcggcggaggaggtggcgcgggcgcggcgtcgtcctccccgcggtactccgggagcagctcgtccaccagtcccccaaacagagcgtcgaatgagaagtctccctgcgccgcagtaccgcaagcgacgatgagaccgcatcgcggaggagacacaagaatcggaggaagggaggaagggatgggagagaggatgaaacctaccttgaagtcctcgaggtcgagggtgaggggcagcgcggcggcggggttggcggcagtcggcatagcggctggcggggcggcggagatctggggttcccttcccttgtcggagaagtgtgggggtgtgggggtgtggccgccgtatcgggggcggactggacgaggaatgcagaacggaaggggaaaaccctgcaagctgcaaccgcgtt

SEQ ID NO: 692 - DNA, 1278 bp, Zea mays
  misc_feature (1)..(100): optimal_loci_114184_G1, chr3:137239110..137240387, Cluster 5
gaagagcagcggctctcgatcgatcgtcttatgagttatgacgacgatgagctacaaaataaagcatggggagtagtactgtgttcttcttgtgcaaatgtatagcagtctcacatgcatgcaaatcctcattgccactcattacactctctcagatgaagttctttctaggtagcttcttgtgattggtcacatgcatatatgctgctgcttgctgctcttgtgctaatgcgtgctctgacgatgggcaagacgatggagccatggagaacagttatacccatgctcattatgctccaagcatatccagatcgggcgttgtggtggttaaaagctactccctctatctcagttgggaattattttttcgataattggagcttatattaaagaaccaagcacattacatcgagaggatacaaagtcttattagcacgaactttcggtctctatctaacgcacaaagccaaactacagatagaaaaggcatcacaccgacacagaactagcggcaatcaatcctaagcctaggttgtcattcatgaaccgctcaaagcgacgcaacccagctgcaagcctgcaaccaaagtccgagcctcctcccgtcgtcgaaagaataacctgcaaaggacaacaagagacttttttcttagacactatatcgtttctacataaccaaagaggccagcataagtccgccgctccgagtagaaacaccgatttcaatgttttattaagaccctgaaaacaccctgaacatatatggtctagattaattatgcgatggatggaagcgggtggtcatatataaaatgctccaaactgatcgaactaaacgacactcaaagaaaagacggttgctagtctcctcttatggcaggaagcgcaagtcttggtttaggattgatttgcattgggataaccttccttatggcaggaagatggtcgtcgcgcggcatctgctgctgcgggggtgcgctgcccctcggcaccagcgtggaggcccctcgtcgcgtcgtctcccatcgtgccacccgtccaccggacctggctgcgggtagcgccatccttcggcgcgtgttgcccgcccgcctggctagccggtcggcccggacgcctcttctgaccgacccttcgcgccgctgctcctctactgttgtacgaatgcctcatgtcacgaggccacgggccacccggatccgatgcttgtctccctctgtgtcgttttgaccgaggataatagatgaggggcaaagctatgaacatccagttgtttac

SEQ ID NO: 693 - DNA, 1269 bp, Zea mays
  misc_feature (1)..(100): optimal_loci_114185_G1, chr3:137240507..137241775, Cluster 5
tcttcttcgacagtgtaactggcgtaaccgaaacgcgtatgcctctttgcctgcacgtccatccatccgttcgaaaattatatacatcataagtttgagcatgcagtttgctcttctctacaagtttggtcaaacttcataatcataacttgacctagctagaacaactccagaaaatcgatttattttgagacgaaagggggtaaagaaaaaactaaaaggtagctgtgttaattaatttattgtctcaaacatcatctctcgatccatgatttatttttgattggttacaaactcaaagtgatccatgatttgttttggagaaactgataaggtaaaggtgggcagagagaggcagggccagatggtgtggtacagtatgggccagccagcaggcactgggccaatgggcggtcgacgtcgagttgccgagtttgggagggcagcacctgatcccgcgccacaagccttgcccgaaccagaaccccacttcggtgctacgcatccgctcgcttttcttctccgatggatgtgcagccagctgcccagctgcactgcaatcaaccaccactactactactacgcacctagctagctgcatgtatgacatgcatggtggaccgggtgcatgtgggggctcatcatcatcatcatccatatctcgtgcactgcagctcctagcagtagcagctagctactactggccgcccgctgcaacatatataagcaccagctagctctagcatcgatcactcacgccacgtgtagcagctaggccgcacaatgatgattgatatatgtatgtatgtattataatgatgagccgctgcttaattccccttcttcatttccatcagagacgaccatgtggaagcagctgctgtagcttgccgtgtgtttgtgttagaacgcagagcaatacaaatacatatctatatctatatatcagtttaaactttgtaaaaaccatcccaaccaaataacccccacatcgtaacctacactaaatcaaccaaacaaaatgcatcggctatctcttactcactcgagttcaataactcaagttcaataggcaataccaccatagcctccccctccccgtaaaatctgtgacttgtgatgttgttgtgtgattgtgtcattgttcatccatcatttaccaattaccatctttatattgtcattgtataaaaatatatagtgctttttatgtgatatgtatacaaatatattgtaattctagcggacgaacaaaattcgagaacgggg

SEQ ID NO: 694 - DNA, 1304 bp, Zea mays
  misc_feature (1)..(100): optimal_loci_114793_G1, chr3:140947448..140948751, Cluster 5
ccgtagtggtcacgatccaacatgatccacgggtagattagttcaaggccataagtgtcaaaccaaattttggtcacgatttgaccaaacttgattttaaattaaaatcactatacaataaaattttcatcttcgtggtttatttaggatctgtttggaagggtttcacttcaataaatttaacttcggttttccatctttaccataaaacaactccaataaatttttgaagtgagttcgagtagtgtttggcttgcacatgaactctagcttctgtaatataattgatttgtgtgagtttttttgattaccattgatgattagtggttatcatgagagaactgagcgctatgttgtgtaaccagtgacgtggtgagtaatttttatgtaacttaacgaggaggtataaaatcaatgtttgcgaaacttcctttaagaagcttcgtaaatttcataaagttgacagctagttttattttttggatgaagaagctgaaatgaaaccagaaattttgaagttgaaccctcctaaacagttgcttaactatggctaagttataaaaataagtaacttattatttgcctaaattttagtttatagtaaaacatggtcaaatattaaccaaattttggtatagacacataaggccttaatccaaacagacaaatattcagttttttagtctggtaggatggtatttcagtttggtaccattagaaaatgactatttcattagcgtagagcgaactccaaagttccggccggtgtgttcctcttccacggcctttgctccaggccttcagccccaatgtcggttgctctataactaggattcacctccccggtgccgtcgctgctcagctcccagtcctcaccgctccgccgagtttccgctccctccctcctgcgctagaaaggacattcgttcctgtattctatatttctagcgcatcgcggcggatgcgggccgaggcagcctctccacgcccgccgcctgcacagtgcaagttgctgccccctgccgggctgctccccattttgatctgtaattcgtcttcgagattgcgtcgttttcgtaggacgaatagagtatgtgttggtttatcgttcaatttcaatggtggcgaaattgcagattaactcttcatacggtcaccatcgtccacgggttgcatctgctaatctgtatggtgtgacggccttctctttactgctgagatataggtacgaccctacctgactatttgcctcaattaagataataatgacgcgtggctacaaacgtgggttacatatgtgcatg

SEQ ID NO: 695 - DNA, 1318 bp, Zea mays
  misc_feature (1)..(100): optimal_loci_11875_G1, chr1:64550165..64551482, Cluster 5
tatcatataagtggatttctatatgatgacatattgattgggagaggccagtcaccaccaccaccactgcacaactatcaattgttgttgcttttctctatttatatattaatggcttgtttgggagggattcactttaagaatttcagctttgattttctagcttctccataaaacaacttcaataaattgttggagtgggtttggggagtgtttggcttacacatggactctagattctataaaacaattgatttgtgtgagttttcttgattatccttgatgaatagtggttgtcatgggagaatcaaagcgttaggttgtgtaactagtgatgtggtgagtaattttcatgtaaggaggtatgaaaactgtgtttgtgaataatcctttgaggagcttcatgaatttcataaagttggcctctagtttcattgttttcaaagccagagctcgtgaagctagatctgtttggatggaaaagttgaaacaaacctaaattttttgaagtgaagccctctcaaataggtcctaactcttcgattgtttttttcttcttggacttgttagttaaatgtctaaatgtgtatagagaaatactaaaaccaaaatagcatcaaggctacattaacatattattgcattacggtattagcctcttagggaaagcacctattcatatagagtgtatgccgaatgaacatttatatagtattatgtagtgtttgttgaatgaacatttgtaatggtatgatagtgcttttcgatcgattaatggtttttgtgtacactgatatattaaggattggttttacgagctcaatgccacgaattttggtcttcgtctagcacaaaagatttatcttactcaattagaaaggtgagatattagccattacaaaagataaaatagattattattttgttgatacttattgttaagacctaaaacaaaataaaatgacattaaactttaaatggatattattgtatttttgcgagctcgacgccatgacatgtggcatcgagcttgacgccagcgcaacatagcatctcatacctcagcgccataagttacgacgcctcatacctcgacgccataagtcatgacatcaaactatgttacctcagcgtcgtggcttgtggtgccgaacaaagggttcaaaatgagaataagacatccagagggcaaaaagtattttttacgagaaaagggttaaattgaaaaaaattgggatctctgccaagcctatctctaatcgctccttgcattgtgcagagcttttggttaaattggcaagggcctctcatctcgtgc

SEQ ID NO: 696 - DNA, 1083 bp, Zea mays
  misc_feature (1)..(100): optimal_loci_120570_G1, chr3:177115970..177117052, Cluster 5
gttgtaggcaatcagatcgtgttttttcagtcattgcacaacaatgctgcttgaatagagcagacattaaatcaatatgttgacttgcccctctaattttgatgttcagtagtcacctctttagtccattagttcgggtttttatgccatccatagtcagtatatggatcacataaaaacaaaggcatgtgaacaaatagaacccactcccctcaggatctcaccgcgcccggaccccatgttctcattgtgctgctgtcgctctagcaaacgacgcaaccagaccactgcacgctctagatcccaccgccgctacgtaagcatttctcctacaaactgttattcgtcatgtgagttgtccctttgcatgtaccttttgttaggataacattagatagaatacaacaactatactttgtcaatacatgttgtgatctttcttcaaaggcttaagcacttcatttttcacaacaactggagcactgtcaaatatcatgagcgggaaagctggactgtatattcgagcgagattttaggtgaagattttgttctaatactcttttatttgtgttggagaagaagctgctgatgaatatgctaggaaggtgcctaggttggatctccatcgccagagacatgctgcgcttaataagtttttggggtgtttgctcggttggtgctctagagagttgtatagtgtctatgctaatatggaatcaatggaaacttactacggcttttgcactcgtttgaatgtaacattagcttgcattccatattttctatcgtttctttagtgcctcacgcccctcaccgcaccttttacattcattattttattattcgaaaaagagaggtcaacacaacttatataccaaatgatcttaacattactgtgtgattatcgaaccatgcctattacaccattgatcaatttagcgttttagattattgtagggagtccaaaggacgcctgatgttctagtggcacttcataagacccaggaacaaagtccaagtgataggttaaactggacatgagcgcactcaacgtccccttagaattaacgtttttaggtactg

SEQ ID NO: 697 - DNA, 1093 bp, Zea mays
  misc_feature (1)..(100): optimal_loci_122090_G1, chr3:184927204..184928296, Cluster 5
tagtcgtgtgaaattcaagtaccaccattgtagtgaaatttgagaggcgctaatattattgtaataggagaaaatgtttgcaccagtctgccagtgttactgtaacaggagcaaggatttgcaccaaagtctgcaatctaatctacgcagttgtcagataccctgaagccaggcatctcaaatgaagtggccaaaggccccgagcgcgcgcaggccacctcgcggatgtctgcggcctcgctcgtctcgtctcctaccaagttcaccttgtgcgactacgagagccaaaggccccgagcgcgtccgtccagtccatccaccgcgcgtcacgcacttcgcgccacatcagacactcttctcgtgagcgcgcaccgatagaccgagggacgcgcggaggggagggatgatgtggccgtcgacggcaccgtaactcccattcctgtacccggcgccggcgtcggcgtacgtggcgacgatgtcgccggtgtcgctcatgtccatggcaaacgcgggtacgacgagagatcttggagctctacgcctctacctccccaacgacggctacgactatctggcccacctccgagagttccgcccctccctctcctcaaccggcggtgggggtcctcggccatattcctccctagctgtcgccccgcggtgaaaatcacgcgctgtttcatgtggccgaggtgcctatctcgttcgcgcgtcctgcaggcgtgggagacgagagtttctgcgttcctgccgtcctcccaagaccggaggatccaagtaaaacatcgaatctaacgactgtgatgtaaagtttttgcttttctccagtcctcccaaaaccgtaagatttaaataaaacattgaatctaacggttgtgatgtaaaaagaaaactggttttttatatagatttattaatataatcggcagccgtttaaaaaaaagatataagttcagttcttctaggtgagactcaacagtgtgggctccctcttttccacccacgaatgggctatttgagatttctaattagcgccaaccgccaagcctacatgtattccaataagtgtcaccattagtgacccatatagtgg

SEQ ID NO: 698 - DNA, 1224 bp, Zea mays
  misc_feature (1)..(100): optimal_loci_123419_G1, chr3:192010348..192011571, Cluster 5
ttggtgctttgaccaatacatcaaacacgtttggtgcgttatagcctttcttgtgttgctctgcaacctctctaagtactcttttcgatggggtatctggtggcacatcagacatatgtctggtaccatatggatgtccctaaacttgcttcaaatctcttgcagtaccatatccgacgcacacatacgtgtctggtgtactctgtttcggtagttattctttcgtacagtttcactaatgtagtgttgttttatcttgtgcactttcagacacgtccgagctgttgagtgatctattttttttttcatttattcacgtgtcgtgttaaaatggtgcgagacaatgtatcacatgccaggtaacaacactatatcaagattagaggatgcagccccagtaggcaggcctttacatatttagtaacaacattaattactaagattagacgcatgtcgacccttttctacttatatatagcattctatctttaacatacatataaccttctatacttgagtacttacacgttgttatattaattagctgaaagtggtacatatatatactggtggtagcgtacttgtttttttttctggaacgaggtcgtcaggactcacgagagatatggacgggcgagtggataaaacggctgggttgacatgatcgacacgtacgggttgtccggtttggcacaaggagccgtaacaccgatctcgcttgccggaacgctccgccaacgacgtcatgccgcatccgcatgaaggaagaataaaatcccttgggtgatgacacaaaatgcaagcgtgtttggtcatcattcgatcgtgctgccgtgcgtggattcgcacccgccggcgggatccggacgaatgtcatgtgacaaagctgcaagcggcggtttcgtcatttcttgcatgtagagctagcttgcgtgtgcatgcatgcgagcacgtcacgaaatatatgtactgtcagtatatgcccccatatcacgatggtattcgttaattgctagaggaagtgtgtaaatcatttgatcctctaaatctggaccacaccttgccaagagagcccaacaagagcaacaagaggaaccctagctaataatacatgcaaaaatgcacagcgctcgtacggtacagtccatgagacgtacgtacgtacccctagttttggtgcacacacgttcggcgggcggtgtgccggccggaggaaggcaaggc

SEQ ID NO: 699 - DNA, 1300 bp, Zea mays
  misc_feature (1)..(100): optimal_loci_125314_G1, chr3:202490395..202491694, Cluster 5
gttgctattgcagtgcacttccccaaaggttgcatcttctttaccttaagacctttactttcaccgtgatttaggaactgtagaatgattttttttatgaaaatcatccgctatcatatggttttcggggacaagttttctagtgcaattgcatattcaaatttctgttcgcccttaatttattttgaccccttctcttccgtaaaatttcgagagcaggatggggagaaacgctttgcgcgtgcttgtaccacatgcagggggtctatcctacaaacacaacaccaggtggtagtggtcaccgttccttagcacggcaacgccgtcgcccgtcgacggtgagcacctgcctcggcaactttcattagttcttgcagcgaatccggaaggaggacaagcttccccgctgcacggctctgatgcttgtcagtgccatcgctgggaaccttctatgttctcgtctctgaaacctgcatgcatcccgttgtttctttgtttggggcagtgagtacacggccagtcgctcagaagctagcacggtggtcattggagctatcgaccgaatcgactgcgtgcgaatgttcatgtaccagctgcacgacgaggtcgttggagactccctgaaacaggtagcagcgttggacggttggtgtccttgaacaggtggtgcgcgacccaggacctgagcgccgccgtggctgggcatgcaggtcgggcagcagctgctgctggatcaggatcaccgcccgcgtgctgaacctgagctgcgcgctcgccaacaatcgagactcgcttcaccatgtccctctgccgcaaaaggaaacatgcagcaagagttcattggccgccttttggtggcgtacgtggggggcacataccatcttgaaggtgttgttggcggcgtggacgatgccgatgatgtgcgtccgatgttggagagcatgtagcatgtagcaacgaccatctcgccggggttcacgacgtgctgcaggtgatggaccagtacaccgggtaggtgtagctgacccagacgctgctgtcgtcgaagtcgcgcacctagctagctgctgagccgtggtggaaagccccatgcattgcggtcgcactgtggtcttcgtaccccgacgatcatgatatattggcacacaaggttctgaccttcatcatggtttaatagcgagcgtgctataatttcctaatagtctactaaggagtataagcaatgtgtaccgttcatgcatttgtgatgtaattccgaagcacgcaaaacacaaaatcatgcacccgatcccgttgcaat

SEQ ID NO: 700 - DNA, 1247 bp, Zea mays
  misc_feature (1)..(100): optimal_loci_125623_G1, chr3:203845770..203847016, Cluster 5
agttctagacatttctacatgagccagttgcagtgctcgcttttgtcatatgcacccacgatctcccatgaacagtttgccccaacatccatctatgtttgcttctactaggaagcacaccaccaccaaacaacatatatatcgtgagaagttcgggatttctatgttgatgatctctacatcttccggataatcctacatcgcaaccgcaatacacaaagttggtgaagataaacgaaagagcagatctaacagcgaatgacgacatatcttgacattttttcgtaggccactaaaaacataaatagcttatatgaccattatgaaagtgacaataatgaaagtcggcaattgcaaaaattctataatatcgtgcacgatactcacacaaaagagctcttaaagcttctctggtcaatactagaccagatggactaccacggaacataattgttgcattcaactttgagaccgcttttataatataatgttcctcaagaggatcatatgttcctcctaacaacatatagcaatatcccgaacgatgcaaaaagccaaaaaccctcctcaaggtccacataattagtggactagaccttccaaccattttgcgttaaaaaaaccctccacctaattatgcataacaaacatttcatacatagagttccgtaacttcctgatctatatcatgtgaaaaagtttaaattagaactaaaagtatactaattatctaaataaatttattgagtactcaaacaaatgtaaaatatctagacccaatagaatccaaaagacaaaggagttagcctgtctccgtcgagctcacccctaaattattttgaaacatacacgaggaagcaatgtatcttaaaaatgaaaccctagagatacatattaggttggaatgcaacctatacctcgctaccctggtagtgggcctatcgcccctctatcggattacaacccccttcggacggtagggagtagaatgtaaaaaacaaaaaatgatttagatccctaccatcccatgatcagatggcaatcacctataatagttttgtgaagttgagatataaaattgaaatttccattatttttgcatataaaaataaaaagatactacgacacaacatatataattttttgtgtgcttgtcccacaaccatattggcccatgaaaagagttgtcacatgcggagagtcatttgataaagcgagaatctggccttatcatgcttcttataggc

SEQ ID NO: 701 - DNA, 1031 bp, Zea mays
  misc_feature (1)..(100): optimal_loci_127103_G1, chr3:210985802..210986832, Cluster 5
acgggttaaagttaagcggacagaccgaacagtagtaatcatagtaataacagcaacaacagtaataaaaagaaggaaaataaaatcaagtgtttgagcgctctatcgtagtcttgacaccgacggtggcgcgcggccgtcgcgtcgaccattaattagcaggcagctccaacaaaacagcagctcggcccatgactttgaacgcaagccacggaggagcgaggtcgtcaagcccaccgctataataataactcctggaagggcaccagcaacccgctcgtggacgtctgcctggccatcgtcggcggcacatgccatgcatggaaacttgaccggcccggccgccgggtttggtggtcagatagactactactgtagggcagcggactgccagacagaggagagatcagaaggcctcaggcccaggcgcgtgcgtacacggcctgaccttagctgcgcctacacgtatccgtcgtgcccacgggttccataaatagatatcggtgtgacgtgacgtgacgtgacgtgacccctgcaattaacaaatcaatcaagccgatggtgctcggaggaagctggattgccaagccacccacgacagcgacgtcgccgatcgccctgctgccgcccggtctcgtctcgtgggcgatcgatcgatcgatcggtcggtcggcgggcagcggtacccgtccggggtttaattgcgcgtggccgtgcgatggctccgtcacaacagtcccccgattgccgatttaaacccacgcaatccgtgtatccgatttcccccgtccgagatcagattctccgacaaccgaataggcagcaatcgccgacgatcggacatcgcatggatgaggatgagcacgccaccagcggagcgtcagatcagatcctggcattctagtgacgtcatgcatagcgacgaaactttgtcagacgtataaacacacctcctcaccaagtctctttgaatataaacatttatccacgaataatctcatctaaaaaaagagtagacattaacaattaca

SEQ ID NO: 702 - DNA, 1064 bp, Zea mays
  misc_feature (1)..(100): optimal_loci_129998_G1, chr3:225367837..225368900, Cluster 5
attagctttaccaaaaatattttgttactacgtagactgtgtcatggtcatgcatgcgagttgatatcgatcaaaaaaaaaagtagcttttttccccttctttacgagagtagggaccagagcatgcagtccctcagtcgagtggcttctggcttaggccacttcaccctgtaggtacagcgtgatgataagatgaagactgcacgatggtccatgcatcagcaagacagcaaccagcaagtgcacagcaaacacaagctgctgctaacaactgccggccagtctgaagccaactggctctcaagcgtttgccgcgcgaggaagatttagtttagtttagtttagtttctgagaagcgtgaacgtttttggggagcgtgtcgtgtgcaagaccgatcgatcgagacgaggatggtgcagtgcaagtgcagtagtgcacacggcgagcaactactgcgttcttgttaaataaaacgcacggtggtttgccgacggtcccagctctagctacctacaagtagctactgcgtgctgtgctcctcctcgacattgatcacctgcacaactgcgtgctgctgcacttgctcagacttgcaggcaatctatcagctcgtgctcgttggcggcttggccgtccttcttcaaatgcatgcagatatgtataatgcgagcaggtggctggcaatcgtcgtgcaccgggctaccgccggccgggtttcatttcttccaagcaaagaaaactctcggtttcttgggcctctcgagcacagatgaggtggcgttctaaatcgcctgcggttgcggttacagctcatgggagagcaagcgaagatcgatcgcgcgcgccggccacgcttattaaaacttggtttgttttatttcgacgacatgcgcaacgatatggcacatcctccgtaaaaacaaacgacgtcgtgggcgatcggctgaaatatgaaaaaggtggctcaaaaggctgctggtttaagtaatggtgttaggcccgtttaaattctcctggctaattgtttgtcagtggttaacaattactcggcaaataattagcta

SEQ ID NO: 703 - DNA, 1202 bp, Zea mays
  misc_feature (1)..(100): optimal_loci_130391_G1, chr3:227232280..227233481, Cluster 5
tcagtaggccaccggcaacagtaagcaagagctagttactagctttaatagtgctaatttttagctttaaaatatttgcaagaatttagttgttgataagatctaggttttctttctcttatattaaaatatatatataaaaaaagagattgcttagagctaattcgaatgtcgattgtaagagcttgctaaaattttctcctttagtcctaatttggaaacttaggagacgtttggttcgaggaaacacaccatccaaaataagatgatgcatcacgggtccattcctcaaatttggtgggatgaccacatttcttatattagtaatatggagatgtgagtttaaggctggaaaaaaaattggtgggaaaaatggttgttttgtgaccacaataacatcccaaggcctctaggatttttaagtttttaaattagcccttagcttctttcccctcccagggcatttgtcccttccttcacgtccaagttacatccatgcatgctgctgtaaagcggaagcatctaattcaaccattcttcccagccttaaactcacatctccaggacctggaccacctcgtcaccggccggtccggtctgcttcccttcactgctactgctagtagtctgctagctcctcctagagactagagtctactacagccagccacagcccacaggtgagaacgaagaaggaagatggccgccggccaccgaaagcagatggcagccacacgcaacgcaccttgacagccgccaagctagccaacccaccaagagaaagccactgtgtcttccttttccttggtctcctcggctgcgtccgggcgcagcgcagggagcagcttcaggcctttcagaaaccggccgtttgtcccttcatgctgggcgcggtactagtagcagagcatgtggtcgagtgagagtgacactggatgcgatggacaaggcctgctgcaattgctgcgtgcagttgcagctgaactgttcagggcaataagctcgtccccgtcgacacaaaagtttaagcataccattacagctctgctagctttgattagattacgtacaacattggcatgcatcaattaccgggtcaataaattaagagggaattaaggagacaacaggcttcacgactatatataatatatgtgtctattacaaaaagcctattacaccctctaaaattagtttaaaat

SEQ ID NO: 704 - DNA, 1052 bp, Zea mays
  misc_feature (1)..(100): optimal_loci_131332_G1, chr4:506889..507940, Cluster 5
gagatgtcatccctgagaacaatgatttgttagaacaattaaggagtcagtattattgccataggaaaaatatctgtaaagatatcatcctttctttcatggacaacataaaagacatcacaaaaagatcatcaatgtcgtggataagacatcaaaaggggaatttgtcttggataaaaaaagataagcagacccatgctctcaaaaacctaagcacccatatcgtacaagaggatactagagtttgtcatggaagtttatattttattaggatattgacacctatagaggccaacaaagaggcaaagctaaaaggaaagacaagatgtgaaatcttgagtacgaactagttataaccaaagcttctatccctgaagaggttcagtgctaagtggcaatcgcagttaggcagttaactcagtaagtgttaatgcatcgtcctaccgacatggtcagcacatgtcactaaaaaaagtagatgtgcttccacaaaactccctcaagacaaataataccatgtggatgatattcaatgtcaaatgccttatgagctacaaatagccttgaggaacctggccgctaaggtggcttatgttatggcttcttcgcctcacacaagggcaacatagcatgatgttgaaatcccagtcgattattcatttttagtgttgatcatatatgtgatggatataaagagttggagcaagacatccaagacggtgataatgaaatggtacttgtacaggctctatatgggtatattttaaggcaaaagagatactcaatggtcaacaaccatcaactactgatggggctccctcatcgctagaatttccacataggaaccctacccctccggactctctatgctagaggcccactactatagattcaccacctaggagccccacactcttaaaaggatcccttcacctgctccacaacctattaaaagtcaaatatgcacaaagtgaagctgaaccacaagtaagagcacacacaatgactccttagctatatatgcatgaaagaagcaagcctatgatatgact

SEQ ID NO: 705 - DNA, 1130 bp, Zea mays
  misc_feature (1)..(100): optimal_loci_132069_G1, chr4:3580942..3582071, Cluster 5
atgtttgatgccgaaatatatggttcataggattttatatagttaataccaaaggaatccattggctctacacttctacaatagcgagtgcgccgcgtgctgcttgcagagacgtgtactgaactgaaccacacaaggcactgttgcatgcataaagacgtcagggatggccgatcaaccgcgacatatggacggagcctggccggcgcgagcgcgacgtctctggtcgccttagatacacttattatctatagggacgtttggcagagcttccacatagttgtgctcctaatgagaattgcttatagaaagccaaacaactaagggatcgtttggtatagctccgctctataattctctagctccaagagttgattctctaaaagagtgattctgagtgattctctaccagaattgaatctattgggcgaaaactgtttgtcaaataggttgtaaagtgattcttgaagggttaaagagcggggagcagattgggagtagtgggaagtaggttgggagtgatggaagtattttttttactagattcactatattcccaccatgaagcagttcagatttttattgtttggctcggtagaagtgattctcgctgggagtgaagttatgggagctctgtcaaatgccccctaaaaattgagttacttcattatgggagtgaagtgaatctagtctccattttgtactaaagagtgggagccaaaaaacatgactcttgctgcttccaaccactccccacactacaacccctcaggaatcacttcacgcacaatttgtcaaacggatttcgtcaaatagattcacttctacttgagaatcatttggaatcactatattagagaattagctctcggagctagagaatcatggagcagagctagttggattatgatagatggacaagagagtaaaataccattttaggatcataaataagttgctagcttatttcggtttatttatggtttaaaacgatattttatcatcctaccatttcaccataatcatccaactttatataatctaggagagaaacatactctgaggccgagtgacgtgttagtttcctttccttaccatagaagtatatcccaaaggtcaaatttgtgccg

SEQ ID NO: 706 - DNA, 1328 bp, Zea mays
  misc_feature (1)..(100): optimal_loci_135093_G1, chr4:17367912..17369239, Cluster 5
ttactagcaaatgtttgcaaaatggcagagctagagctgattttcatgctagagctagagctatttttggacaatctaaagcactgataagctatttctgtcaaacagaccctacaaaaaacaagagaataaaccagagtttaccggaagaagataggataaataaaaagaaacgaaaacgatccggctcagcctgtggattacaccatgatttggatccactaatcaaattgagcagcaagacttggctttaccatatgcgatagcaagagcatttctttatgaaataggtttctcgtattggtcatagtgggatgaatctcttttacttttaggattagttagaagtttaaatccccttaagttctggtttaagttctggtgaggatttgagcttccaaattagcccagaaggtgaaggtcgtatctcatttctggttgtccaaatttccaacaaatgagcacaacagttgtcatgaagaattgggactgtgtaacctgacttctggaacatctattcccaacattgttgcgcaaatgggcattgaagaattgggactgcagcagcgctgcatctgcttcttggttgtctgcgtcctgtatgcatcaagcagatgatctgtgagagcaaaaaccggcacatcaaattgagatttttttttttaaaaaaaaagggaccacatccacattgtacacgcatgttatggtccgagatcgggaggattatctgcactgattctgagtgttgaactgcaacacctgtgctgtgcatccaactgctgccactccatataacgctgccctacttgtgcgcgtacgaataatggacgctggcgttcgccgacgacgatcaatgctgacactgccctgaacctgctgctttaaaaatttttgctccctcgcctcttgttgtggatgaacgtttgtgatgcatggtccccggccggcctaacttattccttgaaccaacttttaaatggattcgactatttcacattgtgaaaaaaaaatagtgtcacagtgtcacgtcaaccagaactcaaatttgtgctctgcgaatcgaagcaagcagacgcagttccctaaacgatcattaaatttgtgttcctaactatatatgtacacaagttgtctgtctgtttggatgtatttgtagcaaaaattagcaactactgattattttattagcagatttagagttgctactaattaatgtttagctacattttttggtgtgtctgtagggtatattcagtcacaggtgggagtaccaatctatcacgtctgcacatgcagcccggatcgagcatatagaatctttcgatggg

SEQ ID NO: 707 - DNA, 1049 bp, Zea mays
  misc_feature (1)..(100): optimal_loci_135476_G1, chr4:18936541..18937589, Cluster 5
tgtcgagctccatgttgagtaccataaaatccacctaccagatagcagactaattggtctgccagctgcaaacatatggaggctagttttagataaccaaacttacaaaagaaaaaaaaaagagactgaggaaatgatttcatcggttctctttccgtgatggagtcaaagcagcagtgtgtccatgtactgtggcattcacatgagcctgcgcaagcaaagagggggacaaacattactgcctgcggctacgacacgaacacgacagtagtgttgctgattactggctggctgtctgcgctacataaacgagacaaaataatggtctcgcgcatgcctgactgcctgcttgaggccacaacaacttagcggctgccggctagctagcgcggccataggcatagcaatgctgatgcatgcatcgatcggaaccgattcctctggccgttgcgtgcgcgtaggcgtccaatagccgcgcatgcgtggtgaaactttggcttggccgacatgagtgcccgcccagactgcaggctgcagcactagcaaccgatccgtgctcgacgtacaagtacaacaggtacatctggtcgtcagcaccaagcaggcacagtttgctcataatagtggtcatatatatatatatgataatgtgaccatctcaaaaaggtactccaattttagaacattgattagtcaaactactccaagttttgataagagtttttttattaaaaaaagctattgatgcttattattggtcacttgtttttttattcctgaaagagataaaaaaacaagacaacacatatgaaaagattcctccttcgtcccttggttaatcttcctggaggaggttaataaaagggagaaggtttcaaaagacaacatagacttgacaaaatgattcatttttattcatcttatatatcattctatcatttcatatttagaaaaataatcacatatgtacctttggctttacaaagaaaggtatagagatacgacaaaatagcttcgaaggctgaccgaccgacttagttttccctcga

SEQ ID NO: 708 - DNA, 1073 bp, Zea mays
  misc_feature (1)..(100): optimal_loci_13558_G1, chr1:74612444..74613516, Cluster 5
atgggtagagcatgcttagcataggttttatttatgcactctaaggacattgatctcatcatgactttactaaggacatggttagttcattaggccacaagattcattagcctagattttagaagaacttaggagttaaaaacctttagggaaggtttgatgatcaggggtcacgaggggatccatggtcagcgaatcaacccttagggtttagattttgcataggttagtgtttgtactttattttttagtctaaatctgccctttcttaggccatttgatctttatacttgatatccaagctttgttgcttgtctagcaatcattggcttgagtaatggctctacgagggagtgctacacttaggttcaaggggaggaactttcattattgggaagcctgcatgaaaatgtaccttgaagccctcttccagatgtttggtagatgtaaacattggtcatgacacacccttgacctcaaatcatgttaagtaaaattcttgtgataagaatgcactctttgaggaaacaaatgatcaaaccttcaatagggtatatagttaggtcatggcctatgatatttggcaagagctcatcaaccttaacgagggcgccgttgctattcataatgagtgatatgatatgctcaagaccaagctcgacacttttaaaatgctcccaaaagaactttgtaatgaaatttatactcagttgaatgtttttgtatgaatataaaatatttggtctcacatagcttaatgttagagaaatcactcacaagatcctcatgactctccacaagcttaaacaggaccttgttttgtccattctccttgaggggggaccttaacaagaaggaagtttatgagcttctcaacaaaatctgggcccatgagacgcggttgtattctaaacctgcaataggcatgtagataataagtaatattgtagacaatacaaactttgtcgattcatggattggatgtgtaataagtcacctcctatgaaacttagttgttttggtaaagtgaatggaatgtgtcttatttcataatgaatgtcagcctcacacat

SEQ ID NO: 709 - DNA, 1026 bp, Zea mays
  misc_feature (1)..(100): optimal_loci_136225_G1, chr4:23161932..23162957, Cluster 5
agcacacagctcctgtcgctggctaccggagcttgtccgttggaccgcacctcgccgcgaccctcccctggctgcccgagcacatccatggaccgtggccggttggcgattgcccgagctcgactgtgcctcgcaggtcgcagcctcggcgcctcccatcctattgaagcagtgaggttgtgtgcttgtatgtgcaccacatagcacaatgcacgatattgagaaagtgagccaatgatagtgaggaattgaggattagaaattgagaagaagtgagtcagcaaggaacaaaggattatagttcgagatttttagaggaagtcgtcattgtccactgccatactttatttttgggtcctgctcggccactggctgcagctgcctgcggcagcacccttgtaatcagcacacacgagaaaggagaaaccacgcagaatctcacacaagtaggcctgcgccgcgcgcctgtgcatctaggccgtgacgatcatggcggcggcctcgctgaacatctccggcctcgggctcaccagcacggtctccgcaaccgtcggcaacctcacgtacctcgagtccctcatcctcgagaagaaccagctctcacggggccaatccaatcctccatcggtgacctcacccaactgctggagcttgatctgagcagtaatgcgctgagtgggtccatctttgacactctagccaacctgacccacctaacgtcgctcaacctctcgggcaatgccgtcaccggccacgtccccagggaaatttcagcctgccatccttgtcgtccgccatgcaggcccctaccgccatggacttgtctcacaaccagctagacggcccgcttccctctgacgtctctggcctcaccaaccttggtcaggtagcgctatccgggaacaaattgatagtgacgaaaaaccaactgcctcgctccccgcccgctgcctcgctcgccggacgtttcgttcgtgaacctacgcgccaccttcgtaaagccgccgcgcgcaggcgcgcctcggt

SEQ ID NO: 710 - DNA, 1261 bp, Zea mays
  misc_feature (1)..(100): optimal_loci_137606_G1, chr4:30438627..30439887, Cluster 5
gggatagagagaggggcgtaggttgaaaacatgctgatcttagataccattatggatacaagcatacaagatagaggtttggtgtgttgaatacggaacgtcctacattctctttgtgtttgatgagaattctaagaaatcggtcaggttggttctcattatttctctgcaggttcattagtagaaccaactagagcaatttttgaaaccacctaggctggctcttcgggaagccccaaattggtttaagttttaatccaatgaatataaggccaatttagaagattggatcactcccattatggattatttatgtaacataagtgttaatgaagttgataaaagttctttcgcaattagcatgcaagtatattctagttaataattgtttgtattaccttactgccgaaggtttgccattgttatgcttgaattaaggatgattacgccactttaatgcatatttaccaagctttgattactgattgttttgtaagtaacacttacaaattattgtgcccactgataatttctgaaatttggctatgaatgaccgaaagggcaaaacgtcagtctgaacatttcgtcagtcgttactgaatgttcgttaataattatcgaacatttctttactgcagaaatgataaattactgaatgttttgtcagtaattatttttttggcactaacaattattgtgcttgctgataattattgaaattgagcgatgaatggctgaaatagcacaaaatactgaaagatgacgtgtcgcgtgagtgggcatgtgggagtcgtgggtggccacgtgcggctcgcgatccattagtggattgcggacccaaaacaatttggtaggttggctggttcgtttggtggggcatatggctgttcggttagatttaggtgaaactttaccctctgtgacatatagcatatgtatatataccagaggatcacttttaattgaggtattccaactaccactcttttatccttccaatcttcatgcttctaagttctatgctttggtgatccaaggatgttattataggcttgtcagccgacctagagcaactcgacgacgtgcttgccacaacgggtttctctcgaacaagaactttgatggtttctttactagattgatcagaaactagctagtcattattcgttatgtaagtatgattttctatcctttaattgtttggttgtaaacctcgacggtcttcatggtgaaagcgtgttggttacttaattaattagta

SEQ ID NO: 711 - DNA, 1060 bp, Zea mays
  misc_feature (1)..(100): optimal_loci_1379_G1, chr1:7268512..7269571, Cluster 5
ctggacatggaactcaaagagcttgtaaaatatgcacatctgctataacacacatcagacatgtttggtgccatgttcgatgagtgcatcaaatacctagtttagagccatcaaaattatagcagttgtagatgcaccaaatgtgttcgctgcggacacctacggtgcaccagacatgtccagtgcccctaaaatctacttaacaggtaacaattgtattcaattgtgagtctacaaataaaccttgtgcccgaccttagctactacctcaacacccattcacttgtatacacttctaaataggtaagaaacatactccactcacttgcattctttggatcatcatttgtgagattggagagctcccaatgcattgtatttagttcttacatcttgtgacactagttgagcgacttgggtggatcattttcttgtttctcttagtgattgttgtcacatatatgacccaaagttcatagtatcgtggagtgtctattagaagattgttgtcggcttcagtcattgatcatgagaagatcttgtgctcattccctatagaagattcaagaaaaacaactctacttgagttgtgattagttagagtgtatctctaatgtggttctaataacgtcttaattgggcgcttgacgtgttattctatttagcacgtgaaccacctagtttggatgccacaatgaggacatagattgccgataaacaaccgaacctcgatgataaattggtttattcacttgtttgattcagtttgatcactattgtacttgcaattacatttatattattgacttatgtgtagatacttaagtaactctagtgtagcttattattgtaactagttgtttttaggtccctagtgattttgtgttgccgctagttagggtgctttttaagtgaaatcaatctagtgacatagcactagatttatttaagaagtcatgcttcttttagaatgagagttagagcaacaattgcgtcaccttttattctaattaaactttgcactactgttttataagatcatagggaaatttttatagac

SEQ ID NO: 712 - DNA, 1109 bp, Zea mays
  misc_feature (1)..(100): optimal_loci_139637_G1, chr4:43642750..43643858, Cluster 5
gcaagtgtgtctatggatggactaagatgtagactataagcccaaacagtaggctttattacacactccgttccaaagtatagtaatttattttacactaatcatatatttattaaatatcatatgattgtagtttacatgtatgtctatattcattattgtttgaatggatgtgaacagaaaaacagtggaatagaaagaacaatactttagaacggacatgtggtcagcagaggatcagaggtgacgcgctttatttagcaggcagaaaacgaagctgcacggggtgtctgaccgcccagcgatcgagaccaacctagctaggttagtaaactaataaccccatagcatcactagttaaactaactcatgcctaggtattcgtaaaacatgggaacatgccgcgtagatacgttcgtcgtcgtccactacaccggaaccgggactttggggctgcggtttgactgcgtgtgccttggtcggtgttggccgagagctccgcggtgagcactactaggtcgtctcgccctcccatctcgtgctctcccatggctttacatgggatggaatgcaagcttcagcgtacagactcaatgcatggatcggagaagatgatgctgagcgacgaagagctagtgaactttccgccacacatatccgtcgctatcgatccatctccggacaggtccaatcaaatcgaatcgagttccgtcgcagcatcaatacaccgacacacacacagcgtcctgagcttttctgagcgaagtcgacatgcatgttgccatgttggcccctttgctgagggaaagagctggaactaaaagaacatgcatattttcatgtgggcaatgggaacagaggaaagagagagaaggaaaaaaaagaaaagaaagaaacgaaaagagaaagaagggggcaaaccttgagctatttgctgggattgacgtttgcccaattgccctaagctgggtaaaagagatttgagacctgaccacttcattgcaatgggggaagtaaaaagggatttgggtacggtgggcaaagcagggacaaccagcagagcatgtgcatcattagggctcagggtgtgtttggttggactgaaagtt

SEQ ID NO: 713 - DNA, 1151 bp, Zea mays
  misc_feature (1)..(100): optimal_loci_141_G1, chr1:656003..657153, Cluster 5
tttttaaccaagctaacagaaataatacaagaaacttgcagctttcaattatgcaaggctccccaaataaacagataacagagtactgaaatgagattggatgtcataattaatgtaaatttaagaaatcataggactaaaatgtaacacagtcgtaccaggctcacctttcgataatatcaagaaaaatgcatcggagggttgaatcagaaaataaaggttccaacctcttcatttgagattcattgtcactatagcagcttgaaatagatagaagagaatccatacaaagccactgaaataaaaattaagaattaggagccatccaaactgacttctttgtgtactgcaaaaagaggcaagatattatcctaaccttccaagtcatcaaaacagctcttctgcttcgcgtcagagttccctctgtaagaagatggttgatgttgtcaaggaaagtggtgaccaaaatgtccaatgaaaacttgtgggcttgatctgtctgcttcgcttccacaaaatccaaaaactgagtactggaagcagtagatagaactgccagaacataggcaagagcttcataagctgccaggtgaagttcagctccgatcttgtacaggggaaaaaaagagaaagactgactttagaatttatgtaaagaaagctaacagaaaggacaatgaaaaagaataattaagtaaatcagtaaaaagttgtttaaaatagcaacatacctcattggcaatagtggagtgatgggtaacattcaaatagaagtcccatagcacggaaaatgcagaagaaacagaatcatcggagttgtaaggattacaccatgaggcaacagaactaacacatcgcattgaccaaatctgtgaattatgaggtggaatttgtcaaaccaaagcaactgtgtgttgaggtgtacttcaaaataagtaagaacaggtgtgtttggaccagcacagcggcatcctcatccgtccacagacaccatgtaatcctcacttctccatccagcttatggattgtaccttgctcccacctcagaccagatccaaacacaacagagaagcagatcccatcaatggccacctctgcctgtgctgcttgcaccggagagatccattggacaatgcagatactaattcatc

SEQ ID NO: 714 - DNA, 1049 bp, Zea mays
  misc_feature (1)..(100): optimal_loci_142744_G1, chr4:62324280..62325328, Cluster 5
tacaatccgcgggtagataagcagatacatggtcttgcgcttcacgaacatttgaagaactatcttattgcgccatcgacaaccttgattttagctttttatgatttctccacattcccctaattccttttctttaataccgggcttaaacccttatttcattccattgcatgaattctggaccctatatatggattttctagcgttaggaatcgtatttcttttaatcttgggtattggggtagcaaagcaacaactaagataaagtaatgaaaaacttttcactatagaagtaagaaatatatcttcaaaaaggcaaacgagatttattccgtagcgtgcatccccataagggttgattcgctttccagactagagaccatgtgccctttcttcgagctttcactcataaattctgactacaacattgcttttgttgaaaaaacggccaaagcatagtgatccaccgcttattcgagttagtactgaaaaaagagccagataaaattactattttttcgtaaacatggtttttctatttagtcgtttcgagcacgctcattaaactaaagagttcatttccctatttcctcattcaatctccaaaacgaaaatagtacttttcttttagaacgttcttcccgaaccagtataaatcttgtgcccaccgcacacatcctccggagcccaaaacgcgcacaataaatttacttatcggagtgaggttcgaaacatcgacattaaggaaggcttgggaatgtataatatctctttaaataagaggatggccaccccaagacaacaatctcttctagtacttgcattttagttgctagtcctttgtttgttcaacctaaatatagggaaggcctaggaatgtataatagctatttaaataagatgagggctgccccaagccaacaaggcaacaatctcttctagtgcttgcatttgagttgctaggcttttgtttttgcagtttagttcattgcaatacgaagtctgtctttagtggatatggtaaaataggggacgtgaaactgtagatg

SEQ ID NO: 715 - DNA, 1013 bp, Zea mays
  misc_feature (1)..(100): optimal_loci_157634_G1, chr4:160350179..160351191, Cluster 5
atttaatagaccggtccgtagaaacacaagagtagtctccacttcatcatcaacgacgaaggggagatggtcagggcctcagaaacctgaccccctccacccgagagccccgacgccatcacggaggccctcaacaatctctgacttgacccgcgggagcaagaggtggagcaagactcaacctcgctctacgtgggcaaagagataaggcagtagatcacgatctttatggagcccgacccatcttacaacgatatgtggacattcttctcttcctttgcgagcttgacatcatagtgcatcgaggaagggtcaacctcccctgacgattttgacgacgtcccagttgtgttctcgccccgccttcacaacactacgaaggtgattgtcaccctcatggcctacagccatgttcccatgatcgacgacctggagttcacggggatggttgatggtggcgaagatcttatctttgacgccctccgctaggactctggctcagatcctggctccacaacgagtagcgaggatggaccctcagttacagagagaacaaaggtcgtctggccctcgtggctctaactgcccttacgcgtgaccctgctcccaggaagaacatgtgacactaacgacactagggaaatgaggcgctacacacgatgctcctatcaaagacccctcatggttctaggaaggagcgaattcttactccggtgtaatccctaatgatcagcaataaaatgcgattttgaaaccactgcctgagtcaggcgtgcgaaatgggtagcaagcctcggtctggggacaaactgactcccctatctttttctccaacagccaacatggcgaatgacaagatgaatgccaggaatatgggtcagacaacaaaaggatcagagcaacatcgagcgaaagccttcctcgataatctagctatgttattcttcctttccaatactgattgttttaggattacttatttatgttaaagggtcctcaacgatatgtgtcac

SEQ ID NO: 716 - DNA, 1348 bp, Zea mays
  misc_feature (1)..(100): optimal_loci_158803_G1, chr4:167297441..167298788, Cluster 5
tctaaaactaggctcaattctccatttgtaatgatgatgccgctcttttcgcctttcgatcgggccttttggtgttagcaggctagctgttggcatctttgcatattgctgtgaagatgaacaatataatgtgtgtccgtccgttcccgcaagtcacacggtagggcactggtagctgtgtagggcagtttccctgcaccggccggccggccggcatggaagacggagtacgtgaaattagtgtcaggaatactgccggcgttggttcggttccaagcggagatcgagaatgaacaacgaactcatcgatcgatcgagaattgaaactggtaacgatgacagtgattgtttgtcatctttactaaatactaattgccttgtgatcacggtgtacgggatgggtgatgttcttctctcctgctcctcctgcgccgttcataaggaaaaacagtttctctttcgggaaaaaaggagaaaattttccaagcagcgcgcacgctcagtggcaaagccaaacacacacgcacacacggtcagagctcatgtaaaagttcgagacaaatacggctttctctctctctctctcactctctctcgattcaacagtttgatgagttatatttcaggaatgtggagtaatatttgatttgctggtggcagacagtttcatgcaaaaggaatactatctttcaggtgtatatataccttttcctttttatgagatcgatcagcgacctgatgaactaggtcagccacaagccaagtaaagtcaaaatttcctttttctggtccaagtctaaactgatggtcggtcggtcggtcttcctcttcccaagtcaacaaggtttctgtagtcctgtccatcactatccactagtagtctcctgatcctaacaccaaaggccgttgggttttcctcaggcggaatgctcaagtttggatggaatattccaattgctagcgagcaagtttggcgcagaaaaccgagtgtcatgcatgctacattgctactagctagactcgaccaccggactgccggtgaaaatgttcagacgtgctagctcgtagatcacgcgccaatcaaggtttcttctctttcttctttttctccagcgtcatcaaatcagagaccgattaatgtggtcgttgtggagcgcgtgcaatggtgcaaaagtcgtacttccatcttaaaataatatttgttttagagtgttaatggatcaatacaatatttgatgtatgtgaatccatttgattatgcatgggcaaaagaaaatttgtagttaatggaaacctgttactttgtagttacttttttttcattattgatattgtggatcaaaaatac

SEQ ID NO: 717 - DNA, 1069 bp, Zea mays
  misc_feature (1)..(100): optimal_loci_160625_G1, chr4:178752526..178753594, Cluster 5
tgcattcaaattagggatgacacccgtaaaatctatcacgatcgcacccatgggtacagtaccaaacccgcacccgaacccattgggtttcaggtgggttttaggtcacttgcgaggttttactaagtgtccacttttacgcaataatttaggtataagcaattaaatactagcaataattgagttttatctacataagtcaagccttcccacgttgagcaacaataaaacatttcatgaaacatcagctaagttatttattaaaaacaattgctattgtatcttaattatatttgcacaaaataaagaacgaatcaatttttaggatgagagtgggtcacccacggattaaaatagaccgcgaaatttcagaccggtgcgggaccactgggtcaaattcttcgttcgtactcgcacccattgaatcaggtcgggtgcctgtcaaattttagatctacagattaaatggtcattcctaatttgaacagaccttgatatgcatgcatggatgccgagatgactgcttagaccagtactccagtagctacagcttttatttgcgatgatgatgaggggagatgggtacgtaaaaaaggagtaaaaggtgcccatcagagagagactttgattagtcggggagagacgatagatcgcgcaaaagagccatagcacgatttcgctcatgataggggtggatgagtagaaacgaaatattccctttgtttttcccccggtgattggataaagctacatgtgtccaaagtaatgagtgagctgataaaaataaccagcttagctatctgatttagatcaatcaggtgcagtcactcaaaatgacacagatcaggttggttgtgctgttgcttgaataacactagtattaacttagtcctgtatgactggcctgtatctgagattctgttaccctctgagcaaagttaattgaagcttccaacattaaacaagtcactaatttgtaccagagaacacagcccctcactaattaattgatcatgtgtacttgtaacggttgctaatgattccagaccagaaactcccaccactgcgg

SEQ ID NO: 718 - DNA, 1210 bp, Zea mays
  misc_feature (1)..(100): optimal_loci_160669_G1, chr4:179076477..179077686, Cluster 5
aagacccaacatgatgcaaaaataaattattattttgttaatttaattatcatcttattttgtccatcaaacaaatgcttcccaatacgcaattcgtatacgcaaaacatatgttttaaggaaataactcctattacataatttgtactaaaagatagtttaacttaacctatttagagaatatctctaaatatattatccaaaagaataatttaacttatataagattgttcattttaatcttttactatgagctatatttattttaggagatgtgacttacaaggtgagaaaattttattaaaagatattttgtttcaagatctcaagtatctaaaataaaattttagggtgttacaaaacttgtgttcaattctaaactccaattcagcgacacctaaataatagaattgaaattacatctcatttcaataccttaacagatttggtatcgcacccaattcaatttcataccctaacgtccaaacttaagtattagagtcccgtcacgcggcatgggcctgcccacgagtttgagcgcacgcaagcgtccccgtccacacgctatctgcacgacggactattttacagctgctacagtctcgccgcagcggtccggtccagcactcctgtgcttccctaccgcgatgcgatgcagccttttttctcaagtggattcgtactcgtacggccgcatgtcctcgagggcgtgctgaccattccgcttctcactcatcgggagcttagattatctttttaagggctgatttggtgattaaagatccctagggatctatggggaggaatccccttgtaattcaattttaaatagcaagaggatttcttcctcttgggatcccggtcaccaaatcagccctaaaaaaaagaaaaaaaaaagagaagaaaaagaaacatcatacgagaaggattgtgcacggtaacaaagaatcctgcctccggaagtgaacagcgtttataatcccctctcatcgtcgaccccctgatcgggatccccactgttcaccaagtacacccagcgtggacataggctaccacaagtagaaacgctaggcctcagcactagcttccggactacgagtatagtactccctccaaaaatacagacgggaacaggcaccgacaacgacgacgcgagcatacccatcagtcattccatcacgtagaaggctgccgacccgtccaatcttgg

SEQ ID NO: 719 - DNA, 1046 bp, Zea mays
  misc_feature (1)..(100): optimal_loci_161510_G1, chr4:185197333..185198378, Cluster 5
gttgtggcggccaaatcgagcgccgctgattaggcaggctgtggcagcttcggcgccacaccaaacaggccctaaagcttatgacatcggatactttctcctgttcgtacctaggctcatttccaaacatggcggattggaaatggaagcatgcgcggctgcctagcctagcgacgacggcgcacgacggacagggggagcgcgagggcaaccaggaaaaaggcgagatccttttcgtcggccgggaaaagcgctaaggggaggaaacgaggcaagccaagaacaagtggaaagccggccggccggggtccaggccacgatgcaatgcaaacagccttttcacgaatcccgttgccacgctgatcggtcgatcggccgggtagggtattctacactgctcctccatagtttttccacagagaacaacgacatacaatccttcccatccgagaaaactaaatacctttaaatttaactagatttatctgaaacactacaactatttatgcgacgacaaaaaatatcttatttattcactttgaatttgttaaaacttagagtacgtactttgataaaaatatgcatggacaccatagttctacacgtattctttttcttaattagagcgtactctagcacaaaatgattgaagagaaactccctccctgccttttcgaaacggctgactttgctgaagccaaaaggaccaggacgtacaagctagatacggtcgtcgctggacaaaatatatatatggtgtctagcttggtcgttgactggttttacttcaacgaacgtcaacgtcatcacagattaattatacaactctactagctgttttcttttgtgtgatgtcgtaaggtgctaaccccgcatgcaccgagtagtagtatttattttatcaatgtcacaaaaccgcgaaggctaaaccacaaagaaaatcatccttggctgtaaatcctcgagcaaatttttatcaaggatagaggataataaggggagttgcttttcttggcggttttggcgcacccaaagatgattttttt

SEQ ID NO: 720 - DNA, 1330 bp, Zea mays
  misc_feature (1)..(100): optimal_loci_161613_G1, chr4:185648311..185649640, Cluster 5
cgtgtgagtgagacatgtctttgcacacgaagatactcatgcagccaatagggtacaaaatactgtgcttgactgataaaacaagaaggcaaacaatagaatctattcttctttatatggtcgctaagctgaaatagtttattttttattgcatggagctacttataactgactaaacgagtatgcatgagcacaggcagctagctagcattgttgaggccgtcgtcagacctttcttctttctctcgtcacatcatccgccgattaaatcgcaattaaacagccgacgacgacactgtccttgcgcgcctcagctcggacgcgtcgctttcggacgcattgtattctcacacgagtactctctcctgatcgagggccgcgagggtagtagtagtagtatgactagtatcatctatttagggcaagctgccgccggtgccaataataaaggtttcagcttcgggccgggtccatcgatcgcgtcgcctttgcagaaataaaggagacggcaactggtgtctgcactctgcagccaatgaaggttcgactagacgacttggtacggaatgtgtgcgtcgtcgtcgatctcactcgctcgatctgcttgcttgcttgctgcacatggcgaaatgcgttcggtcttgagaaaatcagagcgaggaccaccccctccccccgccggtctctgcagctgaagtaagccaacaagtagctagctctctgcacagaaagactcgttttcctgcttgtattgatgatatggtgagctgtgatgaagaacgacgaaggtactgatgagcttcgatcgcacaggagagagttcagaagaactgtttagaaaagaactgatagatagaaccctagtccgatccgatccatcagcgttcggagtcactgaactgccttgtcaggatgtgtgctgcaaattaaagtcggttgttttcaggtcgacgctccagctagccagttcgataaccgaaggctgatgatctttgcctggtgtcgatcgacgatcggaacagagatgtaaaacgccattggatgggagtatgagacaacgaaactgatatatcgtccccagcctgttgctatcgctatagagctatgctgcagggagtttgctgagaggcagtggagagcttgttgtctcgatgatctgccgtccactggtccatgcattgcttggtgccctgccattgcgattaattaataagcatgagcaacaagagccataataataatgccgtatgctggtccctgctgcccctgccgttggttggtccctcacgtgaaactccagcagcaggctactacacaccaaggactggac

SEQ ID NO: 721 - DNA, 1216 bp, Zea mays
  misc_feature (1)..(100): optimal_loci_164362_G1, chr4:199008017..199009232, Cluster 5
ttactggcagagatcgattggctactacacactcgatcatgtggattaattaatctcccacccccctacttgcctgcggagcgcgccaaacctgtatgcctgtctgtctgctgcgggcacgcgcgcgcgtaaactagctagctagctagacatacaagaggcgacgacgacgacccttgggtagcacaagcacagccaagcagccagcatgatgcctcgaagctgcgagcttgcgacgacgtgtacataccatagcaccatgctgctcgtaggagagaccaccctaccaacacacatccctttctttaaattctctcacctgctgtgtagaatattgcacagcgacgcgctttctctgtctggccctccctcccacgccccagccctactagcagcgcaggaaacggcgaccaccgagatcaggtcacgaggcacttccaagtttcgactctccttcgatgaaccggtccttccttctcctagtacgtatcaggtgtttccaagcaggcacaaaccagtcaatcacgaggcggcctcgatgcggcaccggcggcggcggctgggcatcgatcgtcgtggcgagaggagggccggccggtgagcgagtcaccgatgtatgaacgaaaagcattagcaaagaagaggttaaaatgatgggttttttaagctggtgccctcagttttggtggtgtgttcatttatatctttagttgtgtttttttctcagttctggctttttaaaatgtactgcctagtagtagcctagcataggacactttgctgatggcaaaattaagggtatgaattttaaaaaagccatcgttataacccatgcatgatggcgactttactcgaagcagtcgagcaaaaaatgatgtgcgtgtgcgtggcgttgtgggctgcaggggaggggagggaagcttggggcactgcaaactggctgtttgaagggtcacctcgtatgagtatgaccaatccatccatccatctgtcaaactggctgtttgctggctcaccacaacaggtggctggagtgtgagtggatcagccagacaggcccagctgcgtgacttcagactccacgcttcccaatcctgcactgtcctttttctcccaagaacggtgccttccggcttctgtccatgtctgcctcctcatttcaccttctgactataagctacctagcctctaggctttagctacccaccggcgtact

SEQ ID NO: 722 - DNA, 1296 bp, Zea mays
  misc_feature (1)..(100): optimal_loci_164520_G1, chr4:199728962..199730257, Cluster 5
catccctacacttaacgtcgctgccccagcctcccctccccaccctctctgttttcctccccgccgccctctccctccacactcctcactcgcgccatcaccgttcttgtcaacctctcttctcacatcgacctcttatctgctcttcctaagatcattacgttagtatgaactatatactagtataatatagatttaagtaatgagatcgtgtgacttattgtactgtcactatcgaaacacgataagcatattttaccatcgggaaaagttcaaatttcatacgttttgaatatcaatcggtcagaagtattggtgagttcaatggatagaaccggcatcgacaagttctgctatgttgtgtctagtttccattcgcatggcagcatgaataaaaccgtgctgcaaccgttagatgagagagagaaaaatcagctttgcgaacaattagatgttcagtagccaaaaaccggcaggaggtccaaagaagagggcctaagatgcacgaaatataacataaatggtaacgataatgattcacacttgattaccgacagtaacatgtttgaataagacaatatcaatttttagtatgatatctagttacatttgtacttaaataaacatagtttaacgttatcatttaccgttcacgttacaaatatgtaaactaaacagcaccttaactaatagtatgatcccattgctctcagtcaagaacttgcccatgacatttgcaagcgattttcaagattatggacattgcttagatcccaagccctgacagaactttgttagtccggccgcaaacgagggagggatccacagccagccagccagccagctccatggcgctgaagtcaggtcaggaccaatcaaggaaacagagacatcatgcacggatctgtgtgtgaagacgtagctggcatgcatgttgcatggaaagggaaggcttgcaagcctccatgtcctcgtctccatggagacgtcgccgtcatggacagcgatgagcactgcctgctgcgtccaggaaagaaggcatcgtcaggtggccggttcgccggctgcgtgcatggtcgggtgtggccgcgtcactgctcattgatgctgcaaacttgaatggatccggactaagacccaagatcccttcggttcagttgaggaattgagccccgctgatgacatgtgctggtgtgttcatccaaatatgtcagattgcacaaacaccgggtcacatgccatcaacaccaaaccatctgaaatcaacgatgatggccccttcagagcacgagcgca

SEQ ID NO: 723 - DNA, 1120 bp, Zea mays
  misc_feature (1)..(100): optimal_loci_170572_G1, chr4:230939937..230941056, Cluster 5
atgatactccgacaatataacgtttagtggtatttcgagctacccctatcaatcattgacccgaaataataaatcagcacaaaaatttgcaaaaaaaaagtttaaatacgagaagaccccagtagcgcaggtagtcacatgtcacgcgagtttcatgcatgtgcaaacacacgcttcgatcgcgcgcgtccgctctgggctcaaatcgtgacgtcaggcggcctcgtgcatttttgaaagtaaagtatttttatactatcgcacatgaattatcgtgttgccggccatccctaggaattgaatttttatagacggcccagccgtgcgctatactacaacaccttggttcgacatgtgctagctatcataacttatatgagcaatatcgtgaataataaaccaagaactgttatatctaattcatcaattactacttttaataaaagcactcagtacgtactctttatacagtcgtgggggagtggagggacatatacggattgtgacaaccagaaactcatattgtggctatgatccattttctcctctattgtatatagccaatgtgctagtggatgctgaggataacattttatgctaatcgtcttcttgaagatttgaatgatcttgattggccagctcagagtgttaaagaaatgcaaagaaattaaactgggtaggtagatcgtcaaaagcttttgagcttgttttttctgtagttgaccaggaaggatatgacctaggtgccactttgttggtttacacaatataatgaggcctgacacaatttttggtgtaacgtggttcctttcttttttgttcttttgtaattactacggtttatggacctacatggacaatatatatagatatgacttttttccgttgttgtttataaataatttatgagatattaaggtcaacaataattcatatgatgtttgtttttatatagtcgttgtactctaatattgtattgaataatttgtgtatcatcataacgcacggtcattgtactattatatatttatatatacatctttacaaatataaatcatgtgtttcgtcgtgcgtcctagcaatttttttgcaaaaaacatcattatgcttctttgaaagt

SEQ ID NO: 724 - DNA, 1283 bp, Zea mays
  misc_feature (1)..(100): optimal_loci_173125_G1, chr5:4297775..4299057, Cluster 5
gtatgccctctgtcctagcgtaaatgcatgttattgctacattcaactgtcaaaatcctgccgattctcctccagtctgatgaacattattattaaatcaaactccagagagaaagaaaagatgaacacgcattgagtcagacaaactcccgaatctcgataccatgtaagcgatagatgttcattttttagctgaattcgtctttgctggtttgttatgatagtttcactttactaattaactcggttccgatttgtttattactgcatgcgtttagttgctgcattttcaagttgttattactactgtgtgatattgcttcttacatatacggctatttaatttctagtggcagctggttttgtatccaaatttcaactatgatgaggaaggaatgattcagagctttggctagctgctacgatacgagcccgggagcaaagacatgaacttccataggtacttgcaaaatcacttattttatgatatctgatataagaaacatatgcacaaacataaaaaaaaaggctcagcaaaaatatttttttttctagtgctggtaaggctaagattatcacacgattatataaataaatgaaatattattttatatatagactgtacggattatagagtcgaatatagaagttgacataaaccagggcacgatgaaggattgaaggcacattgtcgtggcttttctgtttggccttgctctcttttgctaagccgaggtacagtcaacaaggacttgggcttgaccgcttgactaatgagcaatgagtagtctccctcgctctacacgcatgcatgcaaaaggcagtagcgatcgtgctccttttcctcccaggctccctgcagcagctgcagctctgcagcccatggagaagaaaggtgtcgtcggcagtatttgtgattttactaggaggatctggtggtggtcccgccaggctagctcctgttatgctagctagcgatacaggttagctagctagtaggcaaagtatcgtgacatctgacatcctcagccacagcccacacacaagggggatgaacacaaatatatatataattgtttcaaattacagtaaacttttggttcaaagcgtaaaattgcaagggtgcgcgtgcatgcatgctcacctattttgcagtttgcaacttgcaggtgggaattatttacagtactaactttattacaaactataaaatattatatttttctgaatatgtagcttatgttatataactagatattttaaaaaaatgagaatatttagta

SEQ ID NO: 725 - DNA, 1269 bp, Zea mays
  misc_feature (1)..(100): optimal_loci_173819_G1, chr5:8511039..8512307, Cluster 5
gtaagccccccagttccaactccacacccctcttctgtctcctggcctcttctactcgacgacgactcctcccgcatgttccgtcgtcttctaaatccgagctttagaagacgacggaacatattgtttctgggcaatattgttttgttatgaggcgatttttttctagtttctcttttccggtgggcgtcagagcgctgttggcgctttcctagattatgtgcgttatattgttagcctctttagcgtattctggtacgagcaaatattttctcgtggcttgaattgttgtgcagaggtaggacttggttatcgtctgtgaaggtgaagagtttatacgaaccagtttgactttgttctttgggaaacattaaaccattagggtttcagtcttgttagctagaggattactagtacaatttgaagcttaaatgattcatcgcatagtgctgcatctttgtgaatcttgtacctcgatcagggtactcgtaaactcatacttgagtatgatttcgaagtccagtagtcctgctaggctcgattcctgtaattatctcgttaggaagttccagcaaccatgacttgttttctgtcaggagtttaagtaaacgatgagcatgattcagtttctgcagaaaggctatgttaccagtggcattttattatctaggtatttatttgcccggttttgctggaggctatggttctgcagaaaggctatgggtttgctgaagggcctgccttgaatttcgtatttattttctgcttcaactcctcagcacgtttaactacttgcattcagcattgcgttgcatggcttggtgacattggtcacttttctattgtcttgctcgtgctatatccatacacgtttaaaaacatagtctcattccttacatctctctcatacatataatgttcttttttttgtacttttgaataccatcatgattgagacgtcatcattatgtcatctagcttaacaaaatataatcctcacttagcttttggaatgtttctgcaatgttggtggtggtctctgaacctcaacttgaaaataagttcctgtggactgctgccataaacaatcagatcttgttaataatggtagagcatctgctgtccgtctatttttgtcatgaaacttcgatggtgtgcctatgaaattttatttcttttgagtcactttttcatgaaacagtcaagtgatatgatgtgactgaattgcacctaacaagattgtatttacttattaattcaaattgacag

SEQ ID NO: 726 - DNA, 1121 bp, Zea mays
  misc_feature (1)..(100): optimal_loci_178513_G1, chr5:33560247..33561367, Cluster 5
agggtcaatctctggctccgcaacctttttaatggcacattagaattgattggcatcctcacgatccctctgcttgatcaaaaattctcttggaccaatgggagaaaaaacccaattctggaactccccgatcatgtgttcttcaacttggccatgagtatgaccatcaactcccatctttctagttgtgctcgccctacctccgatcacatacccatcattttatcccttacgactagagcaccaaagccaatgaccttccgctttgtgaatgcttggctcaaacacaacaacttcttgcccacaatcctaccagcctagaacatatcgtcttgtggtacctagtacctacacggatggcatgcttgcttcaaggaggggcttagcacccaaggagagcctgcattggctctagatgttgatgacttatatagtgggtgcctaaatatcaacccgaaacctttgctactcctgtttacaggtacataggcatggaacatgatcaaaggcatgggaaaaaatagtgcatcagggccagacaggttcagagctcacttctacactgctatctagcaacatgtggctagcactgtgatgtctgttgtcactgacttccaaaatatagttgtcgaccttgaaaagatcaaatgctcacacatcatcctcctcccaaagaaaaaatgctactacaccaatagacccccatcccatctctttacaaatctacagtgtcaaaatcatcggtaaaatgttgcaactcgcctatagaagcatataagcatcaacatcaatccaaacctaactagttttatccatggcagatcaatatatgaaaacttcatcaatgctctagatttggcgctaacttgacacaagtaaagggtcacaacgctggtaatcaaactggatttggtcaaagcattgaacactgttaattggaaggtcatgtccttaaccatggaaattagaggtttcccatgcaatggagctcatggattgatcatctgctctccacattatgatcttccatcctcctccatggttgcccttgcccatggttctcctagaagaaagggctaccacaggatgacccaatctcaacatacctcttacttcttatc

SEQ ID NO: 727 - DNA, 1011 bp, Zea mays
  misc_feature (1)..(100): optimal_loci_182673_G1, chr5:58726001..58727011, Cluster 5
gaaactactactactggtggtcggcttgattgttgcaacccgaagtttgactagcgtaaagtattgtctcgccgtttaattgacgagtggtgcccacgactctgcatttgcgtcgatcgatgcagcgttctgaccttctgcaaagaatgcaaaggtgagggggtcaggggaggagtgctggccatgtcctgcaagcaggactgtcagttatctgctctgacctgggcacaagtgttctcttgtagccgcagcgatgaacgggtggagactggagacgatcatgtgttccgtgaacgcatgtagctggtgaacaaaactgaatgcttgtaagcaagcagaacaaaactgagctcccgttgtatcataaccaccaagtccaagagtattgatgcgctttagaggccggcggggttgtacgctgcgtgtttctacatgttctgtagcttagtttagtagcccgcaatgtgtccaagacgttgcagaatcgaggcatttttaccgcgtgttcaacggcggcgtggctatgttcattctctgacactgtggtggacaacgtagcagccgtttctttgagtatttatttatttacttatttctgtgggtgtcactgaaaaagttggtaataaatttacgaaagatggcgccgttggtgttggaatgggtttggttcggcgctgggctctttcctactgtattattcatcgagccatagggcactcttcggactgggccgtgccgctcgctgtgtttggggtggtggcccaggcaccgcgcagccctaggcccctccccggtccaggctagcccggatacgtgacgacccggccgggatcatgtttgggctagaaaaggaaaaaatcggattttgtggagaggcttttagccccctccaatatacactctggttctggttttgtggcttacaaactagcattaagataaaataaattaatttatattcggaaaataaaaatttctttagaaaaacagggttccaaattaggctttgtt

SEQ ID NO: 728 - DNA, 1018 bp, Zea mays
  misc_feature (1)..(100): optimal_loci_18698_G1, chr1:104628886..104629903, Cluster 5
  modified_base (387)..(387): a, c, g, or t
  misc_feature (387)..(486): n is a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (461)..(461): a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
  modified_base (472)..(472): a, c, g, or t
  modified_base (473)..(473): a, c, g, or t
  modified_base (474)..(474): a, c, g, or t
  modified_base (475)..(475): a, c, g, or t
  modified_base (476)..(476): a, c, g, or t
  modified_base (477)..(477): a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
ataatactgattgtttgggtgtatatggttttcatgccctactgatggtgtttatttttggtgttcaaataataagtgtgaatattaaggatctacttgttctaagtgtcaatgacgttgaagattagtgacatgatctttgtttttccttttgccatactataaagggtgacatgaacgtgtagcatgacctaattgagtttagtgagtaggtatggtgcacgctggtgaaaactaacactatgtagctgtacggaagccccaagacaaggttaagaataaatccaactcaaagatcacatgaattagatgagttggtggtggtgcaggtgcactccgatgtgtttaatgtgcaccaaacttgttcatcgaatgtaaacaatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagactggaaggcagtcgcttggctgctgattattaaccacctttttctgatcctcccctttccagtttcttacgcctcgtatagtggctatccttttctttccccttctctagaataccttgaccagtttgaatccaccctgctcctaatgaatccaaggttgggccacataagctattttaggaacctgtgacgatcatagaaaagtaccctgctggacatgaacagatttgacaaagaaatatatggtgtgcatcactgccttttgtcagaggatccattatatgtagaacctgagcttgggttgttttcgtgcatgttgtgttgctgtcacaccagcttcaccacttagaagggtcgtcttgaaagaggttaggagatcctattgtgggatcggtggtttgggatgagtccatcatcattatttattttagcccggagttgtgcgtagttttttttggaatgttaattttggtatggcttttttttatttgttagttccctttccacagcgtccgacaaactccc

SEQ ID NO: 729 - DNA, 1043 bp, Zea mays
  misc_feature (1)..(100): optimal_loci_198523_G1, chr5:165331142..165332184, Cluster 5
gaggtgaatacaactatatataattcaaataagaccttagtagccagagaaatcataactactcgaaaagcctaccgaatgaagtgtgtattcttcttggagggagcatgcatgcatgattacgtgtagctgtacgtgtatttgtattcaaacggctaaaatccacgcatggtttggacaacacaatagaaatccaaaacctgcagatagattcacagatgcacgatctcggtgacacaggaatatatatgacctgaatgagagagcaaataaagcggacaaatgggggcggtagacgccgaggtgcaggaaagcttgtttgtttgcatctgcgtatgtctctggcaagggagaaaagtggtcacgacgcatgtccttggagttggagagagagagagagggagaggactggccatggcctggtacgtgctaggagtaggagagatggccaggccagccaccaggccgagcagggacctttcctccctcctcggttcggcagaagggggaatctgtgcaggatgggggccaggccagaccaggggcagcgcttgcatggtcagcaccacagtctactacgctgtcctgcagtccagcaggagctttagcaggctagaagctgcagtgccagcggtgtccattgccaaggtccccgtaagtagaattaaaattactggccagctaatttttaacattagacctatgttttggaacaaagtttttaaaaaccactgttttttaacagtgcaatatattttagttatgataataccacaatttaaaatagtacaattttaaaaactaaggtttagacctaagtttagagtactttaaaataactacaatatttacaatactcgagttttaaaaacataaattttaactagtttgctaaacaccattcttctatatatataatactgcagtatttgaaaatactacaacattttttcactttacgccgaaacaccccctatgtctacatatcctatctaaacagaaggcttgtacctagaccaacaattagtctttctctaactata

SEQ ID NO: 730 - DNA, 1161 bp, Zea mays
  misc_feature (1)..(100): optimal_loci_200876_G1, chr5:178600651..178601811, Cluster 5
agaaaatcaaatagacccaacaaaaaaacgagaatagagatttatttgtaacgtatatatatttgatataaattgaataaacggaggccctgagcggtggcataccctgcataccctcacggccggtcctggttccaggagctccaatggcggcggtggccatggcctggcctgccctaccccacaccatcagtgagggttggtctccccgtgtcgtaggcagcttgcagcgccaagggagagagttccaggtgtgtggtggtagtgggccacacatagggccatgacacgatgggaggaagtttatggctcttgtggccatggtcggcccggcccgtcctccggtgcctccctgccagcgtagcgctacttcgtcacctagagggcatggatgaagaccaacagtgtctggcggctatatggcagtggttccctcctattagtaccgtcctcccataataatgccatcgggtggatctacctcacaccttagtgcactagctagggatatattctgtgataaattagcaacaagagtttctctaggttggaactagaatcttttattgtagcaatatattaagactaatatttatgtaatgactctttaatgtttaatgaacattggtatttgtatcgatgaattagtatactttattatttttatgtactgtaaatttggatattctttgaaaattgcctccaaaaatattgatgcaatgtcattcattttgtaatagtatttgattgataaaaagggaagaaacgaaattgatgtgttgaatactttgatcaagggcaaaaatgacttctccaaccaaatcatcgaattcgtgaagctaaaattagtctgcaaactaaacacttaaaaaactcagtaattttactgtaaaactaaattatggtgaagttagtgaagctaagctacatcgttagtcacctggtcctggtcagctggtgtgatagcgtcgagaacacgtgaaaggattggtccgtgaggccgtgcatacttttccactgaacaatttttaaagtggaacagggagtcagggagccagcttattgacttgtcaagtccattgattgcaaaatgctgaaatgtacgtacctcattttggaatgcgagtgatgtggattttttttaaaaaaaataaactgggc

SEQ ID NO: 731 - DNA, 1118 bp, Zea mays
  misc_feature (1)..(100): optimal_loci_201995_G1, chr5:185536471..185537588, Cluster 5
atcccatgatgagtttaaccgaataaaaaaaattaagtagccatggattattttggggcatggattgaggcatggatttaattccaatccatgctaatccagagcgggattggtgtaaacgaacaaagcctaagctggattctaattatccatgagaaccaaacgccctcaatcgaaaaaaaaaatcaggggcaggtgcgacgggatgtctgaaaacactattgcatgcccagccagatgccctgaacaattgcatggagcgggaacagtaaagttctttcctagtaggaccttgggtggcaaccgagatacggctattttccgtcgcgagaacataatcggcggacaatacgttttcaaggaatccgaagagctccgagggttgacattaattgtggttgctgaagagacacaaaattcttgtcaacagagctcgtatccgatttggaggggacaaaaaaaaactggtgtacatatcatctccgagagccttctggatgaaggaatcttggaacctacactaggcagcctaagacatataagcgacatatatttacaaacagaagagattctgatcaactcacgctgtaatgggaaacagcacaaacaagggattgttgcagctaggagtgtcttaaagcataaagaaaaaataaatcgtagccaagaatccctagatgttttttttttgcttaaaataaaaaatagaagctagaatccggaagcaggcacagatcgtgtgccccgttatgggtacagaggagattatgttaacaaataataacaatgacaagctctagcttaggggtgccgactagcgacaacgacttaattagcaccgtcgattagatccatgaagccatgactttgtgagtggaatcgaaactttgggcccacgaaccacacagatcttgttagcgataacacagaataacagaagtggcatgaagccttaattggatgccccttaggaaacataactttgggcccgccaaatacacagatctaatttggatgagaaatatagcgccttggccaccaagaacgataacaaattctatcgagataggtgctccacggtagagggtgggttacaagagctaaaagtaggataaaca

SEQ ID NO: 732 - DNA, 1083 bp, Zea mays
  misc_feature (1)..(100): optimal_loci_202012_G1, chr5:185627265..185628347, Cluster 5
atcacggcatgtgtttactgttcttttgtctcattaaccaactgtcttattagcagcaatagcagatgcaaaaaaataaacgcattgaataatatcagattgtgtattcgctaaaaaattatattcgctggaaccaatttttttttgtttgcaaatggttgtagcgatatggtttgaagtgcagtccgtgaggccgtgacaaagttgtagttagtatttgaaattgaacttgtctctagccaaaaattatgctaccaaacagcgctatgtatcaagaaatactttgattttactctggttttgctgaaaccatagtattatgtcgtaacatactgtataccatggtattaaaatactacggtactagaaaactctactcccaaacacgcccttacattttttttacaatagaaacgtcttgtaaattataatgcagagagaatatattttagagactcatttgctcatagggagccagtgtaggctgttcaagtccaagtcaatacctgggggtccaaaattaagggttcacgtattactagtgcactatgatcggatgatgcaagtgtgtggctgtacgtaatgcggctgtgtaatccgtttttaaaccatgggggcatggggcatccgacttaaaagcccccccaactcatacattagacactagtacagtagtactagtgcaccaacaccaccagggcaaaaccaaaaggcgttcgatttgtgctcctctacaggatcgcaggaaagctgccttggctgtacgcctcaggcctccagcaaagcaaagccgcgttagcctttgttcgtgtacaccagctctcgattaacatggattggaattaaatccataccctaatccataccccaaaataatccatgactacttaattttttttattcggttaaacccatcatggaatataacccaggggtttgggaattttttaaactataaaagacatggattctatccatagctcattaggtatggaacaaatccatgagatattgcacaagtttatattagaatccatggatcaaaagaataactagctttaaaagacacatggattagttcat

SEQ ID NO: 733 - DNA, 1087 bp, Zea mays
  misc_feature (1)..(100): optimal_loci_202859_G1, chr5:190041750..190042836, Cluster 5
gcttaagcataaatgaaaaaagtaacaacatacttaaggctatgatcagcagaccttacggttacatatgacggtgcaaactagtgttttatattattttgcactgtaaaatgcactatttacggagtgaggttttcaaatagaaagtggaatcgagcttaaaagacaatggtagagtaatgtattaactcttgttctcccgcggaatagaatctaggagacataaggatcaactattattcaatatatctgactaataacaagtaattgtaatgaattatacgcagttttcttctcttttatcatttctctaatacaacaagcataatagataatttgtagtctgtatcaagttttataaacttaccagcttttgatctatatactttttatttatatccagtctttttttacatagcaccaccatgtatcttaaattctgcaaactagacgagcagattgcttggacgtcggaacgcagcggggtggttgacctgctcaaacggcccaatcaaaggttcccgagtcgctggctgcaggcctgcgggcgaggaggcgatgaggggcagcggcccggggaaccgagctcgacgacgtcgcgcatcccgggcgaggggcgacacgcgagcgcctagatgtgtgtttggttcggtgtcaacgagggatgagacaggatcaccttgagctgatcttgtcccttattttttgagggatagcctcatccactatttttgaaaaatatttcttgaccttgactctaaacctccaaaccaaacacgggttaagttagaatgatctcatctcatctctctttatctttcctcgtccctccatccaaacaacctagagcgctccactgggcttgtgcctggtggtgcgatcgggacgagagacgtgcccacgcgctgccagtgcacgccccgtgtgcgcgtgcgtgcgctggtttcgttcccgcgtctggcgtccgcggtccgcgtgcgtgccgatccgcagccccacgcggtgcttgctgcccgcctgcccgtgcccggacccggacccggatcggactgcgctgcccatgccgccagcggggccaaagcggtgc

SEQ ID NO: 734 - DNA, 1211 bp, Zea mays
  misc_feature (1)..(100): optimal_loci_203517_G1, chr5:193925358..193926568, Cluster 5
  modified_base (964)..(964): a, c, g, or t
  misc_feature (964)..(1063): n is a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
  modified_base (973)..(973): a, c, g, or t
  modified_base (974)..(974): a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
  modified_base (988)..(988): a, c, g, or t
  modified_base (989)..(989): a, c, g, or t
  modified_base (990)..(990): a, c, g, or t
  modified_base (991)..(991): a, c, g, or t
  modified_base (992)..(992): a, c, g, or t
  modified_base (993)..(993): a, c, g, or t
  modified_base (994)..(994): a, c, g, or t
  modified_base (995)..(995): a, c, g, or t
  modified_base (996)..(996): a, c, g, or t
  modified_base (997)..(997): a, c, g, or t
  modified_base (998)..(998): a, c, g, or t
  modified_base (999)..(999): a, c, g, or t
  modified_base (1000)..(1000): a, c, g, or t
  modified_base (1001)..(1001): a, c, g, or t
  modified_base (1002)..(1002): a, c, g, or t
  modified_base (1003)..(1003): a, c, g, or t
  modified_base (1004)..(1004): a, c, g, or t
  modified_base (1005)..(1005): a, c, g, or t
  modified_base (1006)..(1006): a, c, g, or t
  modified_base (1007)..(1007): a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
cggtcgctactcgccagtcgtcggctgctaccgcacccgcacgatgtggacttggggctgcggctcgtgtgcgcaaaagatgcgaccggcctgggactgggacccgcctcccctccagaattcaagaaccgatcaaaccgaggccccacgaggcagtccacgtgaccccacagaattccctcctgcgtggcccatcccgctccgcacgtcacggagcacgaaaaagctcattgcattgcaccttgcacggaacagaccaacccccacccacccctcctccactggcagccgggacccgcacccaccccgctagcacgctatgctgcgtgtgtgcgtgcctaccccttccgcgacggtcgtggcggcgtcgaagaatttgaacttgtcgcctacagggctccagaaaaccagacggcttgaccgcttcacctccatttccttcgtcccccccgagtcctactatatacgcgcggccgtgcgctcgatccatacctccttccaccgctgacgccttcctcgagcgttccatcccatcccctcacccgaatcccactcggctactccccacttccctttaagaacgcgcccctccccaccggaggttaccgcccacccatcaatccatcatccatcgctcggtaatcgatcgacccgaacaacgccggggtgctggtgtgagggtcaggatggtggtcggattccgccgcacgatctcgttcccggcgcccaggtccccggcgccgccagcggggcccagcgccgccaacaacaagtccgtcgcctaccgcgcgcggtcggcgagcctaccgtgccggttccacccgctggtgctccagctcgacgacgacgtcgccgacttgcgtgtactgctgggccgcctggcgttccgagacctccgcgaaccccgtggagcaagaaccggcgggaagggctccgtgtgctgcttttctctagggcagcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttctacgcgtgtcagctccagaagaacatcgcattcgacgttaccattagattacaataataacgggaccagcgaggattgccgtgatgcgaggttgcaagcactgcagattcatcttgctccacagaagcacagagagaggacc

SEQ ID NO: 735 - DNA, 1230 bp, Zea mays
  misc_feature (1)..(100): optimal_loci_203547_G1, chr5:194118135..194119364, Cluster 5
ataatagaacttccccctgccgtccgtacgttcctcagccgcgccgcgcggccccaccgccattcccctcccgtgccgaatacgtacgcagggcgcgcggccccgacggaggcaagttctatgcaaacgtacgtgatcgatgtacacactgtctgctgtgctgtgcagctagcacggaccggattccgttcacgtgccttcgtacagccaccatccgattgtgcatgaagcggttccgcggaggcgtgttcattcttttttttttcttttacggagaaacctttgtctagctagatgggggcagacacgtggctagcatccgggccgtacgttctgcacggcatatgcactgtacatcacgctagcataaaagcgccaggcgcccatgcatgggtcgctcgtaagactgttcactctcaaagaccaccgggctctgggaacagtggcggcggaagcaccaccgccggcagcgcggcgacaaggggctttgttggtagcgacggcgcgctagctctcgatcgggtccggccggcccgcgtcacgcgtatgtgtgcccggccgggctgcgcgccaccctaaaccctagctgccatgcgaattactaagtaattaacgatacgaaaagggagagctatcgatcggttggtggctggcgcgttgccttcatcgcgtgaacgtacgcagccatctagtcggagtacgtagccgcatgtgcagcggcgacaagcaagcagcaggtagctcctgtgcatatatgctgggcacaaaattaaagatcggatggcggatcggacacggcacacggggtcgccttgcacgacagtacgacgtacgttacgtacgcgcgcatgtgatttgatcacttcccagatatagtactacgactgctaatgcgtgctacagtacactttagattcctcatcaacttgacatcacctgtttacgtacgtccggcgggaggaaccggacgactgtatgagcactgacttctagctactttcccgtttctcctacaactcgagtcaataaacacgcggaaaacatcaggcacatatttagtacaagcctcataaattctgacaatcatcagattgtcatgagcttagaagcattacggccctatacttcatcaggtgatgcattatgagtttataccataacttttggtagaatcaactcattcctcatgtatttactaattattagcttataaagagtggtgtggtaatt

SEQ ID NO: 736 - DNA, 1143 bp, Zea mays
  misc_feature (1)..(100): optimal_loci_204550_G1, chr5:199704443..199705585, Cluster 5
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(162): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
actacagaaatttatacttgctacaatcaacacttgttctttcgtgaggcctgaagacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggtcttccaataccacgagaaaattaatacttggctccaataaaccattttttttttgtggaggccgtggaggacttcaaaagaacccctccattttaatttccatgtttggatggccatgttaggaatttggtggtggcttatttttagagttatggcacatatttcttagcacattgataagattttcctaatagaacaatcatatatgatagaatagctttctttggtttcttttctcgtcttcgcaaagaaccctcctcgccgctaaatcaattggttctttctttggatgacttcttttcctaaaatgatccttcacctgggagaccacaacttgatcttcatgatcagttaagtcataagcttgtttctatggtgtctaatttactgaggagttgcttggtgtgttctaatcgacttttactttcaactgacttgccattagtttgtcttttaggagttgctagatgtttggtgttcttgcaaggaggtgtggggctcgtgactcctatgaggaggggtgaggctactacatagaagggtggggctcttgcgagaaggggtgaggctcttacaaggaggggtggggttcctacaaggaggaatggggccccgccaactaccagtgcattgtgacatctgtaatttatgatgtgtctcttctttcatatagtaaatctatgcaatccctataaaagtactagatatgtctccatcaccctttatgatcttgagctctttgtctccatatccttcatagatctaaccaatgatcgtctagaatctcctcaatatggcatgtcttgctttgctgaggaggtgaaaccatatccaaagccaccttaattgtcatgttcggcactgatatgtgtgtagctaggtcacatgatgatctatacttaatttcttttccatctgtatgatatcattgatatgcatggagtttggtgaagcatgacgaattctctagaatcc

SEQ ID NO: 737 - DNA, 1030 bp, Zea mays
  misc_feature (1)..(100): optimal_loci_20623_G1, chr1:118054550..118055579, Cluster 5
gtcgtgcagctcatccctgcgcagctcctgatcggaatttccccggtcgagcagctcctccaccgcgtcctcccggtttcctgctcgccgagcttggcttcgagttcgtgtctcccatgccgcggcacttcactacgcgccgtggtctttccccaagttcctatggtgctcggcgcccctgctcctagctccctgctcggcgctttcttctcttcctcccctgcacagagccgctgactgatcctctcactggccgtgtcgagctccgttcacgcgcgcccagcttctctactccctgcgcgctgctccaattcccagccatggcgcatctctgttcgttctccagctctctgtgcgtcacggagctcccttgtcgcgccccctgctcgctcgcgctctgtagagcttgctcctgcgcgcagcgcgcccagccagctccctgccgagtcccagccgaactcctccgtacagcgccctgtcgaggtttcctgttcctgcgcttgccatggccacgcagccctctcgtggttgctcctccccctcgccgagtccctctcatccccatggccgagtctcttccccggcttctcctgaaccgcgcccctgctctgctcgccgtggagctcctgcgcacgcgccgtcccgagctcgcccctgatccctgtttgccgcgttcctgcgccgtcgccttgctgcttgctttgcgcgtgcggtcctctgcccctgcgcgtagccggtttctcggttcgccgtggagcctgcgcgctcggttctgtccagttcgtgtactgctcgcccgtccgcgcggcacgtcatccatggccgctgtccgtcgtcgagtccctatgcgcgcaccagctccctgtgtcgcgttccattcgcctaaaccggagttcgccagccgtccctgcttgccggtgtgctgctgctctagttcggatctcgcccaagtcgctgccatggttgtccagtgtttgacccgtgccgattcgcgttcgctcatatcgccatcgtccatcgtcgtgttgtc

SEQ ID NO: 738 - DNA, 1297 bp, Zea mays
  misc_feature (1)..(100): optimal_loci_206640_G1, chr5:211167279..211168575, Cluster 5
tattggagttctgttggagtaataaaaactgagtttcacctttaaacaaaagttttgggagcttttgagtcgttacttggaaatgctctaatagcatttagggataaaaatttacaggaaacgctgcgcacagtctcattgcttattcccccgccacccccgcccaaaaaagaaaaagaaaaaaaacaccctcccttctccttgcttgtcagctcgcacccatggaaccctcgtcgccggccaccacggccaccttccctgctgccgtagaagaacatgagacgtaccctcccatggtgtcatcctctctattcccacttttccccttcgccgcctccacctcctctgctccccccgccgaatcccaatggctttcaaaccctagcttctccttcgatgcctcctccctgaacatcccggctaccacctcatcgtcgctcccgtcgccgcagagccactcgtccgatgaggacacgccgctgcaggccgctcctgcgaaatacgagctggtgccttcttcgccgtcctccgacgaggagagggggtcgcggaggaagagaagtgggaggaggaaacggaagcgcgagaaggagcgctatgatggggcagcgacatcgcggaaggctgggattcgtgcctgggctggattggagacgaagccagccaaggattactatgtcgacgcgaagggcgaccatgataacctggcttttggatccctctacaggtctgatcatgaagtatttgatgtagcatgccaatccaattgctcgtagtaaatctatgttgctgcattcatgtttaataattttgctgtgctattagtttgttgaagttgtttattcgtagcgtgatgacttgtgcagaaattttagtgtgaatcaaaggtctcagcatcagtattatttcaaaatgtcacactaagcagagacctgctccaggctaaccaagttgtctgaaatcctaggcctagttatttgtacacaagattctaaaatattctccactaaacccagaatatatgttgctaaatgcagggttggattagcattttgaatatatttatgtgttaaccatggttcattctatgcaacctttgcccattctgtacttgtatttgatacatctagaatgttctaatatcagactattccaaaggctagtgaatcaacataatagtatgatgcaccgtgtcttgatcgtcggtaacactacaacatgtttatatgaagtaactgagcttcaaattgtaccacagcacaatattatacgaatactgtaaactatgtttaaatta

SEQ ID NO: 739 - DNA, 1268 bp, Zea mays
  misc_feature (1)..(100): optimal_loci_207455_G1, chr5:214923380..214924647, Cluster 5
tccattcatcgaccaaagccggcagctgctcgagttgatggaatcattgatccgtgggggtgcgtgtgcttctggttcactggtaggtggaccaggtttgctagaaccttcgtcgtcccaacggcttcgagctgagatcgctggtcgtaacaaacccggtctggattctcggggctggaagggctagataagctagccatcccgttaattcgtggtggaccgtcgtagaacccatgcttcgacgtgggcagagcactccgccgcatgattgccggtaattctacccctaggatgttcatcgttctctctgctacgtcggtagcatcggtcgaggggtaggtaacggaccgccgaggcgccgcacgccggcgagtgcgctaccgcgtttagcgcgcaacaccaccctgtttagccggaagggaaggagatgagcaatggctgttggattcaaaaccagtgcatctgattagaacatgtgtaacactagttcggtttgagtagatctaaagatgatcgtctgaggggcgttcacttaagtctataaagtggtggtccatctccgtcttttgaaatcttgcagaggacctttccagacagataatggttattttccttaacattgaggaagaacagagcggtatgtacgctggatgagctgtcagtcatcccatggtataagaacccacccaaatgggggcaagaactcatcatgccatgggccatgcatggggcatgggggcttggggcacaacaatacaaagaataggcacgggtgccggcaacgggaggagcacagagctctctcagctgcttggtcccgtcgaaagaaaatcccatgccataaagaggttagacgaggttatatattccattaacagcttctgcacaattgaagccacagaaaagatgacgtgtgtgagaattggacctttttttaacatcactcagcaccagatctgtttattatttatatagtggtgttatataaatggggtacggagccacgccgcacgcgcccggagcggcggcgcccgcctcgacggctccgcgacgcagcctcagccacgctgctcgtggccacgccatacgccggaccgtcctcctcggatgagggaaggctcggtgccccggcatcgtttccagtggacggaggccattcgaagcacgcgtgtgaggcagttcgcaatttgcaaagaagaaaaattagcaaaggagcttcttttcgctaagaaaggtgaggaatttttctcaaagttccatagacggct

SEQ ID NO: 740 - DNA, 1038 bp, Zea mays
  misc_feature (1)..(100): optimal_loci_209238_G1, chr6:9143387..9144424, Cluster 5
gttggccgcaacaacgtcatgagggagggcctgacggcggcgacacaagtgaggggagggggcggcgggatcatggaggagggggagagggacgagggaagcatgatataaataacattagctattgaatttgagtgagtagtagagaggaaagttatctagcgacctgaatcgttggttttgagggtgtaatatgtgtgagtacaattcgtttggtaggtttagaggagattatgggtgtggggtgatttggttgggtagatattgcaaagtaaaaactggtaggttatatatagggatatagagatataaatataaatattatatataggcatagatcgaacaaataaccatatagtttgatattaggtgtaaaatatatttagtcagggtagagctaggctcgtttttttttttttttttgctgttactttatagcattacatgctacaaaattcaaggctacaacatttgttgagctaagagaaagcaatgatgataattatgctcatgaaatgagtgacatcaacaactatctactctagatctgacatgtacatagtgctccctctctttaaaattattacataatttttgttatgcccttagatatatgtaagagtacagcaaaaaagctacatatacctagaaaattaagatatcttataattgtccactatcacgcattacgctactagaaattttttagaaaaaagcgatgcaaaaaaagagctcgttttttttcagatcaaaggtacgacttccatatgccgttgccatatgacccatttaatccctaccagctggggttcatgcatactacgcatgttgctttgtgcagagctagcttctagctagcacaacagtggttccccccggcctccccttttttaccaatggtaaatactgtgcatttttttttcccttcctgtataggtcgtatgaccggaatctcccgtcctacaacacatcacacggccattataagggccgggcaacctctctacttacttccacccatcatcgcatctattcact

SEQ ID NO: 741 - DNA, 1202 bp, Zea mays
  misc_feature (1)..(100): optimal_loci_213788_G1, chr6:36603115..36604316, Cluster 5
gtccatgcgcatgccaatccaaggacgaagagcaccaacggcaagcgcccagatgacggccgaagcggcggccgacggcatagccgccgccaccttccaggcgaaggccacggtgagcagccacacagcgcctcgcccgcgctctggctgggacccgggcgccgcgcgctcgtagtcacggaggcagcggaaaaggagtagcagagcggcgtacgagcctgttaccagtaggatggagacgaggtcgccccacacgcggtagatggcgaccctggagttgagggtcaagaagccgaggccggctgtggtggcccaggtcggagggaggttggcgttgtcggccatggatggtggaggtgcgcgtgggggcagaggcagagggcgctgacgtagtgacgccgccgacacgccttttctctcgagtcttcaagtctaggagcgacgggtcaaggactcaaggctcacaacttcacatgctctatatgaaaggcgaacgtgtgggcgccaattttctgggctttgtttttcacgaagaacacacttgcgtttgtggacgggaatttatcccgtgacaatcaggaaagcacagaaaatggtaacctccggttcggtttttgacccctaaaagattgtatgatacaattctaagattctgatcataaatacaactaaaacataatatgtatgaagagtcatcaagagtctgcctcctgttttttattcacatagtttattagagacctttaaaagactatattaaataaggttatgtatgccctaagttcttaattaatagttcttaattaatgcatgcatgtggttttatgtcattgaaatttaactacagcgctgagcgtagtctattggctcatgtattatactatggaaacaaaaaactacacggttgttcaatttaaagggtaaatgtaagaaagggacaccactatacatgttcaaacagtgcaggtcaactgctaacggtccatgctatgtgttacaaggaaattggaggatttgacggagaaaaaaacacctagagctggtttggtgacaagataattaaagagtattgcatgagaagaaatttcttgatattcattgaatagcaagtgggcacctgtgctatcacggttttacctttgtttagaaataaacaataattatattaaaaatagtgtttagaaataaacaataattatatt

SEQ ID NO: 742 - DNA, 1303 bp, Zea mays
  misc_feature (1)..(100): optimal_loci_220411_G1, chr6:82759037..82760339, Cluster 5
tagccaatggtcctttcctgtagctcgtagatgactggtgtcatcacccagcaagcactgctagtatggttttctagatagataagagtaatcagggatggatggtgtgtgtatggacagaggagagccgtgcatgacctgggttcacctgggtacatgactaaatgtgcccagtatgtaaaagagcaagctcctgtccagaataaaaaaattcgggtttcttgtactttgtactgcctaggcaagctggtgaaatgtttcatactagatgtcactgcacagaatatagaagttggactgttagtctgaagatgaagttaggaagcttcttcattccttgttccctgtccagttcacatttgatttcttcatctgtccagcaggtcagggtcaggtcaggtcagctccaccgagtgtcaggccggcgtcacgcaggcatcttttcatgtgtcacagtactgtatttttgatctttcaacaagaagatggatcactagcgacctcttcttccaggtcttccaactcaagaagcgtcatggaacccactgggagcagagcactgaggcgactgacccaccaacatgggcttcttttttctctctctctccagcacagaacaagaagagtgacaggctactttcaagcctcatctatctctccagagtaaaagacttggaccgcttcaaagaagcttcagatcgatcagatgttgtggccttcgtcgtgtgtggctgaatgtcactggaggacaggaatgcaaatgcaaccatatggacttgactctctccggcaagaggcaacatccatcgataccagcaaccatggacttgcttgtgcatccatggaagaaccggtccaagcgacagggatggatggatgggatggatgggatggccccagctccgttccatttccacgtcttgatttttatatggtacacctaagctcaccgtttgtctccagtctcctagcaccaagcaagtccacgcttgtcacactctctgtatagtacctagtactaaatgaaaatatgatatgatactctctgtttagtaatctctttttaaggatggatctagtgcagccgtcttaccgagtcgctatattgcgagtttaaagaagcctattttaaaagaatcaggttttcactagttttaggaatttatgatgacactaaattattatgactaccgtgtgtgtgttttacagagtaaaattatgttaggtcataataatggtgattgtttgggtattcatgcctattatgtttttaaagtatggatgtgccaaatagagttgggag

SEQ ID NO: 743 - DNA, 1167 bp, Zea mays
  misc_feature (1)..(100): optimal_loci_221773_G1, chr6:91616584..91617750, Cluster 5
aagcgccttattgtttctaaattatcatccattgattagactgcgcttactttcgtcatgctggcagaggagacaaccgcaccgtgtgtggccggtgtcctgaaaacgacgaaacggtgttcatcagcacgtctgctaaattcacagtgaacgaacatcctgtgacacgcggggcatgtttgattacgtggcctgggctagacaggtttagattttaatctaatagccagggtagctgaaatctagctgcaacaacgcaatccaatcttgttttatatatgtgacatttactggattttgatcgttacagtagtacatgccgttttacgcgttgtgcaggcggccaccctgcgtgcttgtgccttgtggtaccgctgctgcctccgccggctcggaatactctgaataaaagccaggtgatgaatccacccttatgcttctggtccaggtcctgctgcggtgctgccgacgacgacgacaaagccggtggccgccggccgtcctgccgcgggacttgcgcgatcagagacatcgtccaggcctgtggatgggagctgacgccagagacgaaactgccaaacgcgcccgcgtttctcaaggcagcagcggaagaaagagacaccgtcatcgtcatcggcgatcgacagctctaacagtctcgctctgcgctaggccacgccaagcggtctaacggtctagctctagcaccgccacccatggcgcagctactggcccattcggacggccgcgaccgcgagaggggcaaaagacgcacccagccatcccggacggagtatataagttgccgcctgaccgcgaccagtgcagcagtgcgtgctccggactccggtggcaccgcacggtcacgcgatggagtcgacgacggcccgggcgctgctctacttctgctgcctcgcgctgtacctctgccgccgcgctccgccctgcctgtgggcggaggccgccgccggcgggtacgctgcccgcgcggcggcggtggacgaaggaggcgcgcggctccgcgcccagctcgcggccatcgccgccgccggcgacgacgacgtccggaacctcgacgtgtatgctaggtgcgatatattacaacgaaggaacatcgatagatgtgtatatggttgttagtatgttaccgttaccaagaagtagaca

SEQ ID NO: 744 - DNA, 1146 bp, Zea mays
  misc_feature (1)..(100): optimal_loci_221776_G1, chr6:91620495..91621640, Cluster 5
ctctcaaaatcccctcccaccaaatcagcctcaatcattttccatactcttgctcccaaacatgctttgctcccaacaagctcaggtgccaagatgcggacacatattgaagtcctgaatcggtaaatgtcgataaaaaaatgggaaacccgttggaatgtgttggcagtaaaaaaaatggcaaaaaaaaaacacggcaggcagaggaatagcgttggaataaacaaaaaaattaaggattcattgaagtcactgaaacagtattaagacatcattaaaaatttggaactgaaacagtattaaatgtcaattaaaaaattagagtgtaaacatctgaaaggcttcgatgaaagtcactactgtagacgcgccaggtaggggtcgaacctacggccttctgcttaggaaacagacgctctatccactgagctacaagcgccttaatgactctaaatgatcatcagattataagactgcgcttatttttgtcatgctggcagaggagacagtgtggatgtcctgaaaacgacgaaacggtgttcatcggcacgtctgctagattcaccgggaacgagcatcctgtgacactgacacgcggggcatgtttgattacgtggcctgggctagacaggtttaggttaatctgatagccagggtagctgaaatctagctgtaacaacgcaatccagtctcgttttatatatgtgacatttactggattttgttcgttacagtagtacatgccgttttacgcgttgtgcaggcgggcaccatgcgtgcttgtaatcgctttaatgatttgtttctttttgtttgttgctattgaatagaaaaaatagctcgatggcctttttctagtatatatacattttttgaggagttgagaacagctggtagtagatggcttgatgattacgacagcgtaccgaataagttatgtatatattagtagttttcagtatatgagccaaataggtagtagaattgaccagtttaattaaaggcatcacgtgtttcagcttgcgtggtactatataattatatcttctacctactaccatctccttttttttatgatagaacatagaagagaccgctctattgcaacagtaacaaggcgaaaacaaaacaaggaccaagctctaa

SEQ ID NO: 745 - DNA, 1103 bp, Zea mays
  misc_feature (1)..(100): optimal_loci_223784_G1, chr6:102686863..102687965, Cluster 5
atgtccatgcagtgcagcaaaaatggagagtgtttccactgttgaggtaatttgtcctgttaacatgtatgtcattttgccacattagaccaagatatccaacaaacaataagaaacgttgttgttgaacaaagaggaaaaaaactcacatttgcattgaagagtatcagtgtttgaacagcctcctagtgaccatattggcatgcttgcatcaaagcattctacatagaattcgcaaagcacactctgaaaggaagatgcagcaacaatgtacacgcttctgtttgaagatggatagatcatagatcacagaatgtttgttgtaaaagtttattcaaggaaacaactttggccatggtggcacagatctttcaaacattggtcatgcaagatggtcacaatagtctaatggaagtcaataaaaaagtttaatacattcttggatttgttcttaactaattctgatagttttctaagagataaaaaatgtagcacacacatatcaattgatgacatgatacgcacaaaggagtaaacttaggtattttagaaccagctctctactgtaaacataggtattttagaaccagttttcctctgcaaggaagatggcatttttatttcccactgtggccaacttgtttgtagcataaccctcgtgtgtgttctagacacagtcctactaagttttgaacatagattgacccctgcatgatgtaatggtgttcctagtgccacagtgcattttcctttcatatattcccttgagcctatggacaattttgctagtgcgacgaataagaagcagcaaccccacacgaacggtaatctgagtagatacacatatgtggcaaccaaaaggaatgtacagcagaccagccatgtacaagttaccttgcattgcttatagtgattgttctcttcatgacctcgaacagtcgccccttgtgcatagtgatgaaacatgggagatcacactgacaacaccaagcacatctatcatagagatggcaagggtattaacattgtattcatgattctatatgacacgaaattggctatgcttagaaggttaccaggaacgaatcaagctgatcatcagc

SEQ ID NO: 746 - DNA, 1021 bp, Zea mays
  misc_feature (1)..(100): optimal_loci_224176_G1, chr6:104465988..104467008, Cluster 5
tgtttgaagctagtgccaatatcgaaggtagagggaaagagatgaagtgttgtcctccatcttttgagggccagactcctcctcttatagccacaaggagggaatccaagagttgtcgtagtgtttgagatagtgtttgagagggggtgaacttgagccccagtagcagtatggccaccacccactccttggcatattggcctttgataatggacttttatcctaaaggcccataaacattctcatgggtcatggttgcctcttatgcatatattcaacaataagaaatagcaagatctaccaaaaatacagatctacaagtgagagaaggaactacgaaaaagttttagtggaggttcgccttatttccttttgacgaacagaaaagagagatgcaaaggagtaacgaaggttgattgttcttaggttcaatgatgacgttttggtattatttatcaaagaaagacacatttaagtgagtgtggcaagggtctaagtttttgttgttgcgggataataaaaaagcactggcgggtcataactaggtatatttattagtttagtttgtttacaagtaggaattcgaagatgacaacattagagagagacaagaataggcagtcacaaatgtaagtacaagatttagaagtaggtaaggtttatgcatgacgagatatgatagctagagctacctgatattagaagaagaatagcttgtgcgttttgcgagataggttccaagtaaagacattaaggttggcaatattttcaacatatgccgtctcctaacttagttttttttcggattagcggagtacaaaactagggtagtcccaactagaagctaggcagctagctcggtttaaagaaagcatgcaccagagtggagtaaagaaaaacgaattggatttaaggaagggaacaaaaattagtgaagtaaatcaagaaaatagtaatgataagtgggaaagttttgtataaaaaaaatgtggcgccaccaccccaaatattttgatgcgag

SEQ ID NO: 747 - DNA, 1274 bp, Zea mays
  misc_feature (1)..(100): optimal_loci_224379_G1, chr6:105483792..105485065, Cluster 5
gcatgagcgcgcgcaatacactagtggatgtaggatggcggcaagcagttgaaccttgatgataaatcttgagttcatgtcttgtcttcgatggtttgcatacttcacacttgccctttacattcatatcgtgtgctttttgggaaaatgtggaaataggatgagaaacgagacgaggttgtaaatctgtgatatattgatatgttacgttgtgatatgtgaaaacttattaatcattacttgttatttttattgaaaatttagaatagattgttcaccgacgcgtggtcatggagtgacaaaaggcaaaagaagagcactagggaaggtgagcattgcggcggctgaagccgcgagcgcgcagggacagcagggtgcctaggaagtaggaactattggagcatccatttaagctatttctcttgcattgagtgtatcgggtcccatagcaatgatattattagtgttatttaatttatgttgcaacgcataggcatgataataacttaatatacaattactccacttatatattgttcggttacaaggaatgaaatcccaccatagatttaattcgggtttggattgggtgaattcataccgcacacccaatcacattgtaggattaaatccatcatttaatccatttatcttttaaagctagttatttttttatccatggattctaatataaacttgtgcaatatcttaatggattttctccatacctaataagctatggatagaatccatgccttctatagtttaaaaaattcccaaatccttgagttataattcatgatgagtttagctgaataaaaaaatctaagtagatttggattattttgaggcataagttgtaacatgaatttaattctaatccatgctaatctagagctagatttgtacagaagctgactgttcttggccgagcacgatgatgagtcccggataggccgcccagctacagttgtctgctcgtctacgcgcctacgcttgcattgcatccgctgcccgtcaacgtcaacgaagcgcaaaaacagccatcctaactatgctgctctctcgcatgctacactgcacaccacatgcatgatctatcgccattgccatggccatggccatcgttttatactggctccgaaactgaaacttaatgctagctggtataagtgatgaactatataaactaatgtcataatgggatcggatcgacaggaacttgcttggccagattagttgagacaccggcagcaagctagcttgaaccacag

SEQ ID NO: 748 - DNA, 1304 bp, Zea mays
  misc_feature (1)..(100): optimal_loci_224881_G1, chr6:108143911..108145214, Cluster 5
taatgatagaaaaatatcatcagtttcgccgttatccttcttttagccttttcagccgtggttcaccggaccgagagtgctacggcgtcaatcctttctatcctcgtcgtgcccagcttctcttccctcttttcccctcactgatgaaccctagccgccgtctccatgccggatcccgcacccgagcctgccctcgccggcgccggcgctgctggtgagcattggttttcagttttatgtccagttttagtctgactgggagcattgtttatggccagtttcagttttaaaggacctttgcatttttcagtgtgcagcccctcgcctcaacattcagttcacagattttcagttcagtgatattcaactgaaactggatggtaagttttcagtgaccatgttgaggcgaacaacagttcatgtcactgaaaatagaatgaccatgcatttttcatagaatggccatattcagttcacagaaataaatggaccgcagttcacagattagaattcagttcacagattacaaccggaattcagttcacacagattaaatggactgcagttcacacagcagttcatagattagaattcagcggctagggttgccatgctgcctgtgccgtacaccatcacacagctagagctagttcaattccctttcccttcccgttgtcacccctctgttcagtccacaccacaccctcctcaaccgcaccgtcgtcgtctagccgactagcggcgggagctatagcttcgacgagccgacgacaaacaccaacaggaggggaaaggagggaagagaagctagggcctagggagggaggagagctgctgggagacgacgacgagaagactggcgccgtaacgctagccgtccgtgacctgcgcctgatagaccttactgaaagatcgcaaggctaacaacgacgactgctgatggtatttttctattatggcaaagagaagacttgtatcctttctattttgataaacatgtgtacaccgaattgaagctcagttctgtaggaggtgactcatttccgttgaacatattcatcgacgccactcgtgttttgttcatcgacattaattctatacacgatgcttgggtttagaatacatgtgtttggtaggctaagttgtacaatactgattcctccatttgtttaccaatctgaagttgacagtaccaagttaaattcaccacgaaccgtccagacaacacccacacacaacattccaagtagcaaaatatctattacaaccaatatgatcaagttcatggtttctataaaccaaca

SEQ ID NO: 749 - DNA, 1406 bp, Zea mays
  misc_feature (1)..(100): optimal_loci_229113_G1, chr6:130151579..130152984, Cluster 5
gcgtttgagctactcccgagcgctaaattaactgactcagtgtctgacgaaactaaagaaaatacagctaacagtaattgatgaaactgaagaaagaaaactacaacgagctagctaactcaagataactcatgggttattatctccaacatatgctagcaacataaaacaccacttatgagcagggtcaggccccactaaattcaaaggtattcaagtgaatacccattattttttacaattttttaatatatacatgtatgtagtatatattaatatatacataggaaataggaaataagcaaaatagtgaaggaattatgttactttgggctaaaactatgtccttcctacctcctccagccggcccgttaccatgtcttggcctattattctcacgcatccataccacacggtcactggggcctgttggctgttgccctgttcgactggtcgccaggacaggaggacgccagccgcccagccgccaccgctactccgctagccgctagggcagggcaagtgagtgttgtcctccggcctgaccgcctcttcgcctccggtgctcacccagtcggccagtcgcccgcctcgtcggccgctgcctcgccgcgcgcagcgcgttgccgcctgccagaaaataggccgccaggcgcccgcagtgtggatactaaaaatcatgaagtattttgttttatcatacgcaatccattattttaaataaatagagggacataatttttcttataaaaaactttaccttgaaatgtgcccaaactttgctaacatgtttctctgatcgattattgttttctaacaaatattcaaataatttggacatcatttgctttgaatttaggaattaaaattaaaattctatttttaaaacaattaaacaaaactattgccctaagccggcataggaggcttccatcctagaagcacagcgtgcacccacaacccactccctctcgattgctgacaagtgagaccgccttgtcagaccacgcgcacgtgccctcgtctcccctcctttgtaatctctaatggatgggccagccctattaatgcctctctcccactctctctctaaccagtggggtcaacttgtcatccctaactccgtgttcgtctccctattcatggcgtatattctgtcagcatccaagcccccgtgaggctcagcctgacaccccacgaccattagctgacagagaaggtctcgcgtagcataaggccctttgtccctacctgacccctttttaatgtcatccatcaacgcagagaacatcttagtgttcatcatcgcctccacgactacacttccgttgtcatcaccatttcctcccaataaatggcactcaactataaaagctggcatcctatgagcccctactcaccaaaac

SEQ ID NO: 750 - DNA, 1172 bp, Zea mays
  misc_feature (1)..(100): optimal_loci_229483_G1, chr6:131981727..131982898, Cluster 5
tacctgagccacactagagagagatagagaggagagagatcgagagagcaagtgatagtagtgtcccattattacctgaggattgccatcttttgtgtggcctggcctagcttcctgattacctttaaatatatccgtagctttattttgcaaaccccggctggctctcagataacatacttatgttttgctagtggcaacaaacgaccaaacccacccgccgggactaatttaatctcaaatacagaaaagcgggacagaaagcagggtgcaccagaatatacatacttgcataaagagcaaaaagatcgcctataggttattttagtgtcgaattattggcaaagcaagcgcagcatatggataagctcaatccaacagctaaacagtgcgtgtgtcagtgctaatgagctatctcgctgcaatttttttttgtaaagcttggagagaaagaataatgttcaacttgatcactgagctatcaagcgtgttaaactatgcaacgggaaaattttgctattaaaatcaatcaattgatagtgaagataacttcccaccctgtcatagcaccaaaatcagtctaggtatttcacagaaactgtagcccaaaatcgaagaaaaaaatccccaacaagtagctcccaatcacagaaaagggaacatttttatatttcgagaggggaatgagtgaagcacaaattttgtcttttaattcccaaactatccatccagatttatgagcatcaaaccagtaaaccatcatacacgccttgtgattagagggggtgaatgagagccaatcaaattatacttccaaacattgaaaataaacactgcattttaattgagataaaacaagcgctcaaactaagaacacatgaaccagtgatctcatgattgaaaaatgttcttaatactcacatgagatcagcaaaacaaacagattgcaaatcggggacctaaaactccgaatcgctccaaaaccgtgtcgcgaacatgtgttgattttagcaccacgaaattctgttcttggatgtaaaacttaagcaaacgaactccgattgagatgaatttttacgcacttcaggagcaatatgtttccaaggtctccacaaatttttagctcgatcggacttgtgactcaaccgcagatttaaaatacagccagaaat

SEQ ID NO: 751 - DNA, 1013 bp, Zea mays
  misc_feature (1)..(100): optimal_loci_229491_G1, chr6:132000151..132001163, Cluster 5
ggacacatattggtcgagcctccacggcaccccaaacatcgacacttagggcacctcaggcattggcctccagtgcacctcttgcctcggcccttatggcacctaacacattagcctaagtgcacctcgggcattgtcctatatggcacttcttgccctgaccctcagggcacctcgggcacctacttttagggcacctcttgccctagtttgtgtggcactttgtggattaggactggagcacccaaatattgctcagaattttcatcataatgcatgtgattgagctatgaaatgaacatgtttgatctagaagaatggaataagaaagacattactaaaacttaccacaaatgatagaacatggtgagttggaaataagattttacgtaacatgcattttaaacacctgcttttctttagaatatcgcattttgtgttcctacacaaccattttgctgatatgtattttggtgcttaacatattgttaaacaaaagtagttctttttgttgaaagagtcatcaagaatgaatgatttattttctatcacatacaaaagatgaattgtttgttttctacaaagcattggaatctctatgaaattttttaggtagcgaagggaagagaatggtgggcatggtgggcatacttattggttgcttgtcgtcaatgaagacctcaacaattggcgtacaatgatggcatcttctatatatgagatggaaaccgggagcagtgttgctactttttaatgtgtgagggtagtgtagcttgtgcacttgttcatgggtctatggcatggtcaaggcgattgccatctcaaatcatggtcaaggttgttgcaatggacgtggagtaggggagggtggcttgagcggtgggagaggatccatggtgaatgaatgtgcaagcgatgaaggagaagtgtgaaacgaggaggaggcgaggcgaggctcgatgcgccatggtggcaggggtacgacttgatcaaaggcgtggtggtggaggtgc

SEQ ID NO: 752 - DNA, 1016 bp, Zea mays
  misc_feature (1)..(100): optimal_loci_231904_G1, chr6:142765950..142766965, Cluster 5
ctcaattggtatctgtttggtttgattttgcattcaaaaactgaatttcgagctgctgaaaacaacattttgagcgatacggttttgagtcgtttcagatttttcggtgtcccttttgtgagccgtttgttcactggtcttgtgtgaatcctaggaatattttgaaaacatgaaatcacttgttctttggtgcggtttttggtttgagcgattctgtcatttccattaaaatttagtgctcaggttccggttttgaatgacagaattttattggctctcattcaccccctccggtcgcttttagaccttttacaattccgacaaatagataattattatattttttacagataatttggaaaagtcagaataagtaactttttcagaaccgatcctcctcgctttgcattccgtttcgtgagctttaatttaaatgatctgtgtaataaggactagtaatcctcgactctttacttcactagttcgtttgccgctaatgtcaaatttggcacaactcaaaccagatcatatgattgagattggtgcactaacatttgtgatttggaaaagaaaggtaataaagcaaaccgcagaaccatttcttctttttatttacgccagttgtgtttccagaggcattgtccacgtgtttttggaccaaaacgatggcgtttttttaataaccatgcgaaacaccgccagaagcccagaacagaacaaaacaaaaggtaaactagaaaaaaaaaactcagaagattccggtcattggaaatgaccaaaccagcacccagattacgaatcgcggaacggagcggtgcacgcccggcctcgacgacgttcgttgggtttgcattggggcggttccgtcgtcgcccgtcaagcacgtccgccgatgagacgagcacgcgaaacatgtggcggaatgggtgtgctgaccgtacaggctgcaaaaacgcacgtgctcaccagaagcaaggaccggcctgcagggcacggatcaaaagcgcggccggtct

SEQ ID NO: 753 - DNA, 1210 bp, Zea mays
  misc_feature (1)..(100): optimal_loci_232705_G1, chr6:147033325..147034534, Cluster 5
aaaaaaggagctaaaatcctgcgtgctccatgctgtctggtagaaccaactgaacatgagaactggtggtgggggcacagggcatctgcagattcgtctagagaacccaactcgcaaaaggccctgcaaaaattccccctcccccgggagttaggcggcccaaagtgccgctttcacgcgcgacgcaatcgagcctagtaagctgcgtgcagccaaagtaaaccgcagctttcacttgtgtccttttgcagggaatagtaataataaacaagagcggcggggcatgcttgcttgcttgcttgctttgggcgtgaaaaaagtgacattcccttggtaatcccttcttgcagcaggtccattcacctctctctagtccagttgggagcagggcagaaaagttgactgcgagctaaaacgttgcctagccgtcaggctaagcgaactgccagttcggttggcgttcatttgtttatatcatcactgctggtcaccatcgtcgcgagcggctgacagcacagcacagcacaggttaatttgcttccgtaaatgtccggggattcaggcagtttctgcatagagatggccatatctgcgatgtagtagggtaggacacaagaattgggacccaggtgctcattagccagaggactagccaactgactagtgacaagattgggggctgttttctgaaagagagaaaaaaaaattgtcgtcttctagaatagaaggaaaacgggccgggggagaaaaatcttcgtgccagtcttatctcgtgacagcatcacacctttgtacttttgctgttttgttaggcgagtcaagccaatccctccatctttttttgcctatatacatatataactaaacaaaaggagttccctagaagccgacctctccatgtccaatatataacgggggtagtactattcgatagaattagacatttcattcacagaagcccaaatatataatggcaaaaaaattgttttgccagttcaatagaagaaacaaatttttggtaaggctaatagagatcatgcatgtagaacaggtagatgctagatgacattgccgcacaaagctgatactgcaaagataccagtgaatttcactggtccagtccagctgtggcctgcaacaacagttcagagatcagatgatggtctggttccggggtatgatctgaaccgtatttaacaagtccgttcgg

SEQ ID NO: 754 - DNA, 1021 bp, Zea mays
  misc_feature (1)..(100): optimal_loci_234749_G1, chr6:156052609..156053629, Cluster 5
cttagaaaaatagatctctcttgaaaaaatgtgaaggagattgtgcgactaagcaacctgcagttccctccacattttcgcatccgggcttgggaccggcaaaggcagtgttaaaccgcaaacaaacaaacaaacaaataatcagaacacatataatacccaacaaaaaaaatatcatgttctcagcattataaaaagaaacaaacaacgtaaccggtttttgtgccaaacgaagtattctacaacaaagacgctacgtaaaaaacagtaaataacttcgctgcaacaatcaataagtaaacctagtacgagcaggagcaggtatctagagtattttatttagtcacaggactgaacattcaacgtgtgccaattgtaaaacatcacaagcttccagttaatttcgtccaacaaaactagtgagtcttccatctatttggcagaagatgctccaataaaaatcattgcatgatcggactcaaaacatgccacagttatgtttgccaataaaactaggaatccatccaatttggcctaggcagaagatgctcaattgccacaagatcagctctaataaaaatcatggaatggccggactcaaaccaaaacatgccatagttaatcttctattaggaaccattgttttcagaatatccttaaacccgaaatcaacaataatagtgaacctgcaccatcatatgaggcatataggttaaggacagcttcaaataaagttagcgcaaagaattatttatcactggaaggaagactccatagtgggaaatgtctagaactcatgtctaactagcaacccgcaccttagctccaactgcagaaatccaaccaaacatccatcaacttaaatcagacaactggatccaaaataaatggctgatatgagcaaaagttttaggtgaactctggttagattgaagaatattaagatgtctcaaacaaaacaagggaactggaatagtcagagtagttagcgcaaactaccgcagagcatgaaaacaacatg

SEQ ID NO: 755 - DNA, 1076 bp, Zea mays
  misc_feature (1)..(100): optimal_loci_234828_G1, chr6:156410271..156411346, Cluster 5
ggcgcataggacatcgtaacccgagagctgatggggcacaacgaggggattctttttaaccaagcctgaaaaatcgccccccgggggggggggggggggggtcgagcccaggacttggaggtcctactcggaagcccttaatcactagactagaggccctttcactaaaaacactcctaggtttcccaaggtgtcaagaaatgttaagatacgatcctcatgatccaaaggtacgctcctaggatcacgaaggcctatctctaggagaccatagaggaccgtaccttcgtgatcctcaaggtgtgattccctcaaagtcaagaaatgttaagatgacatgtcctcgtgatcatggagtcaattcattgaaaccctcctaggttttgccttcaaaatacgatagtacatccaaatgttatgtcatcatgagtccttgatcctcaaggaaaccaagcttgagtctacatagagaagcaagaaggcagaagaaggaatgcaaccatggaaccaaccaccttgtacgaagcatctactaatgtggatggcacaccaaagaccacatgttcttcccccactaaaaaaggttgttcacatgtcattaacttttacatgcatcgagatcaagaaaagacttggatggctagcatggataagtggacaacctaagataggcttcaattttcattggaataccattgtaccctataggagaaccaaaactaatttatttggtagtaggcagatgatggtttagcaaaaaaaatcttataaaattaagagttgtttgatgccaccaatcacacaacgatgaactagaagtaaagaaatctccttggacaattttattgctgaaagaagtatatcaagtgtgaccaatttggaaaaacaaagcgatgatcacatgtttgtgtcttgaaccaatgcccactttccgaacatgaagacatccaagacttgcttgtaccatgtgtctttgcaagagagttttgacacaagctcttcacccatcggccgcaagagctaacagaagtttaagcgagctagagggatatcgtcgaagggtgcattgtgattag

SEQ ID NO: 756 - DNA, 1354 bp, Zea mays
  misc_feature (1)..(100): optimal_loci_239023_G1, chr7:10541913..10543266, Cluster 5
ttaaactgacttataacccgtgccaaatctttgctgagaagtgagaacagcagttcagcactgctcagcctcgtctcctccgatatggcctagtgcgtattgaatcttggtagagaactgtatttgcgtcgccccctcctttattttctatgtttactctcttgtctcctgctcttggctcttttaggttgatccgtttaatgtgttcactatagcacgacatcaaagcaagagttctcgagttttctgaaccacggtccatgaagtgattgaacagttgtagctgatgtgagatttttcaaggtgctcgttgttttggtagctagggactatactattgctatagagctatactactatgtatggttcttttgattgctaatgcacatagtagagagcatggcaaggttctgtctcgcaacgcaacattatggtttggttttcgatgtgcctctctactaggtcctataaggtcgctagcagtgcttagaacacttgaacagctgcgtccatggctccatgcgtgtgatcgtgtaaaggtgtagcgacatctgtgttggttgccttcgtacgtatgctggggcgacaaatgatcagattctactatttccatgttacagttctgagaggctaaattttatagcccgtttggatgtagatactgatgcatggaattgtgaattggaattagtttttctatattctgttgttatgttggaattgtgaattgtgaattgagatttggaattagagatctaattacagggaataattggtttataactagaaacccactcacctaataaaaacagcacccctttgaattgcgtggaattagaccacacgattctaaatttcaattccgtgatttccaaaaaaaaaagaagaattggaattacatcatttcttgaaagttgttgcaccgcgttgcagtgttcgattaaatggtttccatattaatcaatgtcctcattaacatctagtgaaaatttaaggtatccagagcctactattgtgttctcccaaaaaaaaaggaggcacatgcccccctctggtcattatacatataagtagttttagatttactagaccaactcgaacattttaagtagcttttaccatcagttagcgaaaagataccaagctccgtgttctaactcttattttcaagctcaactgtggtttacgctcattttccaacgacgtgagtttgcaccctttttttttgtttgaaccgaaggtagtgttttcccttattctattaggctatctcccctattccacctcgcttctttctccttattttcaaactaaattgtgtagtctatagtgcaaacaatattttttacggccg

SEQ ID NO: 757 - DNA, 1341 bp, Zea mays
  misc_feature (1)..(100): optimal_loci_239347_G1, chr7:12455390..12456730, Cluster 5
cttgcaaacgtattaaccctgtatgtgggaaaggattgccttcatctacaatccaaaaggaaaacgaatatctataaacacagtcagaaaaatgagaaaaggatgattaagtttgtttcttgaacagcacaaactcacatgtaagcagcacatgacagaagaaatgctagaatcctagttttttagccaaagtaaacaccaaaaaaagtcaatttagaaggaacatgttccaatcttatttcctatttgtgccaaatgctcaatgtctaatgcaccttggtttcacacttcactactaaactctttatatagactactgcttcttaacatcaagcagacacatgagcgctttgctgggcacaccttttgtttatcatccacaagttgcatattcatggacataataacaaagtagcaataagcaaccgaactgcaaattgcagcaggatgttagtcctgaaatgctaagcaaacataaatatggtaatcaagcaatacagttttaaaaagggagttgtgtctaaattatttggtccatttaaatgctaagcaaaacaaagaagataagtaaatttccaattatagagattcctgaataaacaaaagtcaataagaaccggtaaacaaactgcataaagaaccccctacaacaagcatgtttactaatacaggacaccaagactgaagaatatgtataagaattcatagaatttctctgtacattagcatagaagaaagtttgattgtcctcaataaatacaatcaggatgaaataataacagaaggccattgaataaaaacagtgtcatgaaacatagatgaggtaacaaaaacatataaatcatgaaatgttttcgttgaggtcaaagtgcaaggtggcaataaaacgagagaattccctatttaacgctagtatatgagtgcttccttctatggccatgaaaagtacatacccctttgatgcaggatctaacctttattcttaataacactaatgttaactattccatcaagactctaatgaatgctttgtgaaaagatggggttgcacttatggtttgcaattctgctagtaacagctagagcagcagctggtggagcatctatgtttcaagcatttgcatttcagaattttagtaatcggtattcaagaaaggtagtttgatattgcatgcaacttgtgttaaatgcatggggttacacttgtaggaacctaaaaatctaaaaaattttgaactatcacttaccataggaactacaaaactgaagaacctgagcagtaacatttttctataagaattaagctctttttattgttgtaacaccaatccttttgtgagg

SEQ ID NO: 758 - DNA, 1335 bp, Zea mays
  misc_feature (1)..(100): optimal_loci_240602_G1, chr7:18434944..18436278, Cluster 5
tttgtgcgctattgcattttaatttgcagctcgatggcagggtccaaaattcgtggtctcttgaaacagggaatctttgtcctcggaagatcaggaaccagaaacatttactatatagtactataataaattcacaaaaaaatggtacgaactactgtgtgctcgtgtgctaacacttggctagtaaaataagcctgcctagaggatgaaacgggggtgaattcttacttctaaagtcctgtttggaaccaagccaatttttaagaaacaagtttttattttttagctaggggagatcaatttctttgtttcaagaaactggaaatccaatttctataaactgaagtataaactggtatatttataaccacttcaatttttataaaccagtttcttaaaaaccgagtgcttccaaacatgccttaagttcgtttcaaaacttataaaaaacatgtccatgagttaggccggatatccatcaaacacaactacacaagcaaccgattctggtgggtgtatagattgattattgaatggtacgatgaaacaatatataagctcaaagtcacctctctctctctcttgccaaagaggtggcttcgacgaaaacaaaaaagaaaacggagaggacggaacagaacacggattgactaaagctttatttttagttcagtctcatttcttgcattacgatcgatgatcccatgcatgcatgcacggttagttgcgcattgccttccatgaccagaaaccttgccgcggcacagccattcaggtagctttcgtcgtcaggtcgccgccgcgactttttctagcaggcaggcaggcaggcagcccacacctgacagttcccgacgacagcgaaagctttgcataaacagggcaattcggttgcgagctttccttgggtctctcttgtatcagtcgcatcactcacatgacacgaaaatagtggtgtgatttggtctcatattgtggatttggcaaaatccagttcagcctgcgttccccgtcgttgccctgttaactcctcctgggctcgactcacttctggcccataacgcgtcctctaacgggtccgctccctctgatttgttgctcggatgggtagagcgagcctggtccagatccaaggtgcagggttgagcccaacatgtatatctggttccttaaaacctgaagccacttcgagctctccccgcgtctcgtgcgctctcggtcgcgtgcgtgccgacgcgtgcccagggattcggacccgaaaatattactcattttagttatgagtggtaccgtgcgtccgtgccttcacaagctgtctctgtcgccgcgcacatg

SEQ ID NO: 759 - DNA, 1057 bp, Zea mays
  misc_feature (1)..(100): optimal_loci_241008_G1, chr7:20726042..20727098, Cluster 5
attcattattgtccacctgatgccaactggataaccattctcaaactcatagcatgtctagctatcctcatgtaaggccgactatgattcggagagaccagccagtggccatggtgttgctaaagacatggcattataagtaaaaatataatattgtgccagatgtacatggtgcgaagtggcagacgcagaatggatcgaggagtgtgcctctttctcgatgtctcaaattcccatgattcatgtacctctcatcatattatttgttgatactaacacactaataatgtgttcactaaaaggagtggtgctatcatgtcatgtgtggagtggcaaatacaggtatagatcagcatgtgtgtgctatcaaatttatattgacatccctataggtttcatcgatgtgatggtaggtaactaatttgtgcataatatatgataaactttttgtggtagttggaacttggaaaagatatgggctgtccatcaagagagattgaatgatacataaaaatacagtgtacttattgaaagtaccttaatcaaacatcctaggatactacatgtacaacctagatactatgtggtggttcatcatgcactagatacacatgagaaactccttcatacaacccaatatacttaagccttgtatcttattcattagaacccctcaagatatagctcatttatgtgagttgtatggatgaaattatatctaaacttagaaaaccgtgctagatatgttccttcactaagatacgtctcttgtatctttttttacttaccctattgatactgcttaagatatacgaatcacttatgtgggttgtacaagccctaaaaggtaggtgaaaccagcgtccatatattattgtagtatttattggttaaccaaaggctaaacgagtttctttacgacgatgttgatctacaggccagcatcctatggctctggcaatcacctactaactactatggctttcttggagctatttgagctcgttatgctcttaaggattggggaaaagttggattggatcctctaccaccattc

SEQ ID NO: 760 - DNA, 1185 bp, Zea mays
  misc_feature (1)..(100): optimal_loci_253330_G1, chr7:103868546..103869730, Cluster 5
gctcgtcatagactagacaagcctactagtcatggctaatgttacatcgttgaaatgcatcttgatgttgttgggatgttcatttaattatgactgaattgtacagtgagaactcatcactaaaaaatttatgacttggttaataatggctttaatttatgtatatcaaatattaaaatagtgtcggtttcatttattttgaatggtgttatcttattgaattgaagatatcattctaagtatggtaatatatgaccagaaaggtgaccatattcagtccatccctaatcacgaaacaaacaagagatggtgtagctccaacctactttaaccctgtaatcaaataagaaattatgttcaacttgtcactgaaatcaaacaaggaacaagtccgacccaacccagaaaaatgaatcggctcctatccgacccacgtcgttctgaaaccaaatacatgcttatagaagagaacatgccaaaagatgtaacataatgtgagcaatatatatggagtgattcgttgtttgtttgtgaagcccgtgtcagctgcctgcaagccgctcgacggcagtggtctctcttagtcccgtccaatttatatagattaagatcaaaccgaataaaccatatataggtttatttatttttgtgtggatgtgtagaaaataaacttacagaaattaagtctactgaacgggtcatgaacaaacccgttttcgttcatgtgagacccgaatataaatcagttcgttcttaaggattcaggaatattctagctatttttgtgacacgcgaatttcacttcgacggattgttatgctttttataaaaaaaactatgtttttctgcatagaaaatctctatggtggtataaggctgaagaaagaaatgcctatgattagttgtctgtagagggctaacgatcagaaattttcaagtttatttcattataaaaatacacatgaaaccacactattaataatattaataataatggaaagtatatatcgataagaaaaagtttgtcctttaggactgaaaggtgcatgttgcccaaaaaagagatgccttcagcagcataaaaaatctctatggtggtataaggctgaagaaagaaatgtatatgattagttgtttgtagaaggctaacgatcagaaattttaaagtttattttatttataaaa

SEQ ID NO: 761 - DNA, 1390 bp, Zea mays
  misc_feature (1)..(100): optimal_loci_254375_G1, chr7:109342070..109343459, Cluster 5
ccaactgtaccgcgtggtttttacaaccgatctatatacgtacatagaagcatgaaagtgtcaacggagtggggtctggtcatgatatatatagttgtttgcaacagactcaaggtcggtatatattcaattattcatatgtagtacgttatatgtgcggtagaattgacggtcgatcaggaggtacatgcatgcacagtgttctgcgcatgattgcatgcaaaagctctctctctctcgctctctcttcaagcgtaagcaaagcaaaacagcatgccatgcacgtactacggtcaactcaactgaacggacttttaatatacaaggacatatgcagtatatattaattgctgccttacgacgagcacaaaaaaaagcagcttaatttgtgggaattcgatcagatcgtctgcagctagctagcttgcttctcaagtcgatctatgatctgagctggcgttcagctaggctctcgtatatatatatatatatacctatagatgtatagtggtaaacaatgtggttttattttatatatatatatatatataatgtaataataataataataataataaaccgtctccaaactgaagtcaaccagaaaaaaaaaccaccatgttttccgttgtacttggcagcggctcaactcagacgcacgcacggcatgcacagcatgtattcatcccaaaacatgctgcttcgttcaatggttgttggtcttcactcttcagaagtgtgtgagaagaagggaaaaaaaaacgacgtatatgctctctatccagaggcacgccgttgaggcaagcaactgttccaaggccatgctgaccgtgcggggcggcatctcggtgacgatcgaccagcctaaagaatctccacgctaggaggagttctaagctaagctctagctagggggcaggtacgtggtgtagctagctagggcagttgaagctggcaatcgcgatcactcgaccctttttttttggggggcaggggcgggatttgtaaatgcgcggcttgacgacgaatgggatcgccgcacaacctaacgagcgagagagccggtacgctttcatgacttcaacccagatttcgcgtaatcgctcgcggtaactagtcatcagtcctcacatatgctaataatagtcgccgccgacagtgtcgcgtgttttctggagacttggcaaccagcagtaagctagtactagtctactaccctcggcctaaccctgaacaccaccccggccggtagttttggtctcctctcagacatcctggtttgctggagaaattaacaattgctgctagctagctactataagagcaagtttaataacatagacatacgagctataaggatctttatagcctgttatttagcacatccata

SEQ ID NO: 762 - DNA, 1219 bp, Zea mays
  misc_feature (1)..(100): optimal_loci_256616_G1, chr7:121278446..121279664, Cluster 5
ctcgccgaccccaaccaccgcaacatcttctccgtacgtgccccgccgctagccctttaagataatcgccgtcttgcattgcttgtttcgttagccaccatttttgctcggaaaacgttgggtttaatttggttggtttcttacacactgcatgcaggcgctcacgtcccactgatacgatgttgcttcggagctgacttcaggcgttcacgtcccactgataataagattattacctggcctattcagtttggtgtttgctaacggtgaagtgatcaggctgctaacatcatagggccgcgtgctgcttcagcctgtcactgtgcactgcagaggtaaacaaagggagtatagtgtgcgatcaatgcaactgcttggtatagccagagtgatcgtgctacaacttgacatgtccttgagcagttgagctgctacgtctgtttgtcacaaacatcctatcgttcggttcctgtcaatctgacaaaatctccgtggacagtggacgccgaaacaatgatatcaagatggtgggaggagattattctggtccagctccacatttgagctgacattacctagtactagctagtaagtgtacgtttatcctgttatccacctgtacgattcgtaggaaacgcagagccgacgacgcctagcagctaaacgacgagccgtgaggtaatccgcgtgcagctggaggctggagaagggcagatcgtgccaagatgtgcaggatgtcatacatcagcggggtagctaggattttttttctccaaaagatttttttttaataaattataatccataatagtttggtatacaattcagaatataaagataataataacatatgaaactatagatctaatatttaagtctataagcgcatcattagaatgcaaaataatatgatcataactcaattgattatgaggtacgaaccattgctcgttgtgagataaactaatagacatactccaacagtccaacagtgaggtgttttgatgcaataaaagatacgacatccacactccatcttacatgtgttgcttgactcatttgagaaatcgttcttactgatttttgcaattaagcacacaatgttgttgtcctgtcgtcggtttgagaaatacaaaccaaatttggtgtgtatgtagcaatagtaagaatagatctaacccctcttaaactagccttattagtttcaggtgctgaagag

SEQ ID NO: 763 - DNA, 1153 bp, Zea mays
  misc_feature (1)..(100): optimal_loci_25737_G1, chr1:156206470..156207622, Cluster 5
atccatcttcgagcactccgtagctcactattcaaagtgagtccgcgctaacacccctgccgaacataaatattcttgtcccccgttccagaaaccacgacacccgtgttcccaaaccagatcagtctgttccgacatctctgaaaatagcaataatatcaactattattataagtagcagcaccaatactaaatagatttgaagttaaaagagagaaaattcccaaaacctagctactagagcccccggtttaatctatttgggacccattaatcggctagcggggggcggctaataaccaaaatcgtcgggtttatctctttttttattttatttttgaaacttgtttgatttttagtttgaaatccgttgtgcgttatcaaatttggtttcagtgaaaaatccagtccataatatttatagaaaaattggcattagatttttttcagatttacaaaatatcctaaattcaaatgggtcttgtttattgattattgatttatcggccagttagccgaattaatcgaacgatttcgcgaaccttgggtgggaaggacggagatgtgccttggccgtcctgtttgctatggctgacagacagtgtttgtgcttcatttgtagtgtgtcaaaatgttagcttagctttgatttgattatttgctgcctgatctgagcgcaggtatgctgtaaaacgtaatggctgacacacacatcgttaactactagcagctcatcatgattttgttcaacaacataaccacgagctgatgttgttattagtaaaaaggaagaattccgatcctacgtatagctcaccagcatctggtggtgttgatgtaatctagcaatcagcatgggacagatttgcagggtagctagatggatagatagatttggtataaccactgggtatatactcagggagcatcgatccacgtattattaaccaaacggtgctttatattgtgctgcacatgggatgatgccaaatacgtttgcaaatgcgtggatcggacaggcagacagtccactagaccacggaagatcttcaccgtatattgttggtttgtggaatcggtaatataaaagtggtagtctgctgccagttctaaaaccggcagtgatgaggtttttcaaaacaccaaaaattga

SEQ ID NO: 764 - DNA, 1160 bp, Zea mays
  misc_feature (1)..(100): optimal_loci_260062_G1, chr7:140248342..140249501, Cluster 5
taagtaaatatatattagagatatattttactttaaatttttatactacgtatttgtcatagtttcaaatgtattgtataaattttaattttgctaaagttagtgtttaaaatattaatatagatagatgagatgagagagaaactatatacataataaaggattcagcagcgtctgctggagacatgaaaaaatgtgaatctttttcataatttaaaatataggaggctttaaaccggagaggcttctttgatcaacgttcggcagcaggcctgcagtgcacagctactgcaccgtgtcgtttcggtgggctgtggtagggggctagggccacagcttctctgctgcgggaggcgggagccaacggactttggccctttgttttttttgcatgtttattaatacaaatccagcaggcatcaggctcggctttaataagtgccgccaggaaacacgggcatggcgtgcgtagacgctttgactacacgggccgttgtgtcctggagacctgcagcctggtgcccatttcaggccttgagatctggaaaaaagtttgcatctttgcgagggagacgcaagttttaccgcagccgctcccctcgcctgaagacgttcaaagggcctctcgaaaatggccaacaagatcgagcgaacggaaaccaacgattggattggaatttggatccgatcaaagagacaatgtagaagcggatcaagtgcggcacaaagcgggggcgatctctacgccggcgaagcacacggtgctgaagcggcggtggcgtacgacacgggcaaggacatgtagaagcggcgacgagaggagagcgcgagatgaggatagtggagtgggttgctacgttttctttgcatgagtaatgggagaaaagagacgacaacgaaaaatggccatgggctagggaccgacagagggaatgcgtcgcaacaggagaagaaagcgtgacatggcgtcgggagaagcccagaatgctcttcggttaaatatagaagatttgcaattcttttgagttaaggagtgacaatctctaaatagagttcaactcattttttattacatacttttattgtttgattcaataggaacatgcattatattttatttaattaaatcaaactaatcatagatacatattaattgtgtt

SEQ ID NO: 765 - DNA, 1013 bp, Zea mays
  misc_feature (1)..(100): optimal_loci_26033_G1, chr1:158192453..158193465, Cluster 5
tgtagcctgaaaacggcatgggcctaataagtgccaccacctaaaattatctgtgttcttttccttctccaaacgaaacgagagtagtgagattatctgaacctgtgttgctgccgttgataggagcagcatcaagtactcccggctagcacagatgttatgcctctctagaaaaatgttgcgatggtgatggtctgacggagggaacagagcaaaggagctgagccccacaacacacacatccctgctccatcgggattcgggcggaagattcttgctccatttcttggccaaagttgaccagtggagaatttaataaatatatatatatatatatattattactcatataaaaggggcacctcattttacagcacatcgaggtgtacttgctcattttacagcaagcaaagcaagcaagaggtgaggcggctccagcggtcacgtgacggacgggcgttttgtttatggttgcatcgcatccgcgtcagaaactcagaagaagatgggggaagagcacgaaaaggacagtctccgagatctgccaggggcattttcgccatttctttatgccgaccaaggcggccctaagatcccccgagatcttctgcgcccaacaagcatgctagtgtctgcttgctcgcgggtgctgtggctgacggcgatggctgctgcgtctctatttccggtgtgctgccatgaaaattcgaaagtgtggacctggtgtggattattggagtctaggccaataaatcatggaacgcgaacacttttccagctttaggttattcaggccatttccagtgagcgagagtttcatggtattttcattctcattaaatgagataacacatcaccatatttgatgacataacgcggtatttataatgagagagattgagaaagtttcataggaggagagaggatctcatccagatgaaactcatgatacacgattttatagacaaaagctgatgtgtcaattttgaggaaatcgtgcaataaaacttcca

SEQ ID NO: 766 - DNA, 1250 bp, Zea mays
  misc_feature (1)..(100): optimal_loci_260489_G1, chr7:142885945..142887194, Cluster 5
tatctctaatagcttacccatccttataccatattcaaacttcaccctgcgcccagtgcaaacaatattttggttaaccatacgagtgacatgccggacacggtttcatatttatattttttttacatagcggaattgtgtatataaatatgagtgctttaatatttatagagagaaaaacatggttggttcttgaacttggcgtaaaatgtcattcaggtccatgtactgttgaaatgatatgtttagatcctacacttggtctcatatgagtctaaacaggtcttaatatactctgcatgccgatatttctttgcctcatactctcatagagtccaaacagatattaaaccactattccactatagctacttgccgacgtgagacgtgacatggcgactatgcatttgactgtccccccgggttaggtccacggtcatctctgtctgcgaatccacctgctcatcaccggtcgtccctggaccctgtgtggtgcttctccatggcgtcctcgttcttgccgacgagccccgtccacacgccgcggaggcactgaggcagtactggttctcgaagtacatcctgtccatccaccgttccgtctcggtgatgagcacgtggacgagcgtggactagtcatcggcctcgaccgccggccgccccgcaagcgtcgtcgcctaggcgccatgacggccaaggcgtcgagcacatccagcgactattggcagctgcggagcaagaagctggcggcctccagccactccacctcctggggtgcgcaagcatgaggcgccgcaggccgcagcagcgggattttggcccacccgccacggttgtcggttggacgtacgtagatgagaagtgtggcttggggagccgtggccgaggacggcggctgtcggcctcgtggtcccacccggagccagtcttccgcgacgaagagagcgaaacagagagggagaaggacgaaggagaagaaacagaagggagagaagcgcgcatatgacaaatgggttccaatttgtcgaatgcatagaatagtcaacgtgtatagtgggttaacatctatctggatacataatagatcgaaaacagtacattaaattcgagaatcagtcatgatttttttctctattttatatatacttgattaaatttaaacgatttgcacatggactggcagaggaagtaggtgtcgccgcatcttcctaagagttcaagcttttaagtgaattggtgcatccaactta

SEQ ID NO: 767 - DNA, 1145 bp, Zea mays
  misc_feature (1)..(100): optimal_loci_260782_G1, chr7:144305327..144306471, Cluster 5
ggccattttcggtggaagtttcattgcacggttttcaaaagtgacacatcattttttgtctatgaaagagtgtatcctgagctctctcctcccttgaaactctctacatctctctcatcataaataccgcgtcatgtcactaaatatggtgatatgtcatcttattcaatgagaatgaaactacgataaaactcccaccaagaatggacttaatacataattttatctttgttgttttctaggtcatgcttaagacacaaacatcttgaaaacagtgaacatatggtttcattctcatgccgagtattttatctctctttcatcattaatacattgatacatcatcaaaaacgctgacatgacagcctatttaacgcccataaagaataatgaacaaagtagataaatgtgcatatatatgcaggcaagcaagcagtgctgcatgcatccagttgtgcatgacagcgatagaccaatggtacaaactacaaacgtacctgggcatatggatagcaggaacggctgttacgtacgtcggtacgaaaggaatcctgggccgctgatcgccggcatgcaggttgggtccgcacggacggcggccacagatgcacgcaagagaagagaaatatatcatactccttgattgcgtcgagatcagaagaatcctcacttgcattgtgtcacacattattattagcctggctgccaggcaaatttaaccagcttaattacatgcacgttcattggagacgacagagaaggcggtatacatgcatatctctgaaaacgattcatgcatgcacgaaaccaaggcattgcattgcgccacgtggcctgcttctcactcaagcgttggatatctcaaacgaacgtcatgaaacgattcaacgtggcttgtacaaatgtctaccggttccaaatcctccgtgaagtctcccggctagaagagtgagcctttcgtcgcttcgcagagatgaaagagtcacttcacgaaggctcacgccgtctcagatgagagggaggagatgaacgcgatgtccacatctatctaattaaggcaagatcgcgagcatttctagtacatgcataaggttagaaaatgcatgtaaactgcatgcataacacatacgacaaattaactaggt

SEQ ID NO: 768 - DNA, 1255 bp, Zea mays
  misc_feature (1)..(100): optimal_loci_260802_G1, chr7:144542901..144544155, Cluster 5
gcgtctggcccgtgccgaacgtcgtttgaccatctataggcgtgcaatgattaatttgaaatagctgtaaggggttatttataaaaagatgacgcatgacgaccgttgaaactggtgctttaagtataaaaatatagaatttgtgaaacccctaacagctgggacgacatccggaaaattctgcatttgcacttgcaccacgcctagtaccgatgatcggcgaggatgcatgcacacagttttttgtgtgctgccaccaataatgctagctagctaggtccagtgcaggacaggactccagctgatgcatgagcatacatgtggtgttgtcaaatttgttcccttgcggtggagtgcatcagtacgtcgccatcggccacacgcgcgcgcgagcgccaaagagcgaggaccacacagccacccacacacccatattgtcaaaatcaccaaccgcggcagcaacaacaaatcgcatatatatggaatcctgtcacagtccctcagagctcactgttggcgtaacgcgtagcagcctgcaatgagaggatctgctggtgcagctcagctagggtttaatttgttggtttgccagtgggatccgatccggcgagctgcaggccctgaccgatcgagcatgccaacactgctcgaatggatgggtcacatcaccgacctagcttataggatggatggatgatcgtcacctatatatattgtgacgaatagcgcatctcatgctggacgtacggatgagcgcgctatcgatctgaagcaacctgaaatggggagtcgtcgtcactgcatgtaccggcgggccgaatgaattgtgtaaacaattgcttttcaaaaagcctgctgattcttaattaaaaactgaagaagatcgaaaaaaaactggaggaatccaaacatatcattaataccatgctgtgtcgccggtgctgctagttgttacctttatttatttattattagcgatagatcgtgtgtagaagaattaaacattccttccttttgcagcaatcattaataccgtacgtaccccaagcaagctagtaattagttgttggtacacacgcacgcacgctcttatccatcccctattcccctccctcctgcatacatccagcaataatatgcaagaagaattaaacattccttccttttgcaccaatcattgggcaaagcgatcgtcgtcgtcaacacgatatatgtgaataagaataatgtatgagcaagagggctcccctcagct

SEQ ID NO: 769 - DNA, 1166 bp, Zea mays
  misc_feature (1)..(100): optimal_loci_261799_G1, chr7:150078037..150079202, Cluster 5
cacatgacaataatatgcatatcataactaccagtatattaatataattcatgcatgcgtcataactaccggctgtatttctagtagttcatgagtgacaagaaaacgaagaagattgttactcatacttatgatttgttgagttgttccatttaaccgtagtgtgtgatagctggtgtctcaattaacaaacagtgtattatgtagccatcaaagtataccggtcctgcagcaggtcaatgtataagcaggcaacctgactgagtcgatcggtcggtcactctatagtctatacgcggtggttcagaaattaaagagacgggggtacgtatcgagaacagtttagaccggcctccagacgcttcatcagcccaagaaacttctaccgtcgtcgttcccttttcgactcatcgatttgttcattttattgtatatatatgcaggaatataatatagaggatctgtgcaagaatataatatagagatgttggagggttgagcagcaatgcaatgcaaggacacctagacgacgtacggcaccagcagcagcaacacaaaggacggacgagttgcacgcatgcatgcacaccgacagacagtgagcttgcacccgagcgcatatataccaattccatgctctgcctgtgtgtgagtggtgtcttgtgcttcaagagttgaggccggccggcagcttccctgcgacgcatgcatgcatcctcccaactggacttggactctcacaagttttagcaaatgattagctaggcggcaattaacactaatcgtttggtactcaatcttatggctagcaagcaagcaagctagggcaaaggtccaagaattaatacttggaagatccccccagctggccgctcttgattgagtacaaacgacgccactcacgcatgcatttctagctgctaattattcgagatcatccgccattcactccttcagttctcgaggcaaaacatgctctttactaatttgttggaatttcattatatagtaacgtaattatacaattaaagatggcatcttccacttacgagagaaatatttcaaacaaacaataaataaataaatggcgtttcatagagcagaacatcttccttctacacacaaaataatgtattcaagagtcaaaatgtacgtggactaattag

SEQ ID NO: 770 - DNA, 1373 bp, Zea mays
  misc_feature (1)..(100): optimal_loci_26389_G1, chr1:160673396..160674768, Cluster 5
ttcctctcaagtgaacgatgcaaggacggaccctagaggaaacgacgcctagaagaccgacgaataggaggatgacctgaaggccggatgtaatacccaaaattagtgaataaaggggggaaaaggttatgaaagtatatgtaaatgtattccttatttatttaccatataaattcccatgatttgtgatgaagtcaattaactaatgataagccaaacaagtctacgcatctcatgctggatttcttgttgtgcatttaactaaactatgcaaactcaacttaaaattcaagataattagaaatcacattttaaatttgaaaatggaaagagaaggaaagaaaataaataaaaaaaagaaaaggaaagaaaagagaaaaccctcgtgctgggccaaaatcacgggacgacccaacactgttgacccgtgtgccaggcggcagcgacacgtggggcccgcgtgccagccgcaccaacaaactcgcctctcagcctctctgtagccgacaggtgggccctggtggcccttactcatgagtccgcgcgagccctggttcctgctgtcactggtgtgtgggacccccggtcggagtcatcacgtccttcaccatagccgtcgttgctctgtacgagtccaccagtgcgggaacctgagtatcccaacaaactcggcctctgccgttacgtccttggccgcctcatgccgctatatcgcttgcgtcctccttcacacgaagctagagccgccaacaccgagagtctcacgtgtagggaaggcagccttcttcgatgatactcgcttacatcgacgctctggtcatggtggaggttcgagaaccgtcgtcgagttgcgtggtaggcgcctaggattgtttgccggagtcgcgggtctttgcggaaccgcccagtgccacgaacgagagcctcgacgccgtcctaactctggtaaaccttacacatgccttcaccttcgatttcataccatgtagcaccgatctatgtaggttgaaatgctcatgtgagtcgtgaattgctcgtcgacgttgagctcagccatgtatccgcgcctcaccgtgggtacaacacggtattgcattcttcccgactgggagactccgatctggctcatagtgtaccagggagtttgcagcgccctttgatattgtggttgggcgtcgggggaggcagggcacggtggaccgataatggcgccgtcgttcggctgaccagattggggaagatgatggcgaggcatcgatgcatggataaacagacatgagtagctcggtgaagcgttttagcgagatttaaggggccgttggatcttgaggtgatgaacgagattagatccatgtaccgatgcgaccgacatg

SEQ ID NO: 771 - DNA, 1359 bp, Zea mays
  misc_feature (1)..(100): optimal_loci_264147_G1, chr7:162197000..162198358, Cluster 5
gctgggcagtacaataatcccgtctttttaaccactcacgcatcgatcatcccatagtctgactgataacactgttacctatctaataaattctgttgtcagaagaaacaatccggatcttgcagcttgttgttctatacagcatatactacaattgctacgaatccaaagaagttcgttcttgtgttacgaggaagctttgtcagtccaaactagacgtaagctagtgtctcatcacagagaatataatggactgtacgtagacgcacaatatttgtcgacacctaattaagcaggcaaactggcattagctatatgcacttatgctagcccggccagctctccgttacagtatttgtttagcacgcgtgtagatgccgataaagctaagctaacgatgcatattagcttgtgatcccaatttgatggcgcttttaaaaaactacaactggtctccaaggataagaaacaaaaagtacgaacccggaatctattctcccccgcgcatacgcttgctgatgcacaaaccacatggatttgagtgacatctaccctaccctaaacaatgattggcagccagtagcagcactgacagtgcttcaaactataccatgtccacgctgcatgcatagataactgggcgagagtgagagccgcgcatgcagcgatcgactggtttaacatctaaagacttttggagagacaagatattaaacgtgagctagacgagcgagatcgatgcgcacgagtaaacaatggccatcctctcgcacatcagctcagaatcccaggcgcttgtcgcgacgcctttggactcctcatgtccggggcatatccatggacgacggggggaaagcgcctctccaacgcccgcaacccccgagcacatggcaacactcgcctcgctttcatggcgcccgcacatcttgttccctgcggcgtcggcttggaacaatccacgcgggttcggtgtctaaaagggaatttccctcgaaaagttcaaatgcccctgcctagctgcttggccgcacgcgcttttaggttttgcatcctctagtctagttgcgctaaaacaatacggagtactcttataataatgcactgctagtcttctcgttgctggctgcagccaaatataaaagaccacgatagccttcaacccgcaagcaactaataacactctgaggggagcggactgatgatctgacaacaaagagaattgcccctcgagaaaaaagctgaaacggcttaatttagcctagctatagcttgctgctttgtcagcttgcccttgtatcttcggcgcgatggatccattttagttagcgcctgatcagcatgtggattactataatgcgg

SEQ ID NO: 772 - DNA, 1038 bp, Zea mays
  misc_feature (1)..(100): optimal_loci_264770_G1, chr7:165802640..165803677, Cluster 5
ctgcagccaaagcaacagattcaggcacccgtgagcgtagcctccgttcaaagttcaacagattcagggcctaaaagtccgcaggtagaatctttagaatgtcagctataagttattaactgagggcaagacttaaacctgaggtccttgaatcttattacaacacatatatacatctggtatcgccttttagtttaggtgctaagcaattgttacggtatctcagattttccaaaattagtatgcctacattaccttctttcctagtagcatacacattcgaaacaattatcgtcactaaataagtcatagcgcatacattattagcattgatgtcatgcatgctagtctttacacccaacccaaagaagctgaagatgacttccaactcaggctactcaaccggcagatgtcagtcgtattcaagcattttttttttgctttatggatgcaggagctaaacacattgagaatcatcggagtgcattattgcacgtgttcgactatgttacgcctgaatatgtcagctttcctactgagcttttagatgatgagtctcagtctcaagaggagttatattcaacctaaacaagatggagtctcgtattggagccattgagccataatttttacggtgctagctcatttctctctagttgctatatatatatatatataagtatactatgtgtggcatgaagaaaaattgaagtccttggcttgtggcctctcgtcagttaatagcagcgcactggtagtaaggactactagtatgaacatactacatgatatacatatatacggggccctgactgctaggggggccagggtggggccgggcctggttattactactgttgtaagacacgacacccaattacagagaaccatatttgtgcatgctattaacatgagaaacagcctataactgaccaaactattgaattgtgacagattcatcaaaggagtctgaggttgaccagatcctgttcttcagttttccctagtcagcggaggatgacgaagaaggtttgttcc

SEQ ID NO: 773 - DNA, 1189 bp, Zea mays
  misc_feature (1)..(100): optimal_loci_264921_G1, chr7:166751238..166752426, Cluster 5
gattcttgcagatgatgagatgaaccacagcaatttgagcggggtagtgtgcgtgcttagataagaagcactagagaagaagctgaatttaattagaaactaatacggacttgtcgatcactccgaagagagcaatctattttccgtgttacttctactgggaagatcctaatgagatctcagagtgagtgatgaatcagcggaaattacgacagggagtgcatgtgttagtgtgtacacctttcaatccactgacaagtagcattagctgacaaatggagctgaggtctcagcagcactgacgttagtgatcgactttacagtacagttattatctatcgacccgcatcatatattgtttgtttttatatatatccagtgagatattcttctaaaccgcccgtccggttaatcgtccctcttgatttcttgcacggaatccattaataaatcctgtacagattttaggcctgcacgtacaacgtaccatgcctggaagcgtttaaactacgcagtacgcacgttcttgatcgagctctcgaaacaaacctatatatctgtttgaatatttgttccagcattctgggcgttcagttttctcaggctggggtggtacaaaacaaacacgtacgcgcgagcgagcacgagtctgtagctctcaagcatacattcatatacatgcatgacatgtatgaatggtgaagattaaagtattaaaccctagctagaccaagaacagtatttttcgtttatttatatatgaacgtaaacttgacaaaggtgatgttaatgtgtgtcaattcattcgcatagttagtttgtcataacgcagcgataaacgtatgttaagctagctgttaccgtcccatcatgatgagtggaggaaaagaacaattttgatttctgaatcatctccttgtgtgcataattgccttcgtacaattagaataaaacttttgactggactacatatgccgcgggaataaaaaaacagaaacgtttaacattcgcatgcatgcacaaacactacagtatgctccactgtccaggttagcgtttgcacaagctcatctacattccatgtgattgtttagctgcaccgtctcgtcccgcgtcaccacgtgcgttgactttagctaagtatgtgttttgttgtctgcacgtgtgaaacgtagactgcatggataga

SEQ ID NO: 774 - DNA, 1007 bp, Zea mays
  misc_feature (1)..(100): optimal_loci_265771_G1, chr7:171501738..171502744, Cluster 5
tatggtcgaccaataattgatctttttttaacttgaccgtgtttgttttaacaaaatccttctttagcctaaaaatattttcttttgaaatatgatcgccaataattgactgatagagtacatctttgcctataaatatctatctctatgttatgaccaacgactagaaattgcacaagctgtgtgcatatcatttctattggcaagacgaagtttgaagtgtagatggttcaacaacataacaatggatcatgtttctaggagtgagatgcagtaggaactcgtggatccttcaacagcgagatgcataaagtccaagacggcacaacagtgaagttgggatagctgcctccctcgtaaggaggcatggtggtaggcttgacttagaagaagccaaagttgagaaatctgtagggtaacgaaaaaggttgaccaaaatgttgcttatcactttgtcggcatggctagttaagaagcattatattatatataaaactaagaggccaatagagtatatgaacgcactatccaaaagttattcgagaagaaagggaagaaaagtatattgtgtggttggttatggacagttcagctcatgccaatacaaccaagagttcaagtcaggatatttaaggtcgacgcactatccaaaagttattcgagaagaaaagtatattcgagaagtatttgttcccgctcgtcgtgctttcaaaaacagtcaacataatgtgtggatggttatggacacgggtctcactcctactcaactcatgccaatacaaccaggagttcaagtcaggatatttaaggtcaacgagcctcttgtcacacatgactttgtcaagcagcagcaaacacaaatgtattgtttgcacaaatggtacatagaagtgataaaagaaggtcagagcatgttcgttgcaaaaattagacacgagcattaattttatggtgaggatgtgataaacatcgagttgaagaaatatgctgagtattccaaatgaaga

SEQ ID NO: 775 - DNA, 1301 bp, Zea mays
  misc_feature (1)..(100): optimal_loci_267661_G1, chr8:4623314..4624614, Cluster 5
aaaaagatgcctattaatgtgaaagtgacactaaatcaagcaaacgactggttaagggcccgttcgtttctaacggtttcaatcccaccctaaacccttctaggacaaggatcaagtgaatccagttggttcactgaaacctggtctccggtaaaattcaggcaggaataaaaactgtagaacatatgatggttgttcgtttcaaggaggaatagaaacacttatttcacaacaaactggtattatctcgtgatgctttgttgtctaacctcgccaagattcgaaccagacggcacgcgaccaggattggtaccgagcctgtgaaggaaggagaaactccaaaccgaaccacattcatttttaattcaaatataaacgaacagtccagaataaaatagtcaaatttcaaaccagactaattgtttccatgtggaacgaggcccggaacagactaaaccgctagaaacgaacatgccctaaatggtttattattagagaccgatgaaaatggcgttaaaaagttaaagacagttggattggagattgaacgttaaatagttaaaaatcgctctgacggatgcattaataactattattatgactgaaatgaagcaattgggagaagaactacagcagatgggagtggtccctaccttctgatgacctacagcacgggatcaacaatcatggcgtggagccatggcaggacaccgatcctggtgagaagagagcccattcaattaagtccagggcattacctggtggtggagttgaaggaagcaggggcagggccgacgaagatctgggcacctggcatagggcgggagcgacggacgcccagttatggcatgaggggtgaacaggagaagagaagaaaaggagagcagaggtaagggcggtacggggtatagggacctttggtgctcgtgctccaacgagggagggtgggagatggaaggacgacggacacctaggagctggatctagcctccgtcgtggcaagcaaaagttgcgagcaaagcaacatcaggtggagtgcaaatcgccgaatcctacacaaaatggactttagactgtacacaacacatcactttagacttcaggtggagtgcaaaactaacaattgtgtgatcctttaggtgtcgcccaggaggtagaagagcaccacgagccacagcgcgagcgcggcgcacgcgggcggcggtgcgccggcgaaggcgcaggtagtccacgtaccccaccggggagtagggcgagttttgcgcgcggaggtacgcgcatccgggctccccaccgctgat

SEQ ID NO: 776 - DNA, 1371 bp, Zea mays
  misc_feature (1)..(100): optimal_loci_269821_G1, chr8:16344093..16345463, Cluster 5
gtgcatttgtgcctaagttcttaaatgggtttgattataggaccgtgctacatgttcacaatgcttctttgcaattccatagtacagtaacacaatggcaatgccatctacacatctcaacattatctgcaacgacacagcctcgtctctttcattctgtatgcgtttcctgatgctgcatggtttcatttcgttcttggttccaaagtgacttcgttccattcatggttcaaaaaatgatttcgtgtcatggctcctaattgggcgaggcatggactgtcatgccgatgcagacgagacacacggccatccaagcctccctctgaattccggtcccctgagactgagactcgagtgcagtggcagtacgtgttgttttcaggcttctattccggatcgagcaggcacggttttttcaaagcccgacagcagcggctcatcatcggccggcggcgcggcggcgccatgacccatgactccatgcggtcgtcaccctgactcctccgaatccagtcctctagctatgtatagcaactctcacgaaatctacggtgatgtttcgagcaccatctggtgaaggtgtggatatcgacgacaggcgcccgtcgacgacgccggaccgcactgcatgcactgcgccgccgaccgcgttgctgttcccggttgacatggggaaggacacacagcggcgcactgaaaaggagccccgttggtgttgcagtgcatgcccgcccgcccgcccgtctctgattatgcgttcgcagaaaggtggaggcttgcggaacaatcccatccctactgtacgtactcccttatctcgcgtgcacgtacgtattgtcgttaaggttgtgataaaaatcttttttcgtttaagattctgcgcagcatcagcaatcgccgtgccggcctgcactgtatatgtctctagtctgtctgtccgtcttcttctcaattctaaaaaatcgtagactgataactgaaactgaagcatgcatttgtcattaacgtgttggcaggagcagaacagaattatagaagagcaaagaaaatcagctgctgatgtgcaaaactcaacgcagagacgatggggaggatgacaagagcctactttttataggttttttaagctggtgtccgcagttttgctagtgtcctcattttttactcttagtcgtgttttttttttcagttttgtcattctagtgctatagagcaaaaaggcaaaactgaaagaaaaaaaacacaactaaagttaaaaatgaggacaccatcttaaaaaaaccttttttaacgggcaggagctatgtctctccattcataagaaaataattgatatagttttaaaagaaaccgaacataaacctatacagg

SEQ ID NO: 777 - DNA, 1237 bp, Zea mays
  misc_feature (1)..(100): optimal_loci_272772_G1, chr8:34686356..34687592, Cluster 5
gtgctgagtgttccctaatcgccccctatgatttttgtttctattttgggacccagtcaacccacaatgacaatggcccttgatgctcgattgctttttctcgtttaggctgggctcagaggctgcataactgatttggtgacaagggatcatggagtaattgaaagagaaattagttcattcccatctgattctcttgtcatcaaatcaaccacatgtagattttttttcgcgtggttttctctgtttctgcatcgtgtctgcatgtgcggatgcgcccccttgttttttcccactgattttgtggtaccttctcgtaatcaccaatctaaacttttgtttccttggttaggttattcacaatgggagttttgtgagagaatccataacgttaattagtatgttatgtaggatttttgatgacatgacactatatttattatgaaatagatgaaactagtttcatcactataaaatcaagatattggaaatcgcgtgaaaccactattaagagtaatttgtttcatctccatctatttcatctaattctattagctatttagatgcatcatttaagtcatatgttagcatatgaaattgtgttacaaaactcttcgttaagatagcatattttatttttttattttatcttactcttgttgacgtgacaatattggaaataatgtgacgaaactagcactaggatctgggaatgactttatacattttttgtttgattgggatttgggagaggaaatttagggtactgtattgtctcaaagcaggggcggatcaagggggataaagtgggccatggcccccctgaatttttgatactactaatatatgtaatatgtattttctagaaataatagaaaaatgttaaacataatggaccaaaataaatttcgtctgtgggccactgcgcctcctcccagtctggcgtcctccactagctaacacagctaacaaacgggccaaggactgtacactctagccgacgcctgacgcctcttcccatcccagtccagcctccttcggtcctcccgaatacacagtcgctggtggtttcttcccgatttccgttgccgacgccaacgaccacagcaacacaacctgcttcttctcctaagaccacaacctacttcttctccgactaccgcggccaccatcaccggccagcaccccgtccacttctgtcgcaggctcgtgcctcactcgtggcgcctggccaagg

SEQ ID NO: 778 - DNA, 1205 bp, Zea mays
  misc_feature (1)..(100): optimal_loci_283897_G1, chr8:109261494..109262698, Cluster 5
caatggtgcagtcggcctgttatgggcatggagtgtcgtcgtctaggtatgagtaggtagaagcgccacgtatgaccgatttcgtcctcgctgcgaaccctcaccatccctctctcaacgccaacacagttgccccaattcttgttttagtggatgcaaggcaggcctcccacatcacgttgatcttcattagatctttcagggagccccatgcagcacgatgtcgattcatgacctcaagtgttcacatcatcgacaagcttcaaaaatattgattggatggtgtctcttgagtacaggttgcaacaaatgtgttgtcgagttaacagagaacgtaactaaaggttgctcacacagtgcaagattttcccttaaaacgcaccctttgcaaatatctggagagaacaagtaactgagcctttcagttcattgttgctcaaatttaatgttttcagactttgattctagggatgtgcatacaaatattcgcagataatgattttagactgtgacgcagagactaatataagccacaggctgagaatgtgcttcgaaacagtgatcacattgatgaatgaccatttctgttctgtgcaccttcagtttggcacgccgtcctgccatgtcaggctgccgaagttgtatctcccttgcaccttcagtttggccatgcatgatcacatttagagccacaagtttgtgttcaaatctggttaacacaacttcagtagctggatcactaggttgcaagggacatgcacaatcactcaacaaaaaaaatctactgtctgcaatgcagtgagtcgtgagttcgtgacaagatgagactgttagtatacatatagttctgcataatggtgaacatacagttctgcatacagtttggcatttcaggatctgcataagtcatttcagaatcacaactttctgaacatcagatgagactttttttgaagaacattctctgtcttatagactcagactcacaaactcatagactcagactcccagactcataggttcaagcagacaatctcccacattgtcagataattcaggcagacaaacgccagaacttattataacataaaagtgtcacaaatcccaactatgtatagaaggcagctacaaatccggtctttgaagatgacagacggctacctgaagagtcatacatgcagaaacaaaaatgaaggccatgaatt

SEQ ID NO: 779 - DNA, 1345 bp, Zea mays
  misc_feature (1)..(100): optimal_loci_28627_G1, chr1:175010758..175012102, Cluster 5
tgtccagcgactttgatgaccccagcgcatggacgctctagtctccaaacatcctccccacgacattgatattttcaagctctggctccactgtgagatccaacacttccggataggtgtcatgttaaatggttttcaactgaagtagtaaaataatttgtaaaattgcaccctaaacacaagcattcatattatctcctctccatgtaaggccatggcaagcgcgatcccaaatgaggagagcaatataccaagcacaggagatcgtagcatcatgaagcaaagaagacataccaagcacaggagatcgtagcatctagaagcaatataccaagctcaagaagtaaagcatgaataaccaataggaaacgggatagtctcatgacagagagaagcattaaaattggtacactgaggctagataatgtacatgaatgtgtatatcagtattcttgtcttggagtcgctgcaacttttctccacggcccaaaatctgtatgtatagaagaggcaaagatgcacaccgtaattagcaaccaggaagattcacaggtgcatataggaataggtgcatacaaaattgcaatatggtacttataggaacaggtgcatacaaattgcagtatggtacttataggaacaactgtatacaaaattacagttgtggtacttataggaacatctgcatgaaaaagtgcagtatggtacttataagaacagatgcatacaaaattacagttgtggtacttataggaatagttacatacaaaattatagtatggtacttataggaacatctgcatgaaaaattatagtatgatacttatagttgctgcattgaaaagctaaaatcacttataaaaatagccatactttcctatttgccttagcacttagctaatagactaagggacacgtgatgtatttaaaaatgcaaatgcagttggaggagaaaaatattacaaagacttaaaatgttatggttatgccttgaaagcttcaagttagctgtttccaatgaatgtgaaatatgactgtccaaactgaaagatatataaaatagttcaacctgatagccgcactcgtgtttcatagaacgctctggtttgaagaactaaaaaatccaggaatatgttactccacccccctaatagcaaggatctctcaaaaatatttctttcttatcaaccaagcaatgtttcactaattcaatatgtaggcacattgaacagcaagcacactgaacacattggcatcaagtatgccatctcaatacattttttgcagtacaattgattttgtatttaggctcaagcaagcactgaacaacaagcaaactgaatac

SEQ ID NO: 780 - DNA, 1069 bp, Zea mays
  misc_feature (1)..(100): optimal_loci_287987_G1, chr8:131231572..131232640, Cluster 5
ctcaaattaacgtttagttgaaagtagcggttttgttgtttggctgaaatgcaacagattcatcatgcccatactctaataatcgtacgatttgtcatgacatcgcaagagtgatctttctttctagataatctttcaagtgatgtatgacttatgtattaattgtgaattatgacttacgaatgctttcctaatattactctataattttttcaccataataatcttttgttgtaattgattctataaattattttttcaccataaccttttgcctcatacacataaccttttggcctcatacacaaaaaaatgcagaaagagttattgtgcgttgagggatgatccaataaagaatgaccgccggatgcgattaagtaagagagtgtagacaaatgaaataatctggaacattgtttttgatagtggattttgtgtggagttaaattgatgggtggatttagtaggggacatgagtgtgtgggttggtttatgaggtgtacttagcattgtttcaactgatggtttataaggggtcgagaaaaagaaaattaattggttctcctaatgatggcgactagcgagtccttttgtattgcttttttttgtggggcgtgtggggtggagttcatgtgtgtaactggatctaggatcttttgcgcaagaaactctaaagcggccccctgttatccaatatgcgcgtgcctcatgcataaggaggcgtaggaaggcaagcccaaacttgaaacatggctgatgcccacagtgatatcttgggccgagtgtagcccatgatgaaagaatccctgacgcccccaaaagaagagtgaatcgtttttttttctaaaaatcgttgcgtactagattaaattctcatagtaaatctaactgcacttaaatgtctaatagtatgtgacaaagagttttttcaccccaatatccaaccctacaataacatggctaacaatgtaaatgcttgaattgaattctaacaatgttaactataaatgtgtttttttttcatgagaggtgttgcatagtttaatgatgtataaaaaaataaacttca

SEQ ID NO: 781 - DNA, 1040 bp, Zea mays
  misc_feature (1)..(100): optimal_loci_288388_G1, chr8:133290442..133291481, Cluster 5
tctaagcaaatatgacattattcaaaattaaattgcaagagaatttctattcatatattttgggatctcttgtcaccaaatcagcgctaatatagttggtaggggaaggcgcagggcgtctgtgtgctgtactggtgtgtgcctgcattgcatcgatctgcatgagagagctaggactagaactagaactagaactagagagagcagagtggctttaatgtctttagctagagagaagacgacaatggccgtggggcacacagatctggaggggtcacgtaccttggatctccccaccccatccatccatccatcgccgtcgctttctttcagcaatgcaggcatgcagcagcacggtgtggcgcgcggcaaaggggacgagtgcctttctttcaagtttcaagcttgctgcatgcaccgcaaatgcaccagctccttttttctttttcttgcatgcatctcattctcctgtctcctctagctctccatgagtgcagcataagctagctagggctcctgtattgggacttgtttgctgctgggctgggacctggggtctcaataacccatggcaattatggggagcatggccaggtagtggcctctaggccctcagcagcagctcctagtacttcttgtcttgctttttttttcattagggcactgtgtgtgtgagtgtgcatcaagcagggagaaaaggcaatgtccccctcacttaatagtatacatgtttacttatgggatctttgctagttcccatcttgctcttgtcccatgttatcttccaattctttatttttcgtttcttgcattgtgtggtctcgaggctcaaccacactacagtgcaaaaatagctaaacctgcatgttgacagtagatgcagcactatatatgcgtcgtcattattttcatgctgaagcaaacaaggctgataggcccaacaaaaaggtgccgtgcagtgacagtgggtactcccatgtctcactgtcaatctttataaattaacaaagttgtaaacgaattctactacatctacagtg

SEQ ID NO: 782 - DNA, 1247 bp, Zea mays
  misc_feature (1)..(100): optimal_loci_288391_G1, chr8:133292127..133293373, Cluster 5
tgctcctgcagtcctgctcgcggctcgcccaggagcagagccgccggccgccgccccgcccgccgagcggctgagccggaccgccggtcgcccgtcgccggactgccgactgccgactgtcctagagcaagcgccaggcgagcagcagaggcaagagcagtgccgcagcgagccagcgacgaagaggccagagcaggggtttgtcgtttgtggtttaaagcttgatttgaattttttatttgaatctgattatttatttgatagtaatctcatgtttaattataggaataagatggacaaatttctcatcaagaaagatgcttctatttctaaaacaattagtacaaatgagagccgagtagaacaaaaggggccacgtattgagctagcccccctcttagattaatcctggatccgccactgttacaaaatatgaactaaagaccactgcgaatactataactgaagtttatttatcgcatactagattttatctagttagaaatttaaaggccatagttggttaacaaatagctttaagttttctaattcatccgtctgttagacatcatactcgattcattgcttagtgtcgaatggtagcttgtggtaaaatatccttcattgaattgtaatatttctttcttgtagcaaggtatgtgcatttttttttgtctattaagaaatttaaccagttacttgcacatgcgcttagggcatccacaacggttgtatcaaatagctagctaatatgaagctgatacaagaataaaaatagtaatttatctcatcactagtacttggtctcatacgtaatacactcaattttttaatacggaaaatttcctatctatttaatcgtcgctagctattcttgtttttcctatattttctatccgcatagataagagagtgaatctagctagtgaaatagctagccattagagacgaccttaataatacatacttaattaattaaatcggcactgagccataaggtaaggccattatattagactgtaggcggaaaagtactcagaattatttatttattgtcgcggagaagtattaagcgcggcgctccccgcacatggcctccatgtgtgaccgccccgagcggccttgtgtcggagaccgaccggatggccttcttttttttcctccctttctttttttatataaaaatgattttgaatgaatcaactaagacgccttttttgcttcattttttaacaaaaatgtatttt

SEQ ID NO: 783 - DNA, 1109 bp, Zea mays
  misc_feature (1)..(100): optimal_loci_290640_G1, chr8:145949633..145950741, Cluster 5
ttggcacgtaagccaggcgcgcacgccacgtttttcgccatctcggcgggggccggggcctgcgcactgcaattgcgacgtgccacggtggtggtcggccgtgcgcctatcggcgtgccgaatcaatgcggcacaaagccttcaatgcacaaaccgcggatcgctcccaggttttccggcccaaaaaccacaggcggttcgccgatcgaccttcgtctccccccgccaatgccatgccgttgcgggcgggcggccgccgttttgtcgttggggccgcgcgctcgacaccaccgcgcgccggcccggctgcggcttccaatggaggcgcgcgccgggctggcaggcgtacgtacttcgcgtgatctggtgaccggcgacgaggcgtaccgcgtacgctcgcatgtgccacgggccaggacggttaactgccgacgtacgatcagttaattcgacccgtccgcgtcgcctcggcactccacagtttgatcggggcatggcatgttcatgtcacagtgtcaccgtactgcggatgttcattccggctaggccttcatacttcgtgtggaacgtcgtgtcgatcgatctgggttctggagtactactgatcatccgtagttagtgaccgagctggcgtacgtgaaaaacataattaatccgcccgggtgattagctgaccaaacgaacgtgaggccgggcaggtagctacagtgggagaagggaccagcagtagtagagtcgccaagcaaaaaaacgaaacaaaaacacagcctaattaacgtgcgcgggacgtgcccgaggctgtagaggagtacagtacccgcatttgcgtatgaatttggtgtggcttggtctgttcggtatcctgctgttgagtggtcaaggagctgttcggatccatgtactaaatcttagcactatatatacttttaacttaaatttagcacttgtagagtccaaacatgagcgctaaaagtggctacaagtgaagtcataaactttggcacccgttagcagatgcgctaaagtgagctaaaagtcgtctaaggtggagaaaatacttctactacctgattgtgtttcgaacctcgatctgccaagtaaattatatt

SEQ ID NO: 784 - DNA, 1182 bp, Zea mays
  misc_feature (1)..(100): optimal_loci_290689_G1, chr8:146159156..146160337, Cluster 5
gccctgctggcgggacgaaacatgactaccggctactttggagactcaaaccccttcccgaatcgcagggggtttaagttttcaaattaattctacatgagcaagttggccaggttaaaattcctccatccatgcttgtaataccctatttcaccccctatttcaaactcctatatacaacatttacacgttctaccggagatagtctcaccagtttagagcatcatttgtacatgaagtctggactcgactgctgatggctctagttggtctgccggaaaaaaaacccaaaaagaattgtttggcagcgctagctagctgctgctagcatgaaaaataatatctactatacacacggcgtcgttacatggaccgaattcattctggacctgagaaacgcacattattgtcggtccgagcagggcctcgatgtcctgcctcgtggcccatcttcggtggtgcacattatcggttagagcactcatttctttaatcttttaaatttttgaatacacaatctcaaatgtctgcgcccgcttctgcctggagataacttggcgatcaatctacaactaggacagggacattgtacagtaactttggtaaataagatgcaaaataaagttgagatttgtatgcgtcacagcattcatttgacacatgcatagattatttgaggaagcaatggatggtaacgaggctacttaaaaaccaatacagagcgtaggccgtaggagttatctacaaattattaggtgtcctcgagagttaagagattacgtggtaacgactaaacttttaccaaactatgcataaaaaatcatcgattttttttaccagaaaatctacctgaacggtcgcgtcgttcaatggaatttagaattcatcaaaacggtgaatttatttagtcctaaaaaggagggggaggatcgagttcacgagcgtccctctctgccggccggttcgtcacgagcgcgcgcaagcggacagcgctagctacctagctggaggaggcttcaggctagacgtactgaccaccacgcaatagcgttttccctgtggtggtgtggcaaagcacggcaccaaccgcagcagccccacgggccacgggtccaagttgcctggaacgcctgagcaggcgcagtagtagcatgtaccaatagcaagagtaggtgtctgcta

SEQ ID NO: 785 - DNA, 1369 bp, Zea mays
  misc_feature (1)..(100): optimal_loci_291727_G1, chr8:151223908..151225276, Cluster 5
tagggttgaacacaaaatagtaatcgtcgttgggtttttcttgaacgaaccagattaattgattgcacgatttcatcaacatggtcgattgtacatgtatacatgatatcgtatgtttcccatatgtatattggggtagagatattcacgtcggatgtttggttggataaagggggatatataggtcgttagaattataaccactaattaagcggtgacactcgacttgcggggctacaaccccaggcattatgttaagaagagaaaaatcttgctcccacccatacatcgaacccagaatctgaatagtgctacttagaccacctaaccaactcagttagaggcccggccctaacagtaacacatatgcactaatacaaattaagcattaatcactgatttaaaatatgttcattgcaccattaatattctaactagcccataaaagattgactgatcaacgaactagcacttgtcaaaactaatttacattataattcttgagtaataatataacatagtaataattctgaatttattttctaataacaaagataaaagacacggacaaaattttctaataaatcttttattgacgagcttattcagcatcttttttaaacggtaggtatgatatctatgttactcacgcacctaagcaaacataaacaacccgtccgttctttcgctacgccttgtcctgtggtccgagtgtggcacacgcctgcatgttcactctttagatgaaaagcagaagagaagaggtgcaattgtgcgtctatactagtagggctaaaaaatgcctgaacgatctctagaattcagttggtacagtgtcagcagtctgtcagcctacggacgatctgtagactgtagcagtatattaacggagtggacacaacccaactttgaattctcagtcatcagtcgtgtgtcctggggaccaatcatttgcacctctgcacgctggcaatgaggagacctgaacgagaagggagaagacaaaacttgcccctacggatggaagaccgggactccgggagaggctacctgcttatataagcaaccatggttatcacggaattctttccgcggggacagatacagatggtggcatggtgcagcctgctcgttgcttgccgatgccggggcgggcgacgagattctctttctctacctgtcacgtcccatgatctgcatgtgagatgcccatgagccttttgacgtcctcgcctttgctacgcggacgaataggattcagcgacacatgttcagtggaacttttttctctctctctcaccccattagcctatgaaccaacgtacccacgctttattagggtgtttggtttgagaggctagatgagaat

SEQ ID NO: 786 - DNA, 1066 bp, Zea mays
  misc_feature (1)..(100): optimal_loci_292650_G1, chr8:156233792..156234857, Cluster 5
tgtaacactccaaaatcatacattggtgaattaaaaaaaatcctaaagatttaaaatttcaagcatattgtaacaaagttatgaattgagactatcctctaaaaaaataataaattgtaaatataaaatgttggctatatacttaaactataataaataggatagtgggttattctatataaattacttctattgggttatataactatgtgaattccatgtttattaaatttcatgcatacaaatacttattttagcaaagtaaataagcagtaaataaatgtaaagtatttgcatccatgctgagttttctctgattgtgcattttaaataagttttgaacttcgaaacctacatgaatttgaatttatattgaaactagaaatagaaaatataaaaaaactaaaagaaacaaaaaaaaaagacgctctcaatatccttgtttgtctagccccaccgacccacatatgtgcatttttttttcttttctatttatttatttaatcccttgcggaggcttgcttcaccatgatgtcagccatgttaaatcgtaactcaatgatgtgtgggccgcaggcatgggtaacaaatatctccgtgatctcagaccatcgtcaactgcatctacctcagtctctgttgtgtggggctttctcgtcctccaaacgtcataacgaacgcgaataaagcaaacaatctctccaatttagtcgggattcgctggccagtagttccttcatcaacccggacttgtctccatggccctataaaacctggtcgccaatatccctagatccatcaactcggtagatgccctgttgcagtttgggctgagagcacctcttcgccattgatgagggagagagatcgcagggagtcgccgtagagggaggtcacggtaaattggtgtcgaggctctgtgggacctgagggagttcgtcggggtgcgcggacgtcgacttgcgtccattgctcgctcggccaacgacaagccatcgaggagatagagaagaaagaagaggaggtagaatacagtcatatttgtatcttatatattatctttata

SEQ ID NO: 787 - DNA, 1050 bp, Zea mays
  misc_feature (1)..(100): optimal_loci_295586_G1, chr8:170242802..170243851, Cluster 5
ttacccataactatggccttgtatggttacctagagattcttataatcagataaaatctatccgttagagatccaaacattttgctttccatgtcttggttaatgtgttgtgtgaaagaatctcaattattatccttacgttgcattttcttgggtattgtgcaatgtcatcttattatacatcatgcatcacgtctaagatgaataatattcaatttatttataaaggaaaacaatcaatattatgttacatcaaatcttcatatatatcattccttttttatatgtacattctaataagaccgtaaaaaatcgcgcgcaagtcgcgcgttatacactagtataatagtaatgcctggacgcgcgggacgccggactctgcagcctgcagcagcattttttttcagtttaatggacagctatgcttgctaagctagttgctgatgagagggagtgtgattcggcaggagtgtttcagattatatggtctggtagttgatgaaggtgagcggtcacttggaaagcatttgggtacgtaggccgcgccgactgccgaggcaacaagcatgcatgtgggtcgtgtggacctcaggtgccgcaatctccatgatggcatgcctcgtatcgtagcaatgtcgcattccccaatcaggtcgtagctagcatcaatgctggaacaatcatggcgccatgcatatgaggtcccggccggcgaacagttgccggtcccttttctctcgtagtaccatcgtcgccgacaaacgtgggtcgacgttgtatatttggacgctaaagcaggtaaacaaaaatacggcatgcatatttttatatgtgaattataatagcagcacaggtgtagtagtagagctagaggacgagggtgaaggatcaccgaggcagaggagactgcagagcaatggacactatgggcctttggaacacggttgtatgtacgtgtaatgttatacgttgctttccgtacgtggactgaactgaaagcatccgtattccgaatttccgatgtgtacgtatacgtatgtatctcaggag

SEQ ID NO: 788 - DNA, 1092 bp, Zea mays
  misc_feature (1)..(100): optimal_loci_295930_G1, chr8:172021998..172023089, Cluster 5
tgggcagtgaaaacgagaggggtggagcggcgtgggtgggtgggggagtggagatgttgtcgtctcctctctctctctctctctctctctcctacgcgtcgctccgcttttgctcccgtcccttttgcattgcttgtgtaccgagaagcaggggagggggccaaaagcaaaaggttcccttcgcgttccttgaatctggaaaagcgaggctcacatgaatcaggcgtacgaaatcaaccgtgcacctttcgttcctgccaaaatatatccaacggttgagagcaatctttagtacaggggggaaatggagaccactagtagtggcttacttacgaatggcggtcaagattggcacgaggtgagcgggcagccattcggctggttcatcccagcgcaccgccacagcaattcccttcaggttggccccactggccaaaggctacagttttaacgcaagcgcaagtgcgcaagccctcctcgctttggtttcgtttggcaggcaggtggtgaacgtcgtgtggtctggtgggacgtcgctcgcgagtcgcacaattcactttccggtccagcctcccctcccggctcccgcgagcaagcaaccatgcccgcaatggaagcaagcgatcccgcgcccggccgcggaaggtgaaaataagacgtgagcgacgtggcgagcaaggcaacatgagccgtggaccgacggcccgtgcccggccggcaatggggacggaggccgctgcactgcacacgggcacggctggtttcgtgcgcggggaagacgggcgacgcggggtccccctcgcgcccagcttggagtggagagagagagggacggcttccaccgcggcatgtgccgccaggagccgacagccgagcggtgacacgtggtcggcacgaatgacaatgattgtgctcggcgtttgcttaatgatgggctgacgggtggctacgcgatgcccatttcttaaattctcggtatgacgcgactgttgtttgtatataacgaaaagattctagactagttggttcacggggtcaattttaaattatgcccccccccaggcccccacccacccatcagcttttgcattt

SEQ ID NO: 789 - DNA, 1136 bp, Zea mays
  misc_feature (1)..(100): optimal_loci_295997_G1, chr8:172357994..172359129, Cluster 5
aataataataataatgtgtattattggtagtacaaatagttcattatttttttaaattttttttaaaaaaactgataaaaatattaaataactagattatagtatataaggccacgacaccaacatcggatttgtaggtctcgcaggcacgcaggcgctggccaaccaaatcacgtttccgcatggcacgcaggcagaatcgctccaaaatctgcctgaaaaggacgcgagtacgtagtgtaccgccacgaataataataataatgtactgtatcgaggacgatgttattggcatgcagtcagacgatgctgggttggtcttgtcgtcgaactgcgctgtcggtctgccggttcctagctagctagctccttttaagcaatcggtcgatcacgtacagtgcgatcgagatgattaggtgtgtgctgatatagatcaattttaagggactttggtctaatataaataaaaaaaagttatggcgacatatattgacaaattcgtgaggtgctccatataacgaaaaaccagcacgcccccctccctctctcacgccaaacacatgctagcttgtgtgtgtcacttgaggattttattgttggttcgttcgttcgtttcatgcgcgcgtgactgacgtcgttagcggcgggttccggcaagagatgggtgttgcgcgcgcgaaaccgggcaagccgagtcgagtcggccatgtcacgcaactgtttgtatcatgcgcgcgggcgacagagcgtacgggcgatctatccctgtggccccggatctcgatggccagcaaattgattaaacgcttgcgtagccggagcacgggaacacgtgcgaatgctattggctgtgggggcagtgcatgcattgtcagctggtacggtcagctgctcgatcgaccgatagcgatcgcaaacgcccgtggtgtggtgctctgctccccggccggccagttcgtggatcggtcggtgcacgcacgcacgcacacgcacggtgttcggtccgatggctccggccggtccgtgtgtgggtcggtttataatggtggcagcaggcaggcaggagagcacggcgatctcatgcatgccgtgtagcctactaactagctagggtttagggctagcggagccaagag

SEQ ID NO: 790 - DNA, 1377 bp, Zea mays
  misc_feature (1)..(100): optimal_loci_296201_G1, chr8:173569408..173570784, Cluster 5
ggagcgaacaacgagatacacccaaaattgagaagttttggagacaaaaataagaacggtgagaacaagcgtacaatgacacaaacacaaacgattagtaaaagcatcctgacatgccttgtattttaaaatgtatcaagaggtaagtttaaaaacacatgagacgtattttgatgaagaaacgtttgtagtacagttctctaaatgtagatatagtatcacctatataatccacataaaatgagctgtatattaagatgttctagtaagtcacatacaagacgttgttaggttgtatgaaggccagtgtttggagaattgcttgtacgtgccctaatcaaacgagtgttagacatttcgaaatgcttaatgactcatgcatctcgtgacatgatggtcccatgctgatttggtcgcacgtgtcatggatgccgcgccggaccattttttatctgctcgcttctctgcgcagccacagtggctgcaggctgcagctgcagctgcagctgcaagatttgtgcaggaagataactgcgccggaagcggctgctcccacccactgggactgcgccactgcgggctcacgtgccgctgcccgcaaccgccctgccccgcgtgcgccacccaccgtaccctcccagcgtacgcaagggccgcgacacaaatagcggttcctccatcccggaccttgtccatgcaccatcactcagaatgtccagacctgcgcgcttccagcgtaccagcaccgcgcctacagaagatcgcgtgatccgcgccaggggtccgcatgtcatgtcaccggattgaccgtagcgtgtcgacgggtacatgacacttggcctcgagacaacgccgctgagcgaccagctagtacattgcagcagatcaaacattgttttaggttatccacacttaggcaatcctataaatttttacttaaaaggaatattatatcttgatcagcaagattctctactctatcccacaatctttcacaatcatattcatcttaaatctctactctatatcaactactatatattatattattttattttcacaatcttgcgagcctcacatggtgtccacttccggcctcacctcatgtcttatctctggactatccaatagcatggaatggacggggtaaataaggtttccaacctcactctagactttgcagtaccagatagggtgtgcggttgcgagacttttttactggatgcgcaactacatgtgtgtattgttatctttatagttctcgcagatagccttatgtcgtagacacaatgtttataggttgaagtttaaaataataggtgaagataaacaaatggttagagatagcctaaagacttgtttcagaacaagggtaat

SEQ ID NO: 791 - DNA, 1267 bp, Zea mays
  misc_feature (1)..(100): optimal_loci_296214_G1, chr8:173616941..173618207, Cluster 5
gactatggagtcaccacgacagtcccgctaattagcgtgcgtaatcctcggccacgggcgcgcgcgctcttgtgattttgtgaataacagctgttcgttagtgacgcgccagcatttccagcgagcgcatagatcgttccgaagcatttttttaataagagaaaaactgtcaagtttgaaatccaaggaatgtggttgttttactgtactccttccttggcgtgttcttttcagctagctgtttaccgcgtggcactgtgccctcgtcactcactcggcagatcttcgtcgtgacctatgcagacgaacaccgcatgctacaacgaaaaacattacataagtgtttctcactggcctagatatgccgtcagaaatcgatgaagacaaggggagcgaacgcgacatgaaacaaaaagtgatataaatcgggaaaaaaaaactaaaaaaaattgcaaattgagatgctattgtgatatgccaacttccaacgtcttcttcttccggcccaagcatctgggccgtgagccgatattggatcaccggatgggcatacgaacgaagccagtcaaagcctaaaccttgatctacagttagaaaaagactcacgtatcatactcgtgtctattgggttgttatacacagaaaataacccatgcgaaaatcactttaggaacatattaacgctgaccatgtcaccttcacggcttcaccgagattgcacttgcacatcctcgattgggcgctttgaagaacctaccttagcttcagcttcaaatcagacacttatctttcatgacatatagtgcattgtgttcctacaataacaattcttcccattatatgttctatgtgtacttttttgtttgttcgttaagtaatcataggatcttcgatggtataatttaagaattttgctatttttctatcggcttattttgtgtgtgtgtggggtggggggaggggaaggggactgtaagattataggccactagtcagggccggccctgagggtatgcagggtatgcgaccgctcagggccccaagattagtagggcccccgtttgttcagattatgtccaaatacatatatgttatagataaatctctattctcgtttctttgttgtctctctaattttctggaatcatctctttaaggtcgtgtaacattctgcttatgacgaatactaaatattgattgatgcgggaaggccgtaatgtgttgtacacctgtgcctgtagcgttgttttaattatagcctactgga

SEQ ID NO: 792 - DNA, 1337 bp, Zea mays
  misc_feature (1)..(100): optimal_loci_296401_G1, chr8:174315047..174316383, Cluster 5
cctagctcactcccacctccatcaccaaactcaaggtgcaaacatcatctccagttccaactactctaactcttcctattcggctcgtctaattggcacatggatcggatcaaaattgctttgatggttatgtttgcaccactttctttgagttgaacgggtcgattttgtaaagaatctgacaacaccgaggctttagattcaacttggccgatgctaggctattcaaaattgagcctgaacgatgtgaagctgtttttttctcggggacatctattagacttagacttgctaatataacatctaggcttgtctcgaagcatattcgttcactgcatcctctccttcattcacaaacgcgcatcgttgctctcagagatgaagctaggttatttttaagggtgcagatgtacctaaaaatagaaattttgtagatttagttaaaatttcatcatatacacatctctggaaaaaaatataatggactggttactctgttttgtacctcacgcctaacaacactgccatgcatgtgtggcttttgttcacccgtcacgtggtaggaagtgcaagttacaacgacgatctggtagtgcaagcaaggtacgtgaaaaactactacctcgccaacttagtcctaggtcccattatattagcagcaccccaacttgtttgtacaatgtccactcttgctctgagttcactcccggactagaaaagatgcctcgtgatttggttgcctaagccctagggaacgagtcaacgggtcacacaaaatatgtcatctgaacctagaaccgttatgcaaaacacgcgacttgaaggtccacatggacgggatggggtcgattaacagaaagttcgatggtcggtcaacggaatgtgtttcatcctcgacgtcgcaggggtgcactgccggcagctggtttcgttcagtggtgtctccaatcgtgcgcgatcgatgcatccaacttgccaagagcaaatggatcgaagggactcaaactcctcctaccggctaccgctcttgtgtctatagagtctctcactaaaactcctcttaaaacttaaaatattcatactataatcttactatgtattttatattcatggatgtcttaatataatgctacttcaaactattacatatgtctattgtgagtgatttagtgagattatattgctctagcgatttaagtaaagaacagactgccactatcattttgctggagatacaagttgatgtatacttgtgcaacatgaagccttaacttctgctcggtcaatgttatgtaataaagaagtgaagaaaagactcgttcctattaaaacgcacg

SEQ ID NO: 793 - DNA, 1036 bp, Zea mays
  misc_feature (1)..(100): optimal_loci_296657_G1, chr8:175679911..175680946, Cluster 5
tctgttaggtgtgactgcgagggtttttaaaattgatgcctttagttttggtggtgtgttcagctatacccttagtcgtgtttttgttctgcaaaccagcacaacaccgaggtccctccgatctaaagctaacaccccggatttcaatttctcagatcgaatctcacccgcacgtttcgtatcggacgactgagaaccaaatccgaaccggcacccacgcttctaatctcgttcgctcatcggcagatcaacggatggcatgccttcttcttcctcccgcgcacaggccaataggcgcaggtacgacatccatggtggcgccattactagcgcactaggtccacgcaattccgcccagccctcattactaccgttcctacacgacgcagaggcataatcgaactgctaggaagagttctcaacagcggaggaggcaatggagaaactgccaaactggccacgacgtgctcgccgaccaccataacgccaggcgcaccttgagcgatggacccgcacccgagatgcccagacggaacaaaaacagagggggagacactcaccgaaattagtggtgcaaagaccctgctccacgacgaggggtggcgcaacagctccggttgcatgatgtcgaggcggacggcctgccggtggagcttgagcagcgaggacgaatcctagcgagcaaccgattatctctgagtgcagttcacccgcagcgtccccaatttccccctgctgtcagcgcgcggtgcctcccgccgagcacggcataagcgctgggcaagccagccgcatgtgcacgacgacagccagggcccgagcggcggcggccatggttggaaacaacgccggtgaacttgatgaagagatcgaaacggcaatcgaagaaggactccacaacgtcgtggaggcgctcgtggacgggcacgaacgggagcaggaggtggccgtagccggtggccgctaggtgccgcagagatgtcgatatcaccgaggggcgttaccccgctgcgccacagctctggtgcatgaacac

SEQ ID NO: 794 - DNA, 1032 bp, Zea mays
  misc_feature (1)..(100): optimal_loci_297224_G1, chr9:2270096..2271127, Cluster 5
attagtttggctaagataacaactttaaaggctttgtttgggagaagggtattggagaggattgatggagctagaatctcttactattcaattttgaatagtaagagattatagtccctgcaatcccctccatttcccttggtcccaaacaaaccctaaggaaaactatagcaaatgatcacttccatatatcaattatattggctctagttataattgctagtagtgtaagaaattttatgggctattcactccctctagctatttaggttctttcaccaagttgtaaggcaccacattctacctctaaacctaacaaaaagtagggatggacatcatggactcaaacgacacagcaaaaaaggaaataggttcactctaacctaaaaatctaggatggacaccaacccatctcttaacgtctcaaaatcaacttgattgaaactaccatctttttgttggaatcttgcttgaaactaccatcttgcacaattggaatttaagcaaaggataaatataaggctatatttggaagagtttcacttaaagaatttcagttctatttcagcttcttccattcaaataggttaaactttacgagctctatctttaaaaaaactgaaacgagaggttagtttcaaatccctcaaagggtgcttaaaaacaatgtttttatatctctcatcaaattgcaggaaaattaaccaccatattacggatggcggatacacacataacgcttcacggtcccttccccgcttctgatcttcccagtacgaaattggcagcaacagctacgtatcgacaaagctgttgagaagaaatgccattggaggaagatggcgaggacagcgaacaggagatcacctatcagatggatccagtgctgctacagtgaggcgtccccgtcgggcaggcctgcatgccatacctgtaggtcgtcgtgggggagaccatgcgtctacacctggtggcgcccgtgctgctgccgcacaaggccgtggaggatggggtgaagatcggtggttacat

SEQ ID NO: 795 - DNA, 1162 bp, Zea mays
  misc_feature (1)..(100): optimal_loci_298732_G1, chr9:8183343..8184504, Cluster 5
ctactggttttgtaaaccctgcttcacgcatggttggttgatcaaatgtcgctgtggccatctcgtgttatttattattacgttcacactaattgcagcttcgccattacagggaagcggatcttgccgacattcagtagaggtcttttgagtggtctctaggatgctaactgaaaaatagctcttcgtgaagagtttgtctctacacgattctccatacttgttgtcttacaactgcatttatgatttagtggctcagtattataccatgcaactttttgttatcttttatacttagaaaaccgttctatcgtcttaggggtgtacatgtccttatgacatgtataactctaagactccaactcggttttcaaagtataagagagcttagagactggatgatacaattctaggtctataaattataaatacagtcaagacacaacatgtattgagagtcgtgtagagatatactcttcgcgaagaatccgtctctagattttttttttcacttagcttgctagagacactttaataaacttttcgtttaattaggtggtacacgccctttccacgagtcatcggccgccggtagccagctgacggtacccggctcccgatgtaacgacagttttcgaatgcgcgggacaacaccgttccgacgtttgtgccctcccagtacctactagagaacgcatactgaaaggcacgtttaaattggggcgagtcaaaactagttagtatagttctttactacaaattaaactgggggggggggggggggggggcaggctcaggcctttgactttgttcctcgaaatcctgtatactcaggaattgtttgatcatgtctgctactaggaaggaatccttcaagccatcggactcggactggatgtactggagattaaagtaaatgcatgcatggcacatgcaaagccccaagtagtagtaatacatagatcaatgggcaccaaacccgtgctgccatgcgtcgatcgatcgaatggtccctcaacctctagatccaccgaccgaccccgcgcacgctagaagaatctttaaagaaactagcaaaatgaatcgtcggtggaaaaaatcttcgtgctaacaaaggaagaagcaaacgtagcagaggaggttagaaattcatcgattgctt

SEQ ID NO: 796 - DNA, 1257 bp, Zea mays
  misc_feature (1)..(100): optimal_loci_299596_G1, chr9:11340331..11341587, Cluster 5
ttatttatgtaagaaaattgcattatgagatgcgttgcggcgcgggctagacaggcgacagccatgcgctttttggttcgtcagcgtttcggccggcccctgacacgagggagtgcccggtgccacctcgctttctctagaaccctcgtgccgccgggccgagtgcggtccccggtcaatccactattcgaatctcaacaagtgaccaaatgcggaggccgccgagcgaactctccggaggccgtggccggtgggggtccaacgaaaatatcatcgtccttgtcggccgattcgtgtcagtcgcgtcaagcccggctgcccgggaaagcacgtaaaccaggagattgttttcttcacaacgctgcctaccggcgtcagagcagaggccccggcccggcgaaaggtggttcgcgtaggctagtcgtggtctgcctgcaaaaggcccttttatcgtttccggcacagttgctctcctctcctccctccatcgacttgccgccggctttgcccaaacgaggatcgttccagaaaaaggttcgcatcatccacaggacaactgttaatagtagatcataccactggtactctatgatttgattccaatgatgtcgatgggcaatgtattctcgtgcatgcatgatgcgtgtcctactctaccccccctgtcccgccgtctgccgacgcgcgcctgttcaatgtacctcgatctacatacacttctttcttgcaacttaattagaataataataataataggaaccggatatgaccctgtagagtattatcgatctaaacttaataacgtacatttgatcaaactattccaaccaatccatttgatggttcagctaatgggtttaaattctgaatatttatttggtatccatacactagactacacacaaagaattgtacttaaagattaagttaaagcaataataagtcttaaattttaaaaattaagtttaaaaatgtccgcaaactataatataaaatagaaatagatggaaagccatacggtaatttataaaaaatgtagattaggcatgaaaggtaggtttaaccgtctcgtcatttttataagcctatatccagcaatctagcatctagtatttaagtgtgagtttatactatatttaaagtataagttatgtcagaactaatctttactatatttaagtgtgagtttcgtcgtgcgccctcgcactcactgggggggcctcgtaggtcatgagtgttatgtgcctcgaggtcctc

SEQ ID NO: 797 - DNA, 1022 bp, Zea mays
  misc_feature (1)..(100): optimal_loci_301766_G1, chr9:23448728..23449749, Cluster 5
aagttcatttagaaagggatggagggagtacacgtttcttctgcaagtattgtgttgatactggggcacatctgagccatccaacatgacattactctttttgttctgtcatatacttttgtttacgagtctatttcgtctgtgtatcctaccattttcagtgatttcaacttgggatcaggatcatgatactgatggggcgaattgtcaacattgatttgatgtcacaatattcttgacttgggtaaattcggtgcatagattcctcgtgtttttggtttggatgctcaaacttagttggatgaattgctcattttgttctaaagaacgattttcttttccacactcatttaactagattcaatcgtccactaatacttataagtggttcgctaatgtgtccttacttctgtggcatgaggcattagtggtcctaatcacgtcccatggccttgatgaatcttgattgatcagtcaaacggatacacatgctacatcatagccatgagcacgactgtactttctggtcatgtgcgtgaaagcttctctatgcatgtgctattcacatatgagcagactatttctttctgtgttgttcacatgcatatcaatcgattttgccaagtgcggaaacattgggagttgggatgacaagttgttggagagggttttctttcaatcctgccaaaaaaaccaagattgggagtgggttctgggaaatattggagatgctttgattgggattagtggttgttcacatatcttcgctactgatggctggaacatgaatacttctcctgattcgctgcattggtgatctccttcccctgcagttgcctctggaacatttaacttttttgccatcttctctccttcacccttgccttttctccccttcctcttctctccgcttgtgctctctttcatgttgatcactgggtggcagctgccgctctatgcaggtgccttggtcttgttgggccctttgccaggtcttaatccggcactttgctggcgacaga

SEQ ID NO: 798 - DNA, 1351 bp, Zea mays
  misc_feature (1)..(100): optimal_loci_307919_G1, chr9:64287380..64288730, Cluster 5
aatctcgacttagcgcgtttaatccaatttacataggactaaattattttattgttgttgttctcgatataagttgactcactaactacgacgggtactatcgttttggataacaacaacaaaaccaaaattgactttgcacacaacccgaaaatgactagagggaaaaaaagatatacaaatcaaaagtattcctagatctggatcctccgacaaaaaaagagaaattagtactagtacaatgcacttattttgcaaaggcgaagctggaataaagtgcccattagaccttgccatatgaacgccactcctttccacaaattttcctgtggctgagtggacaaaaccttggccgactgaaaatttacggggtcattcaggaaaacggctgccgatgctgaaccaggggctacaaactgtaactaatgcagaggagcaagaaagtttcgaaatcacctagaagataatcaatcctgtctgtctagatgcatataatagtcgtcttttgtgcctctatgccgcctagtcaaattgcagcgaggaaaaggtgcagaattagacctttggttagtatgtgcttcctgtcgtcctacgagtctaaaagcagcagttatccaaaggtctaaaggcagcagctggcgtggcagcctggtcaaagttttcttgtgtagtcacatcctggattggaatgctcctggtaattagtagtaacaagcagcatataaaaaaaataccgcaaatcaaagttttctatcaccagaccagaattccagagctcgacagtttggcaacgcgataccgcgcgaaagacagtccctgctaaggacacgagatcttgcttttctaatgaatcccaactgatggccagtgagatcccttgcaatatatgcacatgagacctttctttgcgaggtaccgtgactcacagacactcaactagtgtttgtcgatccaaactccaaagagcgctagagaaagggaggtactagtacacgaacaacgcgtggatccatttacttttgccgcaatcagaaggtgttatgaaatgaagctggtgatgattctatttactttacgaaatcaaagtgtgagcgtgcatgtgtgtaggcaggtagggcaaaacagaggcattattctgaagaccactcgaacggatggagaggaggctaaagagagcagtggcaagcatcatggtctgtaaaataatagatgcccttagaagaatcgccggcagactattacgcgtttatgtgttggatgagttggtgtacatatataagagcgagagtcctcgataaatataacacggatttaaactaaattctaatctatcttagaaaccaaaatattc

SEQ ID NO: 799 - DNA, 1071 bp, Zea mays
  misc_feature (1)..(100): optimal_loci_31147_G1, chr1:191629336..191630406, Cluster 5
accgcagttaaccattgacaccaagcaaagaactaattgaatagaagaaaaccgatgtctcaccggcaacacacgaaattgcgacagggtgttaggagagggagcagatgtggtgtcgacagtccacaggtttgggcatttcatcgaataggcggtatgcgaggcacgacttcgatagctagctgtgagcaacgacgatagttatcgacttggccatttcatcgaaccgagagggtgcaggcaaacgacacagcaagggggctcaccgggggatgacgtcgtggctggggcctcggcgaggtggccatggccggccgaacggagggtgctggcgagctggaggcaagggtgtgaagggggtgctggaagacgatcctagggcacggcttgaggtggaggccgagcacagccatggatggagaggagcaggggcggtcgacactgggggctaggaggagccaagacggtcgccgcgagatcagcagggagagggagtaggaaagcggcatggagaaaagactctgtggctttgtcctttggagaaaatgacgtgaagggatttggttcctgtgaccaatgcgataaggctaaggagatacagacgcgtggagagtaaaagaaaaacgggattcttacacctttttcttaatccaaaagcataaacaaaaatacaattatcagccttgattagagtacagagaggtgtggataagactgatggagaaaaaaatcaaagatagagagcggtggagaagataagagaaaaatttagatttttccttctccaatctttaaccaatagaatacccaaataagtgaaaaatctgggatttgaatccgggcgagatgcaaacagacccatcaaaacaatataaattttaatatttttggactacgctaacactgttaggtatttttcggatcagacaaattttcatagttgtagacagtggaacagattaattacgagtactcatttcggttctagttatctcggtccgatttaattttgcagcacttctatcgtggagttctagtaatattcacttgggcaaaaatacaagagtggat

SEQ ID NO: 800 - DNA, 1293 bp, Zea mays
  misc_feature (1)..(100): optimal_loci_311858_G1, chr9:89033568..89034860, Cluster 5
  modified_base (1033)..(1033): a, c, g, or t
  misc_feature (1033)..(1132): n is a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
  modified_base (1107)..(1107): a, c, g, or t
  modified_base (1108)..(1108): a, c, g, or t
  modified_base (1109)..(1109): a, c, g, or t
  modified_base (1110)..(1110): a, c, g, or t
  modified_base (1111)..(1111): a, c, g, or t
  modified_base (1112)..(1112): a, c, g, or t
  modified_base (1113)..(1113): a, c, g, or t
  modified_base (1114)..(1114): a, c, g, or t
  modified_base (1115)..(1115): a, c, g, or t
  modified_base (1116)..(1116): a, c, g, or t
  modified_base (1117)..(1117): a, c, g, or t
  modified_base (1118)..(1118): a, c, g, or t
  modified_base (1119)..(1119): a, c, g, or t
  modified_base (1120)..(1120): a, c, g, or t
  modified_base (1121)..(1121): a, c, g, or t
  modified_base (1122)..(1122): a, c, g, or t
  modified_base (1123)..(1123): a, c, g, or t
  modified_base (1124)..(1124): a, c, g, or t
  modified_base (1125)..(1125): a, c, g, or t
  modified_base (1126)..(1126): a, c, g, or t
  modified_base (1127)..(1127): a, c, g, or t
  modified_base (1128)..(1128): a, c, g, or t
  modified_base (1129)..(1129): a, c, g, or t
  modified_base (1130)..(1130): a, c, g, or t
  modified_base (1131)..(1131): a, c, g, or t
  modified_base (1132)..(1132): a, c, g, or t
taatttgaacggaactcaagtatatatagtatagaataagaatgcaaatggtcattatcccctcccttcctgtcagcttcggccgggagccgggagggaggccgcccgccacggattcttttagctccaggcctccagctcactccattggccagagcggccacgaagtcagcgcccgcgcgcgtagaggcccgtgtgtgcggcgccctgtgctgcgcgggcgctcgtcgcattgctggcggcgagtttcaagtggcgtgagcgcgtggcggctgcgggtggttcctcggtcgtacggtccgtatgcacgtacgtacggtacgcgtcatctgttgctaggaggccggccgtcttggtcttgagtcttgaccgagagaggagaggatcgatccgggagaagcgagaccggccggaccggacgagttcgtcgcacgcgcgcatcgccgcgcacaggccactgcatgctggagtatctaccgcggtcagccgcctcgcgcgtacgtacgtgctcctgccgtgacgacgatcgatgtatctacacggaacgtggaagctttcacatgcatgcatctacccttctgacagtaatacattaaaatacatacaacatgcatgttaattactacacataatcggtatgtttggttgctgcacggtgatatcctggtccgtacgtgaggaaccatattctttgtatacaggctagattcatgtacatgtttgtgtttggttgtttgtattagtgcatttagattaaacatagctcgtgtttggttgtctgtatcagaacgtgtattagataagattgtacaaaaaaatctttaaatattatacaacatgtgtggtctagttttgtttaaaaaaataatagaaacacaaatataaaatcagtcctgtgattaaatattctaattaagagatatagcaaaaaaaaaacaagctaaaactcttctcgttttacccccctttgcacgagctcggcctgcacggcgagctacgcgctggcgaacgaatcaagctggattcttccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatctagagattcgtcagcttgtaggggttgtaatgtcgccacttacttgatgctaacaagacatttccttcaccaaagccatcttcaacacttcgcccataaaaaagatcaattctctttttcaattgcctgtctgcaagacaagtgataattgcaata

SEQ ID NO: 801 - DNA, 1008 bp, Zea mays
  misc_feature (1)..(100): optimal_loci_313602_G1, chr9:99080430..99081437, Cluster 5
acggttccaggtgatcaaagcctatacaaattagataagtattcctggttggattgattctaggtcacaattccggaacaaacgaacacaccttaagccttatatataaattaggcaggcaatccttatatataaattaggcaggcaatccgacttgaaagttcggtatggccaatccaatccccgtgaacgcgaacaggcccttgaggctcagataaaattagaggattctgtcacgtgaaaatgaactaacgatcttcacacagtttcgattcagatcgagacgcgttattgttaatgacggtggggtggatgtgattgtccaacaactgtcctggcttggtccatgcaccaaattttagcgaaaaaacccgtaatcgcccatcaccggtcaccgccacagctccatccatccaagtatcaagtacccgctgcttgcagttgccgggtggaagggataagctaaggtactgtagggaagcaacccagtttttaataaaccagtttttatttttttagttagaagagactagtttcttatttttaaaaaactatgaattcaatttctataaactgagacataaataagtatgtttgaaaccaacttagtttttataaactagttttttttaaaactgagtggtttcaaacaggtcctaagcaacatctatgcaatgaacggcagcaactccccttttccaaaaagctagttaatgaaaagctggtggctttcgtttcattaacagcaactaacgaacatgatgacatgcttcagcgagcgtgctagaacgacggcgatcggagcgagcgagctgtacttccattgcgttctaagagttcggtaacatgtcacacgctgtgattaatcgctgtgcagcaggcagagtacggagaggcttaaattcggacctgctcacttcaactgcacacgcctactcctccactcccaaaccagtggccgaggaaaaacagagagtgagcagctcccttcacctgcttacacgcagc

SEQ ID NO: 802 - DNA, 1137 bp, Zea mays
  misc_feature (1)..(100): optimal_loci_313639_G1, chr9:99284894..99286030, Cluster 5
gctctacgccctaaggtggcaaaatacgacaagaaacgatgacaagtgtttcatctatgtttgacatgacttgccaccaaatattccacacctacacactacacataggaatagatctttttttcttccactagcacactgtactggcataggccaggaatccctgctgggatatcatttatgttacgtttaagggctagtttgagaaactagtttttccaatatggttgccaaactttttaagacctgggaaccgggacaagggggcaagttcaccgcgtggggctgtggaaacatgtcgcgggcggctgcgttgcgcaggtccggtggtgccgcggcggcagcacgcaccgacgcgatggcgagagctcgtgtttgccccacaacactcgcagacggtacacttgcatgtgtagttttcaacagaatggatgcactgtgcgcggcaggaggccgtgggcacctgcgcatgtcgtcgtcgtcgtcgtctctgtctctcttgccgggcagcatccgttcccgggaaaattagccggatcggcgcgcggggggctctactagatagctaccggccgatagatgcagcgtcgccgtcgcgcgggccgtgccctactacctgtcgagctagctagctcgcgtcctgtgcgaccgagcggtgcctgccttgttaaccttgtcctcactcgcacagctgggcgtggacaaaccgtacgtacgtatgctgttttccggggcctaaatgtctatgctatatgctcggtgcatactcacacatcccatattcccatatgggctaaaattcagcaagcagagtggcaacttggcagcttttgatgcatgggcgattccattcattttgatggttgttgacttgaaagtttggatgctaacttcgtagtgtatcttcttgatcccactatttgctgttgagcctgacatatcgcatccgtaaacacatggcatcgatcgacgatccatatctctactactaattaagcacctaatgtagacgttcacagccaaccgtggtgcacggttctgccgcatccagagcgtccaatccgcatccaacgcccctgccgcgctcgtcccagcgttcccgcagccccgcgccccggcagcccctgcagccccgcg

SEQ ID NO: 803 - DNA, 1322 bp, Zea mays
  misc_feature (1)..(100): optimal_loci_315575_G1, chr9:109599457..109600778, Cluster 5
tttcaaaaattttgaccactcgtcttatttaaaatatttatttaaaaatgtaaaattttaagtcgagcacaaactaccttcaactaccttcatggataaaacaaacaaaaaaatgacaaatcattatttttaaataagacaagtgattaaagttttttttttaaaaaagatcaatgatgttatatatttatgaatgaagtgagtattacactccatgagtcatctgaaatagcaggcgactgaaaggtgttctaagaaacctcggacgaggctgcatgtgcgggccgtggcgcagctaattctaacacagcaccagaaaacaatccctatcgagatcgagcgccgagagcgggtataggcctcagctccaccacctgccgcgtgccaactgccaacctagcctcgcgatgtgggagctacaccccgaccgcgagaccccacgccgttgcgaaacattccagccgtgagctgcacgccgccgtcgtccaaaaagcggcgaccgatccatcccatgcacgaattgacgccgtcggtgccgagaactggaactcctccggaagcttggcttccacgctgaaagcgcaccaccggttgacgtgctccgaagaaaagagatcgagcaagaggccgccgtctcttgtctgacggccagctttaggcttctatatccatctcttccctcacgtcgtctcgggtgaaaaaggcagtacagaaccacacgcgtatatgttcaactttgcattggatcgaggatcgatcgcgcatatgagcgagctgcaacttcatctgctgctttgcttattaattaatcataaataaataaccgcaggccaatgcaagctagctaggggggccatatgaatatatagactaataacttagcacagaagcagaaggtctactatatatcactgatgagttctttagtaaaggcagacgagattatattgacaaacaactcaagtgtgttcacacaataatagtaaatatataacctggccatatcaaatatcctgaaagatttgcattggctgcatcatcattacatgctgcatcatcattatatgtgtatgcgcattgctatattattggatgatccaaatgggccaattaatggctggacgacgcatatgatatgaactttgtggtctgaatcatttcgtgtaaaagaggaagcctcgatctcatgtgcttgtttcaagaagaaaaataaaactaactagggcctatctagaacatatgtactccatccgagtcaagaaataattgacgttttttttgttttaattttacgctctttaatcatagtttttctattaaaa

SEQ ID NO: 804 - DNA, 1083 bp, Zea mays
  misc_feature (1)..(100): optimal_loci_319894_G1, chr9:133094236..133095318, Cluster 5
cttcagggaaggacatgatgaatgtgtataacaccggtaatattttgtaaaacaaatcggcatatatatcgtggacctctgggtgaccatgggggtgggtgtgggttctttccagcttctctgcctacttgagctactcagactccgatatagagtagtccgcaaagcggcggcctgctaccccaggaaattagacgttcggaaaaggctcgatcccacaacaacctgcacagtagcaaactatagtgatgtttattgttgttttatattgtttttttaactcttgtgacagtatatttaagaacaatcgtcgtaccggaagacgacagtgctagtctcctggttctcggaatgatttcaggcaactcctaccaaagcatgtacagaagctagtacagtgctgcagcctgtgtgccgtcacgccaagccaagccaggagacctcacatcgcatcgcatcgcatctaccagtactgtacagtttagtggagtaaaattcatcgagccggcggagtacaattctgaaccaaagtgcagtggcggacgcacgcatgcatgcatatgcatgagtgatgccagcgggcatcgggatcagcggacttgagagagtactcgcgtagtagcaggacggtggtagtacgggtaggaaacaaacgccactgaccgtagcagtgtaactttggatggatggatgaatatgatcccacggatccccatggcgagaagagagagaacgcatgggcgcccgcacaaccgccagcgccggcgcgtcgacccaggtcgaagcggacgcgagacgggacgggacgggacgggaggcaggtcggcgaaaagctacgtgcggatcggacaaggtcggttgagcagcgagcggaagcggcacggaaacggcaggtcccgggtggcgacagccgtgacgccgtgccctgccaccggcggacccgtcccgcgcgcgcagtccccgcgtcgtcgcctcccgatcccgggcacagcatttctgggccagcctgcctgtcgcttagcgtggagcgagcatagcacggcctggcgcgaccgacccaggaggccaacccgcatgaacacg

SEQ ID NO: 805 - DNA, 1315 bp, Zea mays
  misc_feature (1)..(100): optimal_loci_319895_G1, chr9:133095352..133096666, Cluster 5
tcgcgctctcgcggctgtggcctgtgggctctgcgtccagcgaccctttttccccttcggttttgtgtccgctcgtctttctccttcacttttcgcggtgagacgtccgcgtggacggcagtggcggaatgatgggtcgcgccgcgcgccagccgagaggatctctttcgatcgatgccttcgccgcgttacactgctgctgcctgcctgcaggaactgacacttccgcctgctactgccactgccactgccagggcggcaagggtatcacgtccactccacaccacgtcagccctagtcactctcaaggtggggactacgtagcttccgtttcctctgtgcttggaatcggtttttggattctctggatttaatacgactttactacaactatttatctcggttctagaagcaatacgcctctagatatactactactattattattattttgacaaactttataaaaataatatcaaatatatataccgagacagaagagactaaggtcctgtttcggcatggtaaagtgtgaaaagtaaggtagacatccaaacacgcctaaggttcacattctaagacctagatgttgcaatgattttttcttttggatgggggaacccaatataggctacaagtttttggactcaattttccacaatcttatggtctataagccgcgctcaaatccatagttaaaagtttaagtaacatgttggggaaacacagaagagatactgtttgcagggacccatgacccatcactatcactaaataataaggtcaaggcaaaaccaatctgtgggaccccacctgttccctcctgactcctgtcttctaacaccacatgtgatttggactctctttagggtggcagatactgataggagcatctagccatctaccctaaaagaatgtgagtggggggtcctcactttctttaacatgcaaggtgaaagcagggccacatatcgctatattttctttgttggattcatgttaaattatacagttaatttgagcattcttaaactaaaccactatatctatataccgattttcgtggacaaatacatgaaagttggatactattttgaagtaaccatatatgcaacataatttctgtcttccggccggtgacaaggacagttaattgctggtctgtgtgttgtggttgatctaaaataaattgaatcatatatctgtcgttgattgtcggcaaataaataatggtcatgttatctctattcgtggcctattcttcatcggctggagttccggatatatatatggttgtgtggcaaaatcgtaacca

SEQ ID NO: 806 - DNA, 1200 bp, Zea mays
  misc_feature (1)..(100): optimal_loci_320545_G1, chr9:135885243..135886442, Cluster 5
ttgccacaaagccttgtcaattatgaaaggaataagatggaaaatgattggttgcatcatataatggtatgttgtatagagcaatatatatttgcaagttattcaaagtgatgatattttacaacatttttcaagaattgaagagccggattggaaaggaacctccaaaaagttcaactggcagattttgtgctcaactaccattttttgcattcactgtttatattgtcacattgtatctctcatttattgcaaatgtttaactcgcaatgtgtaggttcaaattcacgttctaatgttgacgacactattagaggcgaggaagaaaccgatcacctttacctaggtacttttatctttttatcaagtatattgtatttttataggtgttgaattcagataaatatcattttagtctatatttatggtatattatggttttagtggtatatttagctgtataatatgtttgagatatttttaaagtgatctttaaattttatatagtgatatatagggacaattttacggaggtccgccactggctatgacacagctggtcagctgcctaacagtgttggcaggtggagtggagctcgtcctcgtgttcccacccgagacccgaccccatgcgttggcatgcatgtttgcgcaagcagtgtagctgtaaggattttggatggacgcacctcagaaggccacaagtctggtaagcaggctcgcgcacgacgacgacgatctccatctgtctccacatgcagcaggacgctacagtgcgtgcaacagcagcagaggtttgttcatgccaaagccagcaaactacaaaaaggccgttgctagcttggcttacattcacatgctggttcttggtagtagttttaatttgctcggagaaaattaatcaaagagtctgggtagcagaggttaaaagtctgcagtccatcaacaagcacgcacagtgactgatcgactattcgacgctagctctgctagctggcttcctgtgatatatctcactgcacctatataggctgcggcgtcaatcagctcgcaacacgtagacgtgtgccaacctgcctgatctcgacaagttcgacgatgggtccatgatcttgtccccttcctttttgttgccaccacgtccctggatccttaaacctcactttcaactgtaaagctggttccatgatactgctgggt

SEQ ID NO: 807 - DNA, 1024 bp, Zea mays
  misc_feature (1)..(100): optimal_loci_322654_G1, chr9:146765168..146766191, Cluster 5
ttgtgtttttgactgacctgacatgtgtgttccacatgtcatatctatctcctctctatatctactattgtcaagaacggaaaaacataatcacattttctattcggcaacctttgtttgtcgcttcccccacggcccacgtaaaaaacatgtacataaaaaagcatcgcaatcccctctccaagtccgcagctccaacaaaaagaagaaaaagtcacaccttttcgcatggcactctaccccctctaaggctgaaaaccgtaaccaaacatctcgtaatcgaggtctcgtaaatgtatcatttctgtaaagacaatatcattccaaaaattactatatttaaaatttgaattttaaatatctattaacaatgtatcgatcgagtcccaaaaaagtagattaattatgaaaccaggtaaatttccgaccaaccagcaattgttttcgtatagacaatatcgtttttgatcatttttagccctctccatccactccactctatcacttggcccccatcccacccaatgtcgatcggtataccacatcaacggtgagttaggtctttgttcaaatccaaatgagactaaaaaccagttggagggacctatatattctatctagtttgtggattgaggtgacactggcggctaacgttagggactgctaatgatcctcttggaagtttgtggataggatgaccctgctggccaagtctaaggatctactttggagttggtggagtaggatggcatcatgggccaacttttgagattgataataaattttactctctcccaaatgtatggatgaaacacccaaaacccataggtttttgttggtcgaaccaggacctttgtgtgatctcctagccactagatgcatagaatacaactaattacaactttaggatttacagaagacactattagggtgatggacctcaacacagagacgatgagatagcagcgatggccttttccttcactaactaagttatatagtagatcaaatctctcgagtatgt

SEQ ID NO: 808 - DNA, 1228 bp, Zea mays
  misc_feature (1)..(100): optimal_loci_323087_G1, chr9:148903423..148904650, Cluster 5
tgtacagatggtatccgaactcctgtacaattggagcgtgggaatcgaagaatatatatatggccgcctcgtaaacgacatggagcctgcaagcttcttcgtgttcacgagacacggcacgtagccgacgcggccttggtgtcggtacggctgctgcatggcccgtcctggatcggtcggtcaggactcaggacactggacacgggctcacgtgtgggaaggggccgcgcgcaacctccaaagcaagcccatatgtctgcatcggcccggccgtggatatgacaagctcccatctcatgcatgccacgtcgccaggggcgggctacgctacgcggaccagccggatgctcgggcagggtcgcagtgattcgtactccggcgggaaaggacaaattatatgcctctgcaacaatccccgagccgagtgcttaaccctgccattcaaaaagtatccaaaataaaaaaactctgatcgagctggcaagaagatttccaaagccaaggtcttgtctgcgatacagactgtacggcgttgccctcgttacgggctggctgacaaaggtggtagccggccgtctgtcacggtcacggtcacggtcattcatcgtcacaagagcctccatcgacgcctcttgcttggttcgagccatcgcaacaagaacaagagagctctacggacaatatcagctgacacacaaatcccccaacaccatccgagaaaggcccaactctgtattgctgtgcatgtggtctttaggcccatgttgtagttgggccataaaccggggagccctagtccccaaagttggaaggcccataccatgttactatcggatcgaaaggctcaatcccaatccatactgaaaaggccttgtgtgactggcaattgtagttggcctgaaagattgtcgtagacccggagagtaatttccctgcaggcggcgccgatagtcctcgtcgacacgtacatcgctttcccacacgttaatatattgccgcagtaaagtacacgaacagtaccttttggatcacttcacatcatatacataaatgcaatcagtgtattgttgtgcatttgttctttaggcccatgttatagttgggccagaaaccggggagccctagtccaagtttggaaggcccataccgtggtactatcggatcgaaaggctgaatccatactgaaaaggccttgtgtgactggcaattgtagttggcctgaaagatt

SEQ ID NO: 809 - DNA, 1107 bp, Zea mays
  misc_feature (1)..(100): optimal_loci_325689_G1, chr10:6391768..6392874, Cluster 5
tggcaaagaatctctaataatgtttatgaggaacccacggttgaagagcaacattagcaatggcatctgagagaatgatgaagtcagcaatgacctcccacgtcaccactcctcttaaatcaccaagtcacgaagagctacaaagagcatcagccattgtccttctcttgaccagtcttttgggaaccaaactaaaaacttgaggagccaagtctgcaatcctctgacccatgagccatctgtcatgccaaaaaagagtggactgtccatcacccatcataaaagccattgccaaatagcacaagctatccaaaaactgatttgtctaatgttgttaatgagtgcttgcattgttatttccttctctaaattaatctcaatgacaccaatatgttttaggattatctttctttcatcgtcctcctctcttttacgcatggtattacaataactattttgcctatgaattagattagtgggagaagatcggggacttagcgctaaataatgttttttctccttttatctataatttttattcttattattagacttctacctttccattgtatcgctaaacaagtatagattgtgttattaactatactactgccaacacacacacacacacaatatgcgtgcacacgcgcgtgcatttcgtacgtgatatatcattatcgtccgttttgtcaaaacactagaccctctccagtctcccctatccaaatcctggctctgcctctgaatctctgaagaacaagacttgcacctgctagtctcaactactctgcttcgtgatacgatgcacgcacgcgatcgaagtggagtgcatgctcgcgttacgcaggcaaggcgagcagcgatactgcgagggtttgccatatgcaacacacaaaatgtcccagcaaaatattttttttgtaggtaatggaaacaagagttcccggcttgtcccagtaaaatatttggtacaacataattcaaaacgtaaggcaaaatgggggaagaagacggtcctgcttagtccaaaactgcctaagcctaagttgagtgtcccaaagctggccagaccagcttgtcctttatcagtgtgtagtgtgtttggat

SEQ ID NO: 810 - DNA, 1097 bp, Zea mays
  misc_feature (1)..(100): optimal_loci_326876_G1, chr10:12363214..12364310, Cluster 5
cgaatcgggcctcaaaccaaccattgattgacattgtctatggttaaattaaccatatatgtgaacgcatggcccaaatgtgttcagtgatcctgaaccccccactcgcccggtgcgagtcgcggcatcggggagccttcataccccccttgcgctgcaccgacgaagtgaagattgtccgccgtgggggctcacctcctcatggacgaaggccataaagggtaaccataccaacattggggatgccgtacccccctacgctgcaccgacgaagcgaagactatccgtcgcgggggctcaccggctcgtggacgaaggccatagagggtaaccatgccagcgtcagggacgcactacccactcctccttcactcaaagttatcccggtggggctatgcaaaggcccctgatctcaggaccagtgatggcgaagttaaactgaagccgaaggcgccaagatttcgacccacagatcgaagtccctagaacgatcacaacgtgggacaaagtctgtgtgacgaagaggactcgctcatcgggcccacatgctagggtctcatgcaggtaagaatcctagtgtagttaggcataaacctatacaatgtaattaccgcgctggacgacatatttcaggaatgtagccgttaattaggggcatgatcatatttagatctccgtcccctgttagccatataaataccatcgtcctatagccagacgagatacttgttgtgtcaccaacatcaccttctttcaagtgtggtccacatgtcgggatctagggacacatgaacaatttatattgatagctctcggagtctagaaatacttagagatatttaggccctatttgggatagctacagctctaggaaatttggtggagttggtggagcaggtcattaggtgttttagaaaaccgtagagctggagctgtaagtctttagaagacatttagataagtcattttgtttattatttagattaaaaatattttcacaactaattaaattgatatgataaactacagttccacactggagctggaacctagagccatctcaaacacccccttagtctcagttatctacactcaat

SEQ ID NO: 811 - DNA, 1053 bp, Zea mays
  misc_feature (1)..(100): optimal_loci_338132_G1, chr10:82855822..82856874, Cluster 5
acctggatgtacggttcttaaaaggttttattaagttgcactgcaccccaccgtgcagtgggaaacacgatcatcacgtgcgtcacgacgtcgtgtgcagatgcttaatcagtttattttccggccccccaccagatcgacagcagtgcagtttcttcattctttaccctattgcttgtcgacttggtgtccttagaatgatccctcactttctcatggatttgtcgcattttgtgtgcccaaagaaatgtttggacgacaatcaccacatgaaaataaaccatgcgaatctccagaataattttaaggcgtcgccggccggattatttgaaaagggcgcgcagtccggccgtcatcacatgcatgaagaacgcaattcacgaacaatggcatcttaattaagtttgacgggccaatgacgatagttttcaaaaagaaaggcatggtgttctttaatttttcataggatttgcattgcattggcaagagagtgtaaaccgtaaatctggtgggtctagcatgcatgcacgcacatacgtacgcatttgaacgacgtatatatagcagtatacgtacgtatgtagaccacgtacgtgctgcaacgtggttggttgcccaagcatgcatgcatgcaatgcgcttgcatgcacagccgagcatgcaacgtggttgattgcgtgccaaggcgacctcgccaacgacgttggtgaaacgactacgggagggacggagtggttcacatgcgattctccccgtcccgaaactgaaagcgatcgatctacgtacgtgtgcgttgctataataacttgagagcaaaagagagatcgagtagttcagttcgcacgggtttttgttacgtccacatgaatcaactggaaatcatttgtagctagttttgttagtagtacgtgtttgaattcgctagggcggcatccatcgtatcatcgacacctccggttcacgtacgtgcgcgtgtgcttcacaagtcctactttaatttgcttcgtgatgcagctagcagacgtacgtgttcttacaacctcttttatttta

SEQ ID NO: 812 - DNA, 1032 bp, Zea mays
  misc_feature (1)..(100): optimal_loci_338573_G1, chr10:85332751..85333782, Cluster 5
aaatacgtcatcggccagagcttgggtcgacggatttaattttaagtatgtcggccatagcctgtccgacgttcttatttgttttaatgccatgtgactcgcccacggagctctggccaagcgccacgttgcccggagttaagaacgtcgggttttccctaactgacgttcttatattaagaacgtggggtaggatgaattttgggctctttcaacaaaagaaactaacgatgtaattgagacaaaaccaggtatacatatatagttcaattagctatatacagagaagctttttttgagacaaagatatacatgtagaagtcgtaaatgccctctctgtagctagtggaatatatacacatataaattgcatgccgtagatatatattacactccgaacattcaacatatagaacgcgtttccgttagtgcaggcacacgactttcaatttggctgagctgcaagaggaattgcaattgcagatgcatcccaaaaaggtgaagcgaagcggcacgccgcctgcagtggtgagtagtctccttcacaaatcacagcccactaccaacagtgcatgcagtgtgtgtgtacgtacacgtactactactactactcgccacacatgttttaacaataccgtcgtcgccgtgaatcgactagctagctaggtactgtacttgtgtcgtttgacgttcgtctcgttgatgagtaacccatcgatgtgtcagcaggatgatggtgcaatggagctagctagcagattggagccggccgcggcgtgatgacgtgcccatatgcatgcatgcttgacgacgagacgatagatctagaggacgacaaatgtccatgctttagggcgttgaaattcgtttggagtgtgagagtttccaatccagatgtcactcggagtttaattacaacgaggcgtccgcaacgccatcgcggccgcccacggcgccaatcggcgaaggtgaggcacgaaggctcagaattttggaggcgacagcgagatgccgggagcctacgggttacgg

SEQ ID NO: 813 - DNA, 1103 bp, Zea mays
  misc_feature (1)..(100): optimal_loci_338640_G1, chr10:85708371..85709473, Cluster 5
ggaggtcgggcgggcggggttagggacggtttacggcggcgatgaatacggagatcgggctgtcggggttggcgggcggtttgcggggttttcctggagcgggggcggtctacataccgctcttaattgttagtacagatttgtagtctaggtgtcgctccacctgcttccccaccttgtggcaacacacgggcatatacctagtattggttgaacagctatcctggcctggtttcaaaatgcattcactgccggtttctaaattgactttcgtcgccgaatttggaagcggcaatgtgtatttgattctgatagtgctgacgtttcattaccggctactcgactgaaagcgatactacacattcttattttttgaaaaaaaacaaaatctaaacctgggccagccatcgccacaccgggccgccagcccgccacccctcgcaccctcgggagctctgtcgcacaaggcgtaggccttttctttcgggctccgctcccgcacgtacgtgggctggaccaatccgtatagtttcgctccagccgctcctgtgcaaaagaagtgaagagaaatactagtatcacacaagccagagagtcgttatccatcactatgccatataaaccttgtttaagtcatgcatgaaaatttatgttaataactcgtatcagagaccattgaaatcaaagaaaaagatatcccactctaacaagaataacattccacaccaaaatataacattagccatctcataaaatatagaaaaaagccaacacaatagagaaaactaagtaaaaacaaaacaaagaatgtaataaaaaccagtaaccaaagtaaaataaatataaaaaacaaatataccatagaatacctgaacacactaatatgcatcatagaacatcacatacatactaattgaccatcgtacgtacgtatatatggaatatacaaaataaacaatacaaggtggaaaatacaaataactatttacagtaaaataaagaagtaggaaaaacataaataccaaatgctacataaacatcataaattatcacatgtatgctacatgaaccttacaaaatcatttgacctacacgacattata

SEQ ID NO: 814 - DNA, 1241 bp, Zea mays
  misc_feature (1)..(100): optimal_loci_342099_G1, chr10:105282122..105283362, Cluster 5
ttaagacaatcggcagttcatcttcatacattagagcttgacatagtagctaataggtgtccagtacttacctaatattctattcctagtgtatatatattaaggtagttcaatatttttttaaaaaaaatatgggaagagtacaaccttgctggagtattttacacaatcagtgatttaccaggaactcgtataagagctagtcatagttttttgttttgtttgtattagtgggtaaaatataaagttcattagtgtttttatataaagtttgactgcgtgcgtattcgaaaacatgtgcgccctttgttctagaaaggtgtcattctcatctttcgtaaggctgaatatttaaactttgatcaatcaaatatgttttgacgcataattaatattattagggaaaacacttaatctatttttatagtaaatttccaaagatttaaataataataatatttttttgtttataaacatagttaagtttgtaaaagttcactcaacatccgtcctacaacgtgttattgggaacagagtcatgaaatcaggctcgctctattactaataacgatgtaataaaaaaataaaatatatttttatacggaatggcgtaccagtaatgaaatcacggccgctatataattattactcctaccaataacatactaaaaaataaaataaaataaaataaaataaaataaaataaaatagaggcaggaaaggaggttttgccagatgcgcgggcacggcgtggtcttttcctgcgcgcatgcggccaaagcggggaagaggaaagccaaaaggaggccgtctcctccaaaagggccggccggcgaccggcggagactgagaagaaggagccgacccgaggacgtcctccggcaaaaggaaaggctgctgatggaaagcgaaagaaagcgagtgttcctttgtccctctcgccgccgtcgcgtccgctttcctgcgcgcatcggaaccagcgatattctgccctttccctcggttcccgtcgcgtcgcgtgcgtcgtgtccgtgcgatgcgtgtcactcatcgtgtcctctctctctcctccctcgcgcagtaatgctagggactagccagcacatcatctgcaggtaagcagtgcttcattgtcttatgtggcagagctcaaagtttcccaaacgcttgttacgcctccctatcaacaaagcaaaaacatttttaattatatagaaaagttttctatccatctatttgca

SEQ ID NO: 815 - DNA, 1033 bp, Zea mays
  misc_feature (1)..(100): optimal_loci_34275_G1, chr1:208771362..208772394, Cluster 5
tagattatatatatgaagtaatgccacatatgcctaaaacacaagtggtttaggacatagtatgcataatattctatgccctctttagctgatgattgattggtgtatgcaaatcataagagattacaaactcctaaaccagtgaggacaagcgcctcctggatgagaagtgagttgcggcaaactagactaccaacttttggcttgtgtggggtcataaaaggagtctgcattggcttcgcttaaatgcttctccacccatccattttatagtccaaggaagtggttaagcttacatgtatgctctacttgtgggcactatttgtcattgaatcaactgcccctatcttgttacagccatatgtaatagcagctcgtctcccttgtaatcatacaacatgtgttgttgtcgcaggtgcaatcatatctactaatctgaccttatggggacttatctagaacgagaattggtgccttaattgccctagtaagctataatgagtgcttagcatggattcttgtaccttttgttacatgaatgtaccactgtactacctattcatggctaattggattttccattgcctggaagccattgtgattgcctgactagatatttttgtaaatgcgatagcatgcttacacaaaggcattaggtgcacctgaccttgagtgtgtgtgagaataaaggcatgtccataatgccatgtctcatttttaatgtgatacatagtttcacttatagtcatcctttcctaagatgactgccatactggctacaaatgaagatatgataacttgcatctatcgatgttttggcctaggccatctagcttaatgtaattggtagacaatgtatccctaaaactttattctattttatggcacactctatgtgtgtacacatccctacaggactaatacacatactgcatggtgattttgagtgtcctacagtctaagtcgtgtacttggtgttagcatacttgtctaggcttgtaatgtcacccatcatacatttaatgtgttgtac

SEQ ID NO: 816 - DNA, 1029 bp, Zea mays
  misc_feature (1)..(100): optimal_loci_344413_G1, chr10:117716754..117717782, Cluster 5
ctgtgtctagcctacaagttttttcgctttaaagttgtgtgagctgaaagaaagaggaaagagtacctaagatcgataggaataggaggcatcagggaaacacaagcaaatttctaccttcaatgctagaggagaaaatgaacgtgccgctttcctctacgttcctatattcccactgtctttagtgaatctcttcctcttgcattgcctcacgctcaatcctgaagctgaacaacttccacaatcacaaacactaagcatgtagcactactctgacgagcctagactgtgaagaaccatatgaggacacccaatgtaggatggtggtatccaagtctttgaccccatgcccatataattcgcgaaaaggtaaagaaaaaggagtagtgttgtttgttcgatctcttaatctaaaaaataaaatatatgtttacgattgtaggaaagcaatatctgagtaattaaagcaacgagaacatgccatgaagtgtcatttttctatagtgattctttttctcgaacacgcaaggtggcgtcatgaatcaaggaaataaaaaaattgattacataaagcacttaaatgcgaaaacaaaaaattacagattctgaaaacaatacaacgtaccacaggatacatttttctaggacttcagaagaaggacaaatcctcgcaccactgccctgcaccagagttcagcctcgtcgaacgaaccggataaagcttgccaattatattaagaaagaagaaacctaaactggacaacataatataggatgcataaataattgagacaacagcaaaaaccacatacacaatacctatcctaagtcatcgttgtcgagcctaacacaagtgacgagcagctttgacttttcaagacggacaacacatgaccaacagaaaccacgacgatggctataaacaccggcgcaggagaaggaagactatggcacgccgtcgttgccaagccacaagacaccccactcgaggcagctctgattcttcaccagcaagacttccaaaacatt

SEQ ID NO: 817 - DNA, 1305 bp, Zea mays
  misc_feature (1)..(100): optimal_loci_344416_G1, chr10:117726048..117727352, Cluster 5
atccgattcaactcccagcgtcatggcaagagtagaaggttttgttgcccttttgggaaatactgaacttacatcatatgactgtcccgtacaatggtaagtgatcattagaaactaagtacataagtttttttagaataaaaagagaatcagaaataattaaatccggaaaaccttgacgaggtcttgactcttgtcccttcaatatgctggtgcgtactttacaagtacactggtacaatgtccgcatactgcgacgacacacaaattattcgataaaatgttactaaaacttcagagtcaaatatatgtccattttcatcagagagccattgttttgtgcgctagttcattttctagtaatcaatacaatgattatatttcagatgatgatgtcaaggagaaacgaagaaatattaagataaggcatatgtgtttaaacatgtcagtatacatacattgatgttctactaaatgaaattctcagatattgaaaaatattatttttaatgtaactgtcctatacatgattcagattctagggcgatgcgggtggtgatctcgtcgaccaaccagcggaggagtccatcgtcgaggaggcggtctcgcgcctgctgcatccgctagagccatcttcttacgcccaacttcagagattgacgacatggcttggtcgtctttaaaacatcgtaactctttctcgtcgaccttacaacattgctcatcgcccaacacacacattacccatccataattgatgttaccgccttcagcacttctccaaccctcgctttgatgttcggtgactgcaaggctacgaccccataggagataacaatgtaacatttattgctttagctactgccaccgctatgcatactgctagtgtaggatgacatacatgtgctggactagacgtgactacaaccatgacacttaagcctagctctgtagatgtagggccctatggtatggcgtatcatccccttgccgagataacatgttgttaaatcggtctgagtgaccaagacggtgcctctcctaccatgttgtcaattcatcatacttgacaattgttttaactaaactgctttcatataaacatcagcttgcaggagcttcctcatatctcatagctacatttagattttgagaagcctatagctaaaccaaatagacccttagattaccacgtggtcaatttcctcatcaagtacctcggcattttgatgtccatctttgggttgcacagcgtaactccaagatcatccatacatctcgctgcagtcaacgtttctctatgaa

SEQ ID NO: 818 - DNA, 1013 bp, Zea mays
  misc_feature (1)..(100): optimal_loci_345673_G1, chr10:125092420..125093432, Cluster 5
taaaaaggagataaatcgggcaattttgctcattagccgcccttgctagcagattaatcggtactagataaagataaaccaggagcctctaggctctagtagctaggttttgggaattttctcctttttaacttcaaatatttttaacattggtgctgctaaaggtaataatagttaatattattgttatttgcggggattttagatcggatcgatccggtttgggaacacggggacaatatatatcccagattcaatgtgctttatttgcctaaaaagatgttcagatgagatggacaccgagagtgacaccccattaccatcaagcatcgtggctggaggcacttcaagggaaaatttgtttgagtgggctaagaaaaatgtgggagacactcacgttggtaagcgaaatgtgcaattcatgttaccaaaaacgagaaagaaaggaaagaaagcagtggcaagcggtgacgagatcgatagtggagataaaagtccatggtaccaagagtcccaatacatttcacatatactaccaaatgttggtggactcgtggagtacgacttctacgtggaccagacagacttggtcggtacaatacgaaattgatgcatgagaaatttattacgttactctcaacgaaggagtataatatggcacaagatcattggaatacacacccgtgcggatgatcttcacccagggatgtattgtatctttgattttgtttgtgaactatgaaacaatggcatgtaatgtatttaaactgctaaatattgttattggacttgtgataatatttgggtcatcttttattcaaattataggatctcaatgtgctttatttgtcaaaaaacaagtggtttgattgttgcacctttgttgccggtttatcaggtaagcaactgattaatcgatcttatgaaccaattaattggtctcgagtcgtttgaattcaaaaatcgtgttgatttggaattcggtcgatttctactagcctctacggatttat

SEQ ID NO: 819 - DNA, 1024 bp, Zea mays
  misc_feature (1)..(100): optimal_loci_3466_G1, chr1:17896378..17897401, Cluster 5
ttctttttgctatccaaacttatctgtctctcagatggcttgtaaaaatttatggcaaatttttttctatgttttggttgtcaaatctttggcgtggtagtttttttaccgcaaaccaaacaggcccatatgcatgatccagacacctttagccaacgcagttcggtcccaggctcccagctcccaggcatccctagcaagttgacgtgagagattaacaaaacagccgagacagttctaaggattcttcctttctcccaaccaataatgcccgacttgggtgccttttttttaataaagtggaaccttttcagttgagattattctaagacgaaattaaagcctagttcaaccaataccaatgtgtttaggaggccctgagaggaagcaagctgacattagtggcgggcacggtgcaggccaaccacgaccagcagttgtgccaatcggctcctaccgaaaaaaggcgttctggtcccacgacggagaaatgggtgcttggtgaaaaacaatttctatatatagacggctttagggcatatacaatgtagacactatgatacggttgtccaagtgtaaaacacgtctaagacatagtttagtacaaatgattgtgtctaaaattttatatcttaatagtttagattcttaccgtgtccttgcactaggagcagcacatatgagaagagccgatggatacaatacaatggagacatagctccgtgtcctggtttcgagctgagtgcaagaaacatggcttggtgaagaactgtcttgaaattttttgcgtttatccccttagacattgtggaatacatggagcattgaagggcaggaagatacaacttcattaaagaggtctttaaaggggtaagtcaaaagaattaagagacaaaatcgccacgaaaaacacatcttttcatagctttctatacatactatcgcatttatgatttagagactaaaagttgtatcttatacttaagaaaatggatctgaaggcacgagattgtatatgtctacg

SEQ ID NO: 820 - DNA, 1248 bp, Zea mays
  misc_feature (1)..(100): optimal_loci_34911_G1, chr1:212179892..212181139, Cluster 5
tactattttaaattgaagggactaaaatattttaataataagtccttgtttggatactctcgtattcacctcaatccacatgtattgaggtgtattagagtgtaaattaatttaagttctactccaatatatcacaatacatgtggattaaggtaaatacaaaaatgtaacgctctctccatctcattcctcaaacaaaccataaaaaaatcatggattgtttcggacaataccgtacgaactccaaactttgcggcctgtatgcgcgtgaggtggacagcaggcgatctttgaaatggtgaccgaggaccggcatgtccatgtcacgatcgagccatcgcggcacgggcacgattaaacgacgacccgcggtcaaagttggttggtgccgagaccgggatcgaggttgatcgaccggccggcgacgcgaccgtgcctccgaccctttttgacagccttgacggccaaaagtagaaagggacgggaccccacaaacacattctattcgacggagtcttcgattcacaaggatcctcgagccgagtagcggcttgctgcaaaacgaggagctggggcagcagccgagtggtgggggtggtgcactggtgccccgctgccggcaggcgaccggcacgggcataaacgcgcgtacgccgtggggcgcagcgaggcaggtaagatgcgatcgaacacatcgggttgcgcttgcgccggtcgtacgtgacgtgcctggctgacggacggcagatccaggcgtttcaatgcccgtgggccaggcccagcctagccaggctgcctgacgagatggattgacaggatgagtgctgctggccattctgcatcatctttgaccagtggaggccactttgccagaccccctactgattgcgctcataaatttgaagtgagccgcgtacccagcacagaaaatgccatgtgagaggacaatgtccgggtatatttgatgagctagtttagtccctctgttaaaaaatatatagctatatgttacgtgccaattaaaacagttcacgattgattaaatttctaccaaatagtatttacatttatactccgaatcagcttttttatgaaaatatattttgtaattaacttaataagatttattttattatatcttatagttaaagctactaaaactgcatttttttccaggaacacagtagaggtaaaaactagcttaaattgtgggttcactaactagttagctaatactaccttcttctt

SEQ ID NO: 821 - DNA, 1378 bp, Zea mays
  misc_feature (1)..(100): optimal_loci_349158_G1, chr10:144160356..144161733, Cluster 5
  modified_base (562)..(562): a, c, g, or t
  misc_feature (562)..(661): n is a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
  modified_base (583)..(583): a, c, g, or t
  modified_base (584)..(584): a, c, g, or t
  modified_base (585)..(585): a, c, g, or t
  modified_base (586)..(586): a, c, g, or t
  modified_base (587)..(587): a, c, g, or t
  modified_base (588)..(588): a, c, g, or t
  modified_base (589)..(589): a, c, g, or t
  modified_base (590)..(590): a, c, g, or t
  modified_base (591)..(591): a, c, g, or t
  modified_base (592)..(592): a, c, g, or t
  modified_base (593)..(593): a, c, g, or t
  modified_base (594)..(594): a, c, g, or t
  modified_base (595)..(595): a, c, g, or t
  modified_base (596)..(596): a, c, g, or t
  modified_base (597)..(597): a, c, g, or t
  modified_base (598)..(598): a, c, g, or t
  modified_base (599)..(599): a, c, g, or t
  modified_base (600)..(600): a, c, g, or t
  modified_base (601)..(601): a, c, g, or t
  modified_base (602)..(602): a, c, g, or t
  modified_base (603)..(603): a, c, g, or t
  modified_base (604)..(604): a, c, g, or t
  modified_base (605)..(605): a, c, g, or t
  modified_base (606)..(606): a, c, g, or t
  modified_base (607)..(607): a, c, g, or t
  modified_base (608)..(608): a, c, g, or t
  modified_base (609)..(609): a, c, g, or t
  modified_base (610)..(610): a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
  modified_base (623)..(623): a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
agaggcgatcgagacgtccgtcatgactcatgacgatacgtgcttgtgcgaccttgcgtgcacagttcgtttgcctcttcgggtgccgtcttgatgagcatgtcattgcacgaaactgcaaactgcctgtgcgtggggagaccaggagacggcggcgggccgtttggttggaggaagatgaaaggatgttccaatgtcccatgctgttggatcgtcacgccgaggaagttgtgcaagaagacgtgttatgcgtgatgatacaagtggacgtgttagctgttaatggattcgcttaagaaatattgtcaatggattcgcttaagaatatacatgtaactataaattataacgagactatagcacaccaatgtatttttttcagacataagtattatattagctacatatggatattaaattaaatgaaagagtggagacatataccagctgaatagaatcctaaaaccatttgtttgcatgtttaaaaaattttgctttatgctttgtaacatttcctaattcctggtatatgaacaaaaaacgaatctctagatcgtttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgatatccggatgcagacgacgtaatagactatctatgtcctgtcacatatggaagtcacctgtagcaatgatcatgaagccagacgctagtaacaagtttgatgtcttctgcaagaacttgacgagcatcaaaggaatgccgtactatatatatactactgactgtgtagatgagtgcgtaaatccataaagtgagtgaaattggaagtagtggtcctagaaccagacagcgagatagtgattgtgtctgagtgaggggtgtgtagaacgtatgtgggatttatattaatatatgcactacgtaaaatagatgagttcgacaagaatgtgaccctgaaggaagaatgaaatcaacggaaagcagggtctcgccttagattcgagtaggtgtcaaggtcacggaccgaagccaaggttcaaagtaccaatgaaatggttcgcaaattcaagtggaaagtgttatttgtactgttctccgaggtcgatcctgataccacaagatccttttataattggcataggctaacatttttacaaaacaccacgtttcagagatatgtacaagacccccttcgtgcacatacgtagaaaatcaatataaaccattcaaccacaacgaacggatgacgtgttttacgaaaaaactcattccacgctatcctcccctgcacccagctgcatatttgctgaaaaaagaccctgcatgctcagca

SEQ ID NO: 822 - DNA, 1294 bp, Zea mays
  misc_feature (1)..(100): optimal_loci_349983_G1, chr10:148714533..148715826, Cluster 5
ctaagagatatggatgtgtcgtacaatatcggcacacacatatgctccagttagtccacccaattcaaccctaagtcgctactccgtagattgtcactcatcacaaaaattgaaccacaagagcaaaaatatcaacattgtgttggcaatcttgtagtgataatcttattcatgaacaatgattaccttcttgccacgttggtatgcaagaagttgacatgtcggtacatagatcagttagtaaagaatttgctatttggctaacatatatgcttctctcgaatacttgagttaattggtaattgtttgacaacttgaatggtagtacaagcaatgaagaacttggcatgttggtccataagagtcctcaagatcgatgtaattggttgccatgttggtctgcacagctcctctcatgcatcggaccaatgtaaaaaaacccttaattatagcatacagtagaagccgatggatcgaaaggcgttgcaaacagagtagatagaccggcggcggcgaatcaaataaataataaaaaaaaaacaaacgaactaatttaaacgaaggaaacatggatggatcgaagcgaaacctggaggcgctaagtggagaattccaaagggattgcactgactgatctgcttgtcctcgggcacgtacgtacgtcggcgtcgatcggcaggttagatcaatgcgatccctttggagtcctccactagcttcctgctagtaggcggcataggggggacgacggcaggagagctagctatatagatgccatgccattgatgggacgacggggagagcgaggagaggtccatgccaatgccagctggttaattccggcgatggctgttgcttgctttgcgctctcgctttcgacgtacacgtgggcccgcccggtcccggggtggggtgtgggaggagagacacggcggccccaccacggagatgctgctcctccgatccgtctcaccgggccggccggtggtggagacgacgagctagccaacgccaagcctccgagtctccggaccagaccatgcacgccgcacgcattatcttctggcttgcatttgcctcctctgattcgccgacgcacgctgatctagatgcgtcgtacgatgtgctcgctaagccccgtgcaacgagtcttgccgcacagtgaaatggatgtgcgtgtctactttacataagctagctgtggtgtgtgtggcccatcatgttgtcctcctcttttacctctccctctttctttttaccactgctctatctaagcatctacacactgtcactt

SEQ ID NO: 823 - DNA, 1353 bp, Zea mays
  misc_feature (1)..(100): optimal_loci_40335_G1, chr1:240397833..240399185, Cluster 5
atacatttaggccaaccgtctaaaaacttgcatgtagcgataactaactttaggccaaccggctggctgatcgttcacaccgacagttctgaaacccatctgtgtaaatcgaagaaatgacgccaggagaaactctttctttacgagtggtatatgcatgcaactcaaaaccatcaacaatgatctcagtctctcgccgcctgtttaattcgattcacgtgacagcgcgagcaaaagcaatttgtttttggcacacaacaacgggcacaacggttaaagttacaaaagcctagtgacacgcatttcagtgaacacgccgagtatattcttcagaaaaaaggttgatgaggtcggtggcatgcatgtacgtacgtcagcgcccatgcatgaccgcaggtctgcgtgtgggccggcggccaatgcatgcgagatcgaaatggccgatgatccatgacagcgcgtcagcgtgcaccctttaatttgggcatggaggtgactgaacaaaagcaaagcaaaggagagagagaggacgacatgacacttggtacgtactacgagctagctgcagagagaggagacgagctagagagatggatggatggatggatcgtcgtccatgcatggctgccgtaaagcccgacctaggtagctagctagatcgatgccgcactcttctcctagctgagctactaccctatagaagtctagaaccccgaaagctaggcatccagcaagcagccgaaagcaccaccactgcatgcatttttgttgcatggggccaaagcaagcaaagctatgatatctcattccctcttgcattgcatgcatccatgggtttgcccagtggcatgcagcaacatgcaagcatatctgagatcatgagatcagatcctgcttccagcatgcactcacctgcatcatcgttcgtgctcatgcagtaattgcattcattcattgcgtcttgcatgcagctggtggtcagttaatcaaatgcacgcatgcatgcatggttcgtcatgttcatagggtcatatcgatcatctgcacggtgcgcgctagctctctctctctatatatatatatagctgctgctcgctcgatcttcttctctttttccacagtactgcgcatgcacgcttgcttggccgaccttggattacctcacttgattgcctccttcgccgtgacaaggtagcagtatgtgccaagacacaatcactcccctcacgagcacgaggagagacagcaaagcgtggttgcattccgcatgtttggttgttgggatcaacagatcctggtccaagcctagatgcaggatgggcttagcctgtatgtattgatgcaaaccaaaat

SEQ ID NO: 824 - DNA, 1184 bp, Zea mays
  misc_feature (1)..(100): optimal_loci_42568_G1, chr1:251172484..251173667, Cluster 5
gaagaaaaggctggcagctgaatgtaatcatgagcttatcatttactgacccaagtcaacgagttaaaatctgaacgcgcaggaaatgaggtcgagatgcccttggtttccatgctgcactgcagagccctgcacctgatgcctggagccgcatgcatgactgtactgtctgcccgtgatcccgtctgccctccacgtctcctccgtttccaacaaattgccggagtagcctacagagcctgctgattccgacaagcttcgctgacacaactcataaagaacaatcaggcacgcatcacgcagtaacttgggaatgctaaagatagatatagatatacctgatggagctagcgtctacagttggatcacatgcgatcttcgttcctagctaggcatgatgactcagtccccagcgttagattaactaagcgttagaccacgcattattaaccgattaaactagtccatgatcgacgcaaacggatttacggaaacggagcttctggcttctctctccaaagttagagagtgagagacagggccgccaatattcgcgctaccctggtagggagacagcccctgcagggggtcagatgccctgctagtatatcatatgatgcacctacgagccctacacgcatcgcttatatctaagcggaatcctgtgaatctcaggcccagattgtctccgcccctgattaattattagtagggttttttctttctttctttctcttcatcattagtactccaggctactgagtttgtttattgaccattcgttggacgcacgttgagagatgggcggacaccgtacctataatgacacgagcacatggatggcacaagacacatgtatatacgctggctgtacgtgtgtttccgtctgacgattctgcgttaagcattcatacaggcaggcacatagttttcccccctctgactatatgtttccctgaacgagtgttcttgtccataatatactttttttttttttacaaaagacaaaccagggcgtcgcatacttggtgtgtgaaagaaaacaccgtgtatggaacaaggggaccgacttacaattaatgaatttgacaaagtctagagcacggtatttaggtgccgtttggttcacatgagtttgtaatgtaatgggtatctgataacattaaatcatgtttgtttaattc

SEQ ID NO: 825 - DNA, 1023 bp, Zea mays
  misc_feature (1)..(100): optimal_loci_43872_G1, chr1:257856344..257857366, Cluster 5
tatttcgtctggcgctatccctactcgcgcttcatacggaaacttcaccaactgcctttcttctccgttatatacacgcctatctagaactatgctgcccctccgtccatcccacgtcgcccccgtccgtccatcccatcccaggcaagctccacatatctccacctcgcatcctcctttctccatctctccttcatccattgatcttcctcgcagcctccttcctcgacgatacaggaacttgttgcctgatcttcccctcctcccctttccatcataggtgcttagttctggtctatccagtcgcccctccccaccgttcgcgatggatggacgacaagcacccaaatcccgtcgtgattcgttggatgctgccctaggtatgatttctagatcccatcgaagttctgtgcaagacattcgagggaactccatggccgccagtggtattgctcgacgccatgttcagacagcaccagcctctaatcaatctgcgtccattagtgtcgatccagcatggatgatgcccgagtacaggtttgtaatcaatttttagtacctcagttaggtacttgcataataacctactgctatggtctgctagaatgttgcttcgcagaatgtcttttagcagctgtatgagcatagttgtgcatactgactattgtgaaaagaatatatggaaaactggaatatagatgtgatgcttcaatggccaaggctaacttgaaatatatgctaaaaagaatacaatgacacctgtgaacaacaaaattaggggggagaattaccctctgaaatacattttttggttttctgtgcattatctgcaaaactggtaatgccatcagctgttgggtgcattatctgaaatatatagttgatgccttaaaggtgtgcaatttagtttgagagaaaggcacgctatttcttcttgacatagtggtagaagaggaagtctactcttcattgctaacttctggtcacagtttcttcttgacattttcagaagcatttgttttt

SEQ ID NO: 826 - DNA, 1277 bp, Zea mays
  misc_feature (1)..(100): optimal_loci_4431_G1, chr1:23065322..23066598, Cluster 5
ccacggtcgcgcgccgcgagtcgtcttcttgctcatgccgcaggctgcgcacatcagcgtgcatcactcgtacctaaataccttcgtcagcttcgatgtccttggtgaaaaacacaggttactcggcaccgccacacgtagggctgtttgatacagtttttttccttttccgaagagctttttttaaattccttgataatttagttatcgtgagaatttggatatctcgaggtttatatgtagagaaagacgaagagatacgtagcatttatatattcatgctaatttagacgattttcacaaaaccagaagcagattccgacaaaaaaaatctggtcagaagctaatccaaacaggccgtagcgatgacactgcagttcccgcagccgcgtaaacacacatgcacaactagatgtcgccacaattatagcatgatctcatcggcgttggctgccggcacagctcatgctgcagctagacatagtcatgtcagatatatcctcggagtccatcagtgattgactcgagctgactaagcgctatgatggagatcacaaatcctttccacgagtcttcacatgcattatatatgaaagccaacccttctaccaactctagctattcagatcaacctccagtgcttagtaactacaaatgagcccgactttatcttatgatactgataatccataatgtatctacgttggtgagcacagacgtcccaattcatggcccaacgaccccgacacctcaaggtcaaggagtaggggaggcacaacaagatgaacatacaaaggtcccccacaggagcggaggacgaaacaaatttaaggtatggcaaagcgtaagcatatataaacgtaagatttaaaaaaatatgattcgtacaacacaacatataataatatatgacaaacaattttgtatctaaattatcatgtaaacaaattgcaaattaaaataatcacctctcatttgttgattggctttattctctcccattcaatacggttttaatcaattaatttaccgaatcagcatgttgtatagattaaccaatgatttactaataatttaataatacaaataaatagttaaggaagttggaaaataaaccatcaaataataaacaatatgtgactctagtcctgtagtacaaccgcatgggggtatcgagcgctagttactcttctggcaatagcccaccttaaagcctattattaatagtggcctaaataatggttcgttgtgtagcttctctctcatccgttttctat

SEQ ID NO: 827 - DNA, 1266 bp, Zea mays
  misc_feature (1)..(100): optimal_loci_4441_G1, chr1:23101808..23103073, Cluster 5
agctgactcttgtgctctggttagattttatccttctcctaactagatatttgctagctgactcttagttcaaacgttcaatgatatacgcttacctaatttgcactttcagctcttggctgctagagcagaagcccttttccgtctcaatttacttgatgaggctgatgttgcaatctctagtttatatagattttgatgagctgtaatgaatcctggctcattccagtacaaccgaacgggcccttacaaatgttctggtccaggcatccagctccagcggctcccgctgggcggcaggcagatgctagctacagccatgtaattaacctgcaactctgcaagcatgtgcctggttttatactgcgggtggcctccagcgatgcaacgcatgccgcgcacgtacacgcgcggcagcgctagctctgtcgcgacgtccttcgtctaatcgcctgcctcgagctgcctgcagctagctttgatcgccgcgactgttctgctcgaggccgggccggcttgcattgcattgcatatgagcccgatacgcggttttgcagatcgagcattctcttgcagtcttgctcgtgccctattgagcattctgcattcaccgttacgctagcaatatagttcgggccaacatcggggtagctagtttcttttaccatgcatatatagcatctatatttattatttattttcatttctttgtaagagtattggtttactttcgatgcatgcacccgtgttatatctgctagcatggatttattgttgggaaagtacgtgcgcacttttaagattagattaatttctagaacaattactacttaactatatatagcaaataataatattaaatctgttttagacgcatctaacagaaacaggaacacgggtgcgaaactcaccattacttggacgtttcagtctagtcgaaaatgagtttgcggtgttgttaaactttatagatgttgccgtgcaaatcaactgaggagtcaagtgatcgttgttcaaaaacctgattcgcctcaatctatgcagtttctttaacggagcgaggtttcgagattactgcttatctatctacaccgtcaagccaatgtcgttaacagaagagcataagattgcctcttatctaaaatgataacttatggagttatggtagattggttgtttctcgtgcctttgagggagaatgacatctctatatataaggtattaggctcctgataaaaaagaaactaacttggttgcgatctccat

SEQ ID NO: 828 - DNA, 1082 bp, Zea mays
  misc_feature (1)..(100): optimal_loci_44930_G1, chr1:263592712..263593793, Cluster 5
ttgtatcacagtctcttagctatctcttgtatttaggccctgtttggtttagagtgactgaattttagtgactaaagttaagtcacttttagtcctaaagaagcaaacatggtgactaaagtggggtaactaaattttagttctttagtcaccaagggatgactaaaatggactaaaatagtatttttaccttatttgccctctccagttccttcttatagcaaatatccattaattaataggggtaaaacagtcattattcacagtaattaatactctttagtccggtttagtcactggaaccaaacggaatattttagcgactaaactttagtcactaaaatttagtctagtgactaaaggaaccaaacagggctttagaaaaccgttctaggagctcatgattgtacatgccctagcggacgcagtcgcttagcagctaggtctcgcaatgattaatggaagcatcaccggcctattgtgcccaccatcattaatcaatgccgggggcctcataaaagcttttgtatagtagtaaagtggtgccaatcctatctttaggccctgtttggtttagagtgactgaattttagtgactaaagttaagtcacttttagtcctaaagaagcaaacatggtgactaaagtggggtaactaaattttagttctttagtcaccaagggatgactaaaatggactaaaatagtatttttaccttatttgccctctccagttccttcttatagcaaatatccattaattaataggggtaaaacagtcattattcacagtaattaatactctttagtccggtttagtcactggaaccaaacggaatattttagcgactaaactttagtcactaaaatttagtctagtgactaaaggaaccaaacagggctttagtattccaccttgttgtcggaagttattaaattagtagagccaccctaacatatatattagcagccgcttcgagcatgggttctgtttcctgctaatttcatcttcgccccttgagcaaaagtgtgaggcggtcgctctcatatctatcttaacatatcagatatcatatctatcca

SEQ ID NO: 829 - DNA, 1353 bp, Zea mays
  misc_feature (1)..(100): optimal_loci_46166_G1, chr1:270552005..270553357, Cluster 5
cttgatctaacaaacttttctaaaatctcttctaaaaactctccttatcttatttgctaacaattatatccttatctatttgctaaaaactctcaacgaactcgatttggccgattacatcttgaccacgccccctattttggcgctggtctggctggcatcgtgcaaacgtccggcccacatgacattttgtgagccaactattagtgctttcttgtgtgagcccttggtcaccttgtctgctcattcgcctcttattcaattgcttattctaaaaatgtgaggttggttaatcttttttattctccttttggagttccctatgtttctactaatagaaatagttcagaccttgctcatacaatcctcgggactgctgttgcttaatctttgtccttcctagagaaagtaaacaagacgatacaactgaataaaatcgggctgaatatttttgctaggttggccaaacaaactaaaacactcagatttgctttcagatttgtctgcaaggctacatcactgccaatctttaaaatgaaactccaccactgtctttgtcgtcataaaacctaatcgttgcatgaaggccccaaacaaattatatccaacgacatgcttgctttctaatttttaagcaacttgatggtctttcccaacaaaatgttttcccataattatgcactcttcaattctacatcatatgtgccagtaaacgaaacgttatgtacctgcaggttatagtgtttagtttgatgaagaggctactcataggtttcttcagaaaatgctcattatacgctttgttaacattgcagagtttgtaattggttttcaggaaggcacataatctttctttatgaataactaaggagtctctgattactgttactagtactatatgctaaaggtgacagttcagattgtcaaactgtatcttgatgtatttggcacttcgtgctccagtaagtagcctcctgcctgtggattgtttatttgtttcggtgaagcacaagtctttcaattggctacatgactacatccctgtttcttgtgctattatcatgcacatgcactgatgatcatttgtttccttcgctcgttcatccactctttatggttgtctctgtgggccttttggtcctggcgtaaatgttggaatgcctctaaagctgaagctctgatacgctttatgtggtatatataggtctcatggttcgctgaatctatactgtttatacttaatagaaaattctctttccagttctcgttccgtctgtgcatctgcggtttatgtatctaccgatcggtgtttcctttgagcaatgcggcaggcttgtactttggtatcatatt

SEQ ID NO: 830 - DNA, 1291 bp, Zea mays
  misc_feature (1)..(100): optimal_loci_4704_G1, chr1:24190113..24191403, Cluster 5
agatctaatttttgtaggtgtttttagtggacaggaatatatgccaactggagagctgttagccgctgctctacgcttgtcgtttcaacataatccactagctagctgaatatatatatttgagacacagatcgtccgcacgcaacggggcacgcgctgatcccggcgtgaaattgtgttgctgcatgcggaccacaccatcagtttcagttcacgcacgtcgagtagtatcaatcaatcgacgtgctcccgtcgtcgtcttcgtccacctctctgctgccccgtcgaccgcaccgcactcatcacctgcgtgcgtgaaagggttgctgattggtcgtagagcatactcatggctacgttgcctgctcattttcggcttgggtccaccgtacgcgtagctccacgttacccgccctagctagctcatgtttcccttttctcttttttgatcgatgcgacgctgcctctctgaacgtattacgtatggagtttttcattttgtctgcttgcttgcatgcactagtattcgtcggcacatccgatcccactgatatcgagcttcttccgtagtgtgccggatcggacgcagtattggtcctaagcttgcaaactggagatttataaattgccgagatagttttgcaaagagttgtaaaccatatatgcatgcaaagtgtactgcactagtccactagcttcgttccattgatcgagcgggccacactgatctgagacaaagaggaaaatcctagcgcattgaatggtgctagctatagcgagcgcctttttctttcttcttcttcaaaagtctgcaacaagagagtgtgcacatgcagctgcgtgctgcattggagtacctaccgtcagtcgatcaaacagtcgctgctgtaggtcatcgtgatccggacgggcgggatccaagggacgttcccgtactcctgccgcccgcccgcgcgcgcatgcatgcacgcacgcagatcgcagaagcatgtcatcgaacaggcgggccgtgccaagagccttaaattagggatgcaagaagcctacaacgatgatcaatgcgaggcggccgtgtgcgctcggctagacgcggtcggtcccccctccccctggccatttccccctgttgtgttcgcctcgtgacgaggaagaaccgtgcaattctctgctgtgtctgcggcgtggtcgccctgaactgaacctcagagctctctgaccgaccggcgaggaggccaagcatgcatgcaggcaggcctgctggcgagcgccgctctcctcttgactccggccg

SEQ ID NO: 831 - DNA, 1103 bp, Zea mays
  misc_feature (1)..(100): optimal_loci_47553_G1, chr1:278680720..278681822, Cluster 5
agtagggaacactcccagatataagttggttctctgctatctagatggacgatatgggactaaagtcccgtgccatctctatacaccaccttgactttcttattgaattgggtcacatactagtcggcctaattccaacagggtcttctagaactgctctatagttttttccaacatggattactgcaggccatgagccaaagcaccttaaaaacatactacatctcatgagaagcgaagccaggatatctcattttgtagaagttggcttaaaggactaaaagttcagaaagccaacagatgatgcacgaaacgtggacactgtgtcaagttgtatacaaatcctaattttaagattaactaatatataaattcaactgcatgttctctagatccaaatttcctaccagagacatcctcatctccttctcggcgaaaagacatcctaatttttgcatgggtaattccatgtccaatttggtggcatcagagtagaaaaaggtcaaatgcttctggaccacttaggtgaggtatccattccctctaagaaccgaacatggcataaaggctgcatgcaaattctcacatctcatatatgacaacacaatgagaggaaggctaaacctgacccccacgttaagtatagctttctgcctgacctgagctggacatcctaacaatttccgtgagcatcagaacaagtgaccctgcacgctctccactatgtgtaccaataacgactgtcagcttcatatcaatgttcaaatacatcaatgcaaatccgtgctaatcaccaccagatccggaggatgtcgcctgggaagcaagaaatgtggaatactttgctcgctctaccttgtaacgtttcagctctttgattgccgccagcagcacatcacatgcaaggaaactggtgcgaaaaaaaagcttcacaaagtatggtattttcaataggaattccttttcaatgtagtactgatgcacatgggttttgatgtatgctatacagttgccatctcgccactctatagtttgacaaaaaaatgtgttgcagattggtaagctatattctgagattttaaaatagataaccgaagaatcga

SEQ ID NO: 832 - DNA, 1184 bp, Zea mays
  misc_feature (1)..(100): optimal_loci_47844_G1, chr1:279877264..279878447, Cluster 5
aaataaaacactgtagtaaaggacggtttttactccggtatatagcatcgtcgtaatgatacgaaattacaaattgaaaaggaaataaagtaagggcgccatatcgttggtatcgaaagaacgtcaaggccactttacagtgcaaaaaaatcaggacggctgagagaaagaagctgaaacaggactttttgatatatctcgctaccagtgacccctctctctccctcctcaaaaaattggatccaaatcgaaaccggaagcgccctatttgagagatcacgagcgcttacgtgctggagtgagcgacagagattgcagcgatggccacgcaccatcagcctgtacgtacgcgcattatttgacagggatggcagcgttggggagtagcggagtgtaccaacaagacaccatcgactgcgtatctccggcgaaaggatgtctagagacgaaattcgccatgggttcaggataacgtcgtcgtataatcttcgagagggccgtttctacagcggaggcggagacggcgacgccgaagccggagcggagcggttgttgctagtccaaatgcgatgcgccccgtataaatagggctgtagcaatccgtggagccacgaagcagtcaggtcggtctcatgcggaggctgcatcacgcgaatgccgacggaagtcgaatttatgagctatccagtacccgccgctctcgtgtctccatcaagaaaggagcaggccgaaatcgactgctgtgccttcgttcgatataccaagtgcgtctctgctctaacagcacgggctgcaggtaatagctctaacctaatagataacatagaaaaggatccacttaaccaactgcatgcgtagcaaccttgacgcaatgccaacgcttctgattgcatcgcttctctgtagctggacgctggcgctgcgagaaactttatgaggtcctgtttgggattaaagtattttttgtagtttctagacaatattatggtttttattaatatcatagtattttatgctataagttgtttggttgcatttctggaaactatgtttttaaaaaaaccatggtattctagatactatggtatttttggagtattgtaaactccactataacccaaagttttcatggcatggctagattttgtctaatatcatggtttacaatgtgtatccaaacaatg

SEQ ID NO: 833 - DNA, 1109 bp, Zea mays
  misc_feature (1)..(100): optimal_loci_48648_G1, chr1:283167650..283168758, Cluster 5
tatagatatatagatttgaaagtggttatagggttttgcgaacagtcccatccgttctcatcgctaaccccacgtccccacgtttcctcggctcctcgcccgcctctctcgtttattagcgctcgtaaaccccactcacttcttccttctcttcggccccttcctcggccgaaacctcagttgctcctccgcccgctcgaaaaccccaagtccccaatcacacatcgggccaccgccgcggcatccatggccgccgaagacaaagggaccggagaccgcgagaatgcagaccccaacctctgctccatcgccgacgcgtcgctgtctcacgagaacaccgaaggtgatttcccgtccccagtcccatccattacttatcccaactttcgtgtcctgtcgatcaggtgctcgattcgaggccccgacgctagcctaagcctagcttggtgggttagcttgatttcccgttggtgacttggttgatcgcgtgcttgtgtacgagccggtgcgtggttccgacttattacgtgtgcggtgtgccgtatgcgggtttgcgcgccgtttctggggtttctggtgtttgcgggctttgggtgtggatctaaaccaaactggtgtgttttatgaacgatcgttctcacactgacgtgcgtgttatggtttggtatgtccaacatgtgggctacagtatgaactttggatcggttagatttgattgcagcactgctcgttagtcgttacatgctgtttttaagtattttgcacatttttttgccagtaatgtcacaaagatgttagatctcgttgatgatcgctctcaggtcgttctttcgccggttattttactattaacaattctgcagtgatgctggtttcaggggtcttttgaaatccactctactagtcacgatagcttacgttctagtaactgatttacgtgcatactttaataaattaaattgttacctttttttgaaatgctatgattggtaagtgcttgttttacttgctagcgtcgagcttcgttttttctgtatgagcaaactcgcacactaatcatgatagctctcgctgaagtaacttattttaatggcaagatcttaccatac

SEQ ID NO: 834 - DNA, 1322 bp, Zea mays
  misc_feature (1)..(100): optimal_loci_50469_G1, chr1:293309386..293310707, Cluster 5
tgagcttgcattatatttcagtatagataaattttggaagttcccatgaccgcatagcttgcttcgtgagctccgccactagtagtatgcatggggtttgattgaaactgcgcgcgagtgataatgtttttggccgtaatgatttctgtcggcgacgccaccgttggccgacatgagcacgaacgtcgctaagctttgtgctcggctgtgctggaggtgtcggagtcgggcggagaatgaaaaaggaaagatcgcatgaaacggcagccatcgatctccggtgccaacacggcgcttgctttcaaatttccccaatccctccctccctccccgccctcgcgcctttggctttaatcaatcgatcagctcgcgatcgtcagcagggatgttggtacatcatggtagtgcagggcgaaagcggcgtcccgccggcccctccgactccgatcctcccccactccctacgcggctaagcaactaaagcgccgggcagctagccagggccaatgatcattatcgcccagcgggaccggcaccgtggctttactcacctggccgtcccgcgcgtcggccgcacgtacgatggccgcggcccgcccaggtagcagaggtagtacgtctccttgttgccggccgggccactgctgctggccgcggccaggcacggccggcgaaaggccactagctaggggaggcccaggagacgagggggaaaccaagtggccagcacggccaaaggccaggtaaagcaagcgagaggtgaggtgacgagccggcccggcgcttgcctgctgccaccctgcgctggcgctgggttgcgctttccaccggcacttgtcctgaccgggtgattgcgagcgatcgagcagcggccggcgggggagatggcagtgcatgcggcggcgttggccaggcgatcgtcgaggccggcgcggccttaagccacgcgtaccgtaacgagcaagctactcgaccctagtcctagctgcaggttttcggtcagcttacatggccgcgcgcgcgcgcgccgccatagacaagctagctttcattggaatgccagaatgcctttgttcgttaatcaaaaaaatcaaaatagaatatgtatcgccgatctcttcgccccaaaggaaacgcatggcagatgctagcagggcggtggagagagatgtgtgaggccggatttgagctgctgcaactgcatgctgcaggtgcaggatgaaatggccagagggcagtgccagctagctagcttagtactagcgctaagtgcgcacacaatcctcagtgagcaaaagccgggcagaatcttggactgctaa

SEQ ID NO: 835 - DNA, 1300 bp, Zea mays
  misc_feature (1)..(100): optimal_loci_52299_G1, chr2:3008769..3010068, Cluster 5
ggataagaagaaaaaaacaaaataagagtacttacaaatgccttttcagataaaatatatttgttcttccactctttattccacaatagagattgtaagaagaaaatgtttgagtgcatatatccgtcgggcttgaagcattctacaaaatatttttctaccactacatggtccagtatatctaattttactgtgtccctgattctatccaaaacatgctcttggtagagttgagctcaatccctggaggttagatcagcaagcaagcgatcatgatggcagtctctcgaatcctgatcatcataccaatatagagtgaatcacaacattgcacaaaatccccctggtctcaaatagaaaaagggcatgccaacttaccgtgggctatgtgtactcttctacacttcctctgtttgcatagcagatgtcttcccaactcttaaactgaaatgggacaaggatcaatctcaatgcttaaattgaatcttcacaaatttacaaagttcatatgtaataatgtcctagaagaaaatagattaattaacacggcagtcagaacttttttgtcaaagaagttttggtccctgtattcaatgtaataatgactaacattattttagtcccacgattttctttaacggtatagctttgtaattgataatataattttttggttgaactgtcataaatttatagactaccgtcgtgtcgtctcggggtgaaaagaaaaagggctattttgtagtctaccgtggagcaagccggtgagccgcccctcctgcctccattcatttcggcggcagattcatgccggcacctgtcccagacacttgcctggatattaatataggaattacattatctgagatggaaacctgaaatgaaaggccaccaggatttctgtcgtcgtcatgggctcatggtcatggccatccgtacaaacaatctgcagttgcccgtgctctattttactgaatgttcaggggtcagttgtgcctataaatactacttcggccggctcggcagggcgtactgcagccattgctggctgctgcatctgcaaagactgcaacagttcgccaaaggcacagctctaccaggagggagctaggaggggcgatcgaggtgggcaagagaagagctagctagctaggagatgcaggcgaagctaggtagctgacctttatttcctggcatgcagtgccggtgccggaggctggtgctgcctgcgacatggcatgtgctcggacttgctcttcctcctgtacgttacgggtacggcgtcatcgtatggctgtta

SEQ ID NO: 836 - DNA, 1042 bp, Zea mays
  misc_feature (1)..(100): optimal_loci_5288_G1, chr1:27110749..27111790, Cluster 5
aacagggccttagtttttttacggtgttgggatgttcagagatggcgccgatttgccgaatgaaagcaggcacaaaggcccgatcatgatggtaaagggcggcgctgcatatgagatggaggaaatcatgctcttgcgcttgcgcccccaatgatttcctcctgcgctacctggacggaagctggtttgagctcgagccttttgctttggggccattgggcaacggagttcaccgcttcgttctactacacgaaggtgcgctgcgtaacggcgaccagcgttgacgtaggcaacatgtgtttttccacttgctcatccgatcggcagcatgccctcctgttcccaaaacggcgaaacggagatgataattacttgcagcccacggccgtaactggcgtagggataatgggccaacggcccaaatggaactggtcgacttgcatcctacctagaacccctttcgaatattattttttattagcaatttccaaatcgtactcccgaataaggctgcctgaaacaaggcacgctttctgacgactgacggtaccacatacaatgcttacataggcaattcatgttccagatttgcactttgggttctgagtttctgatgctagttgtttgcttgctgctacatcagtgttagtctaggcgttgtgaaaaaaaacacgctggtggacacgctagctacttgtactatgtgattggttgtggtatggtagcagactggtccggcttggccagtatgtaaagagccaagctccttatgttctggctagatacatacgtaaacttttgtttggttgtttgccttagtatattcaggttagatataactagtgtttggttgtttgcatcagatgcaagatcaaataaaataaataaataaatcttcaatatttatataacaaatatggtctagttttgtatataaaaatgttaagaacatatatctaaaatcagtttagtgattggatatttgaactaagagatatggtaaaaaaaaagttaaaaggaatatttttggaatccgtctcat

SEQ ID NO: 837 - DNA, 1133 bp, Zea mays
  misc_feature (1)..(100): optimal_loci_53532_G1, chr2:9424286..9425418, Cluster 5
ggagagacgcgtctcttttcgacgactggctgcgcacgacggcgcgagacgattgattgctcaggggctcatggttcaagcgatgatcgatgctcatctcttcctactctccaagagccaaggtcaagctgatgactcactgacgagttcagttcacgatgacaagcatctgccgtggcaaatctggctttaactgatcattgtgtaaggcatgcaaaaaaaaccctgataaataaggtagcgtttacttcctaagtgtggtggaacacaatcgttcggtttttaatttattgttgtttgaattgattttatataggatggagtggttctaaaaataaaaaaataatcaaatgttaaactatttagctcctcaaaaattctcggatggagcttcttctaggtacagggccgttctatctaagtgatttcagaaccaaatactacctaagttagacatcgaatgttgtatgatcggtttggcctatccactcttttctcgggagggaagtcgatatgctagtttggaagccacaaaatcggaggaatagatcgtcgacggagctgtctcgatcgatcagaataggagcttcctcgtgcaaagaattgttccaaatctgcccaactaacactgtcttctgacagcgccgagatgccgtcgacgacgtctacacatgcgcaccgcatgttttagggcatcagccgatgtcgatgtactagtactactcatcgcgtcggtccggccagagaaaactttcacggtttactgttctctgacctgttagaccatgccaatcgcttttacatccagcaacttccaactgcaggacgagggagttcaactcgaagtggtttctgtttatggtccagagggaggaaacgttttaaaatgggtgccattgaaaaggagaggatcaggctagcagctattcaaatgatatcgatggcaatggtgtgtgcaaatcgcagaatgctgtcgaggagagaattccaaaacggatctacgcttggtatatttaatctgcttttggttgattctgaagatttcaaatgctacgtttccggaggtctggaatccggagtagggcagctgacaaggccatctaccttctacttagcagacagttgaaactcgg

SEQ ID NO: 838 - DNA, 1271 bp, Zea mays
  misc_feature (1)..(100): optimal_loci_55530_G1, chr2:20110471..20111741, Cluster 5
agcacatacgattgttttccagggatgcgtaccatgagtcaggaatcatgtattggaaaattgtcaataacgttaaggcagtgaaagtaacagttaacggaacagaaagccacggactagtgcatcattatcagtaccggaacttcgacgtctcgtcttcatagttcagaaagagggggggggggggggggggtgatcaacagcagccagctcgtttgtggaattctgcgcaaccttcaccaaggcttctcggctacgaaccacagaatcagattactgcataaaaagcatgctgctcatcaacttcgttggctgtttcaccgtagttttacatatagtccagtttcagattctcacatctatctcaaacgctggcatgacagttccagattcttacatctcaaatgctgccatgccaagtcccagcaccatgccgccagcattttgttgaaacaaagatagcaccaatgctaagttttcacaaaccagatttctcaagtcctaaccaaacagccattatcaccatatgcttacacaggaactgcatattttgaccaggctggcaactgcttgtctaatgtctatccctatatgactgacaataagtgtcacatataccatataagtttttcatgcatacactccacaaatcggtgtgggttattatggcttacatgaaagcatgcgtgaaacacggtctcacttcttactgctgtgctgtgcacaccgtacccttggccttggaccagcatcctccttgactcctcgtctttgtcatacgcctcctgccgcctttggtgcttcatgcgcctcatctctccgatgttcacatcatgcatgacggtctcctcgcactgatccacctcatgtctgatacttgagtgccctgcattggtcaggcgagatagcgccagattctgggaactcgatgtcgaattccacaatagatggcctttcatcaaagcccgaccatgcaggggcataccctcatcatttatggctgaccttttcttttgaacaaagtgtatgagttgaatcatttccaaaagtcaaagtcaatagaatttacataccaaagcatacttatgtgtcaacccaaaacaataccatctagaattctagattctagaagtgggcagcggcggatctagaaataaatgaaaagagagcctgaattatgtattggagagactaaacatggtcccacaatgtgaattaacgaaaccactatggagaggatgcgcgaattacatggacatgtagcctgttac

SEQ ID NO: 839 - DNA, 1309 bp, Zea mays
  misc_feature (1)..(100): optimal_loci_56391_G1, chr2:24726950..24728258, Cluster 5
cttactctattcatagatcgcacgtacctgcctaacttatcgcaagagcaccagaggaaggattcacattagcacccgatagttcctgcccaccgagccaatggtgaaggtgggacccttgcaatcatcgttgaggtcatcctaaggacatagacttcgacaaccagatttctaaacctaagacaaaccaatggggaactccaggcttgaggacccacactggttcgaccaggtggctcaactatagtagaggctcaatcagaggtaccagtggatcctagagtcatgatgtaagacttggacaactctgagtactagatattaagatattcgatggggaagacaactccttaggagggacaaacatgcctgacaacgagatcctagaggactacatcaggaacctaatgaggttggagtcaaacccaacgaggaggaggaccctaatgagctagtggacatcgatgagccttggacatcggagccacttatacatggagttcctgatccggagactcctatacatgaggctcttgcactagttgctcatgctctagaggcacctatcctagaggatccctcgttggaggaccctatgctagagcaccccttcacccatgacatatggaggagggtcatccactacatcagtggcctgaccttgcgatttacctgcatgttctaacatttgctcacaacattgggaccaaccgaagtcattgtcaactacatcagggtgcaacatcagcccatcctaaggcattatctaaaggagtggctcatcttagccgagatcactaggctgcatggatttggaggtcggatggtggtatgttgacactacgccatatctatcttggacaactacgaagtagagatcaatgatgcggctaggtaggccatgtcgtatttctatgacctcaactatggcaccatggaccattgtatctagtgatactaccctcagtaccaattcggacggagccttataccttcgactcaacaaccaaaggctaatatacatgacatattaatataactaaatctaagcaattcattaaaggttcaattatatttagcaagatcaatagtaaacataacatcctctttccaatttttgtggatcgacttcagagaaggacaagtaactaatttaacttgtgtttactaaacaaattcaacaacattgccctccttactttcatcgtttgagatatcgaaatagttttctatgacatgcatatttggacaatgtgatctatgaactttatgagattctttcaaataggattcatccacaacgatattt

SEQ ID NO: 840 - DNA, 1131 bp, Zea mays
  misc_feature (1)..(100): optimal_loci_56729_G1, chr2:26924626..26925756, Cluster 5
atttaaagttatgatggaatctacaactttgatgctccgtatagtagcaagcttcatcatgcataggatccatttggatgcatcaaagtagacaattgaacctagaaagaccaaggaacaatggccaaaatagggaaggcttaatccactctcagggcgatcaacatcaaaataggggaggcatatgccatcctaagcccaatcaatattagggcaaccaacatgaatgactccgcactcatgacctccatgaacaactaaaatttatacattaggatcatgatctcacagagtcttccaatgtgactgggtacgacgatgacatgatacgagtggatatctttccctactttcaaaaggctaaactccatcaagtacatgagaaagttcatgcctatcaacattgacatgtattatggaaaggaatattcaaatcagtagatccaatgttacttgtccaccatcaaccttgctagagggaatgattgtatctatgtagactgcttccaatggtgcttgaggttactctactaacctagctcaaacaactcagaacaaagtttaacaatagctaacatgtgctctccaaaaaaattgtggagaaattctagggtgcatgtgcatgggttcatccacccaatcgccatgacctctagagttggaagcaaaaaagatagagaaagcacatcgactattacaggcgcttcactgatatccactgcacattggtggacatatctgatagagatgccattgactactttcgacgatggagttagagacaaatatgaaatatctattgttttctaatatggtggtcgaaaccactaaaacttaggcaagttttgggacatggtcgataggcggacaaacacataagacagaatatgcgacaaatatggtgatcaaaaccactgagacaataaaggcaagaatctgaagaacaacagcgaaactcgatatgtaggaagagggggtatagacaacactatcacgaccatgaagaagtcgaagaaaggcagcaagcctaaatctttcgaggaagtgtagcaaggtttcactatataacctttctctagacgccctaactagttaatagtcactagcttttagtggtaagtggcaggtaac

SEQ ID NO: 841 - DNA, 1184 bp, Zea mays
  misc_feature (1)..(100): optimal_loci_58586_G1, chr2:37873114..37874297, Cluster 5
aaaaagagagacaaaaaagatacacaggctgacataggctgacatgtgggtccacatgtcaatcacgaccgattaaggactggactggcacactttaaaagtttatagaccagtctgacatagggcgacaagtttaaggccggaaatgtattttactcaaacaaagtcagtattgtttaatatgtttccattagcggtcagttccattaccatttgcgtttacatttacaaatgatacaaccaaacgacaccttaatgtacatggaaacctatcttcatcaacaatagcaccagggcagatatagtaatgggcaacccaatagtttttgtagtaagttagaagttagtaggcatcaatcaaatagcttgaggttagattttgaaaagtcggtttcgcacagcagatagggaagaggggggagtacctggtgggcgctcttcgccggagaagacaacggcggtagaccacccagtcgtcgcagacagagagagagaccccccccccccccccctatctgctgtggaggatcgatctgggctggggcacagtcagcggtgcgaggcagacggcggcggcgaacggacgaggaacgcgacgcgagggagacgggatcgaggaggtggtagacggttgggcttgggcttgagatggactttttttggaaaaaaaaatttgctactggttaaagcccaaccgatctcaacgtgttgtgggcttgtggcacaatggccagggtcttcatttcaagaattacagtttcggttttctaattttatcataaaacaacttcaacagatgggtaaattagggttcaagagttttggctccaaatagactctaatttttgtaatacaattagtttgtgcgagtttctttaattgtccttgataattagtgggtggagaaagagacatgaatcagtagatcatgtaatcaaggtatggtggttaatttttgtgcaattttatgtagaggtatgaaaacaatgtttttcaagcaccttttaaggacattcaaaaattttatgaaactgacctctagtttttttgaagctagagctcatgaaattaacctatttagatagaataagctagaatgaacctaaaattcttgaggtggagacctcacataaaggtaaggtactgtatggtacgtagggatggctcacactgtcacgcacaag

SEQ ID NO: 842 - DNA, 1140 bp, Zea mays
  misc_feature (1)..(100): optimal_loci_5872_G1, chr1:29800013..29801152, Cluster 5
gccaatcctagcttgattacactaggagttagacccacgagggaggctgaagagtaggctagcttgactaatggaggtaggcccaccttgccttattgtcttgtacttggtcttctagttccaaatcttgagaggccttcgttttggggcccttgccttggagccaccatcttgaagtcttcatgctcgatgccacaaggcacctcctaggcacccaacaaagatgatgtccttagtgtagcccaagggctccgctctggctcatgcgacctccttcttgtgggacattaacgaaatcctttggggggcattcacctttgggaaagttgagccctcgcttgtggcccacctttagagacttcttgacttcgctgacacctaccagagtttgcgtcatcttattaggccaccacggagtctctaccttcaaaattggaattcagctctgatatccatagataagattagtgaagggttcactggtcacttaattggatgatcgaggtctagttcggactttgtcccaagaagtactattatagcagtgatgccccatcctcccaatatcttttacacatcatttgtatcaaaatctaatttgttctattttatatgtttttataggaatcattctcatattgatcacggtgaaatgggaaataacttgaaaaataaactagacctcacgtaagaaataagaaaaatatgtctatcaactagctcttagttgtttatatttttttatttcctgctctaagggctagttaggggtaagagtgtcttcttcccgcacatgaaaccccttggcttggaaccccatgaccataggaagtaaggttgaagtaggtcaaggagtaaggaattgagatgaaaaaatagggaagaagtaactcaaacgtatttttgcacttttttatatttgtaatgtgtgtgtgtgagagagaggttcttcattcttcaccttaaacccttttggtgtgtaaacccttgacttgaaaccttgaccagaggaagtaggcttcaagtaggttagtgaaggaggaactaggatgaaaaatttggatgtacatagatctgttgaaccggttgagtagttgaacggatgatacactttgagggtgttggtaatgtcggcgatgg

SEQ ID NO: 843 - DNA, 1180 bp, Zea mays
  misc_feature (1)..(100): optimal_loci_60310_G1, chr2:47967092..47968271, Cluster 5
gtacaatttatattaaatattataaacacctaagcattatgttttactggttagacatcttcaccaagtatcccacacctttcttccaccggagtgtgtgttcaaacctcacctgatgtatcgctttttaatataatttatctcttgcccctctttttaacattttttacactgagttgatttaaaagaaatatagtgacttttttgtaaaaagttaacgcacgccgacagttgaaactagtgctttaagtacagtagagaaataaaacatgtaccataagttattgagtaaataattgttcgcggatttatgacaacttggagtgcttctattggttgagagtggttacgcctagcgctatacaaaatctggccacaaaagatccggcgtgggggtgtttctctcccttctcggcttttccacttccgtaatccacgcatggcagttctattctttctctcctctgccttcacgaatgcagaaaaaaagaactgccatggggaccatcgggaggtggctagcccaggccctggccgacgctgctggctgctgaccgctcggccgcgtggagggccgcctggaccaggagggcgccgccgcggcgtgctgttcgcgcgcaggggctacgcacaggggccgccatggctggctacgccactcgtcggaactggccgtcggcctgggcgaacgccgccggtaccggggcacgagcggggagtcgggtggggctcgcgaccgcgcctgaagcaggggcagggggcaccgtgcagcacaacggtaggagaagtctgcggctacacggcgaagagaatgaagaacgggaagaaaaaacaatgcagatatcgttagagtggaggagaaaactaccgattgccgataaattggaggttcgattgacaaatttaaaatatcaagatggagccttcgacgatactaacacagcggtattcttagattttgttaacatcgcataggttaaaagtaattactcgtcggaattaaaactgtcctgaacttcgacgatatacttacaacgtcatggatctcgacttgcgatacagaaataatatttgaactgacgtcatggatctcgacttgcgatacagatataatatttgaactggctcgacgagaagatttcagcaatatatatatagcaatatatatagggtttaaaga

SEQ ID NO: 844 - DNA, 1088 bp, Zea mays
  misc_feature (1)..(100): optimal_loci_6213_G1, chr1:31776094..31777181, Cluster 5
tagatcacaaactcaacagtaataatgaattgctataaataaataatatgagtgttccgaccaaagtttagctactgtattactgacgctatatagctgtactaatttgtttgccactttaacttttcagctcagcattatattagtcggggaacaaacaactatagagtggaatagcctagagtagctaataatgtacatcatccagcacgaccctaaggtgtactacgaaacgatatgatgatctcggtacgttagttcttgttctgtttgtagtcggcaaggcaagcacctggatgatccatgcaaagtgcatgcatgcatgaacacagcctcgcgtacgttaccgtttgtcattgcaccgattggcatttggcagcagcgcaggggccttagggtgtcgatccgtcacttcatgcacacacgacgattgacgacgatccgatcgcgaaaaggctctgctataggcccatagagcttagctatagctagctatatagatcggccgagacgcgcgacaccattcatgcacctgtgcgttggtccgtgcatatgcatgtgtggttagcaccgtgcgtccgcgcaagcatgcatgtgggatgctgatcgatcgggctgggccggggaataagagggtggcgggtggcgtacaaacgcaacggaacgcgagcttgacccctccgctgctccggccgtgtccggcgacaagaggatgcgcccagcgccagcgccgcccgacgcgcgcccctgtccgccgcgcctagctcccggccccggcctgtgcattggaaagcaaccaagggttgttgtagtagctgtcgtcgtcgtcgtcccactgctcctacatgatgcatgcccactgccgggtcgatcgatcgctcgggccgcatgtaggggagtgacggacagagacagacagacagatcgatcgcgacggtacgtacacgtacttgcactgacgtcgtactgtgcttttcgtggataggaacggccctcgagtcgacgcgccttcatgcacctaccgtaccttctggttgttccttcggtgtgacatctatcggtgtgattcagtgatggtataattgttt

SEQ ID NO: 845 - DNA, 1074 bp, Zea mays
  misc_feature (1)..(100): optimal_loci_6262_G1, chr1:32010760..32011833, Cluster 5
gatgcctgccgtatctgtttcgatcctcctcccatagagagaaacttaattatcacagagtttaagtgccagcaacttctacttgtatgcatactaattcccaagaaatactgcgtattaattaaccaccttgtcccctctgacatgtccagttttaagaccagagctattgagctatatcgcttacattaatccgtaaaccaattcttggtggagctcaaattgccaccggccgggtcaaaatgtgctcacagaatcacagcacggtcgcccgttccaagaaaacgaattcgatcgcagtcgctggtgcaacttgtcagtcgttaccacagcagggatttgtaatcttgagaatattaattggtcgcagtctagctggtatgacataatgttcaagtatatgccttggctaattagctagtttttgttggcagtgtttcggctttttcatatcttctctgaatcataaggccaaagctagcatcagattgcccatagaaatctggagagcacaaagccacgtaggctatggcttagctcacagttcttatggcctgtgtttcttgaaccttctagctgttccatcacgactttttatgtatgttcatgcatgtgatgtggccatcccaacgtcccctacgctcgctgtgggcttgagacgaggcgttgccgctcaagcagtcaacgtcaccagtcaagttgcatcactaactagcttagcatcttgggcaatagttttggacgacgacggagccacttggcacattattgcagatactaaatttttcgtccatcctcttgcaactaaccctaaatttatccctgttagctagccatcacatgatctagcatcgtaagtgaccaccggtgccgccggtcgtcgctcatagggcgagcgagaggtggtcgagacaaaccagatcgaagatagtcaagaaccaggattatacatcgctagatggatggttgtggttgtccacacacctaaggttttgccattaatggacgtggcaattgccgaccgtggccattgcatgcgacaggaacagcgatggggggtggggggttaagaag

SEQ ID NO: 846 - DNA, 1278 bp, Zea mays
  misc_feature (1)..(100): optimal_loci_6638_G1, chr1:34159289..34160566, Cluster 5
taatgttgaggcctgtaactaaacctatctgatcaagtttctattaagtatgtcaacaaagatttgactgtgcatagaatgaggttcaagaatcgtgaatcatctgcttcagaatctacaaagggtgacggtacagtagatcaagaaaagactagctctgatggtatcgatgaaattgctgaatatatgaaatctagataactttcttgctgtgaggctacatggaggctgttcgggtttgagtttcatggtaaattttctctgcggagtgtcttttcgtgcatctaccaggattgaactttgttatagtgcaagaggaaactgatctgcagagtgttgtcaatgatcagaggcaattgtaagaatgcaatgaatcttaaggattttaagaatgtactgtgaaagacattaatggtcagacatgcagttaacacctgaaatgtcaaatatgacagttatttattaccagaggatgtttaatcatttgagtgtgtgctttgacatttgtgctgatttaataaaggggttaaagccaagcgaagaggtgtcagctctcatattgttttccctgacaagatcgtacagatgatattcaagccccgactgtccgactacctacttgtatagtcgatgtcacaggaattccctgtggacgtgctacggcatcaattacatcaggtccgttgtccttggcttccttgttggtgcaaatgtaccgtctgaaggtagacatttatcgtgtacaatgcattcactgtcaagagtataatctatactatctggatacttatataatcgggattcaaacggggcctgatgagaactttgaatcaccttatctgtgccttgttcttgtgcaaccacgtctagactctagagtgtcatgcaataattgccaagatatcaaatgtcgtgtagtacaagtttcagaaaaataaagaacctttcaagtcatacggtgtcacagtactagtagcagccactggaatgtgacggcgatgaccgctggttcataacttcactacggccacaggtacagaactcgcaaaagtcttcaggtcatgctggaacagtggaaagcacgtaacgtcatgggatttgcctccgtcatgtaatattatgcattctagttttttttaaacaaatactcaaatataagggattccaaaggacaaaaaaaaaacggttttgcatgaactacttctcatttatcaaccaatttctgttaatcatgttgacagtagcatctaaatactgcatccgtctggccgttctcac

SEQ ID NO: 847 - DNA, 1035 bp, Zea mays
  misc_feature (1)..(100): optimal_loci_7374_G1, chr1:38211834..38212868, Cluster 5
ataaacttatagcaaaacgtcgagaattatacctggggacggtgatcgatgggtacccgatacacagcctgtccaggtcctactcccagatcttcgtggctgcttaggggggatgaacctgaggacttgtcaagggataaagaaagcagcgtgtgaatcaaatatattatcgtggaaggaaacgggtatgttgacgacaggctcagttttcaaccagtacagattctccagaagacattctgccgaagctgaattccctccgtcgctgcattctgcaccgtgtcacggaagagtggggggaaatgctttcacgacaatcgacgcgactgagtacaatccttgcatatcttgcacgtcatccctcaagaacttggaccaaaagttaaagttaattccacgattcgttctgagaaaaaaaaaagttcggggcggggagaaaggcactcgttggtgttgcttccttcggaggtcatcgattcccgccggctgccggcggagccgcggaggtgggaattccaattcccgaccgaaagatccatgccgatgggcggcgacggtgactgatgcgttcgcggcggcccgagtggcattatcgctcaccatcagctagacggtgaccgcgaccgcaacatcggctgctgctgcttctgtgtagttctgttcagtgtttcaacacaaggatctcagtcccgtcacattttttccttttcatttggtgtgtgaactgggccgcatgagggtcgctctcggctctcacatgggggcaccccaccccagcaatggttccattccacgtgcactcgtgaatggcttgcgacggcttcgggcgagactagcagcagggacggacccgtaaatttagaggctatgtactaaaattcaaaagaggtcatattttatagaaaaaatataatcagaactacattgtaacagaattcttatattctgaattgcaaaagttgtgtttgaagagcagcaagctagctgctaattgagttcagcttagatggtgtaatgttagtttgctcattgatg

SEQ ID NO: 848 - DNA, 1225 bp, Zea mays
  misc_feature (1)..(100): optimal_loci_7392_G1, chr1:38327413..38328637, Cluster 5
cttatggacaaaagagataaaacaggttgtgaaatgaatagaggtaatttggcctatctatatatatggtgtaagcaataaaagaatgcaaaatatagatggtctgttattttctgaattaatttggtaaaaccggggctattctaagaattgattgaaaacggatgctattttctgaatgtcttcgcaaaccggtgttattttgtacattcttccaagctatcgcctatcggtagtcttggacaatccggtgacacatttattaccatctagtgactgacggatgctaccggcaaacgcaaggccccgtgccatctccatcgtttgtgctagttcaacgatgcgagcgaaagcgaccgtccgcgatgatgcaatcctatattcctatcctgtttggccttcctccggaaggcttccccgtttcggttcgcggacgcgcagcctttccggtgccgcgagtacgcggaggcgcccgcgccgatgcccgccctgcgccagtgcatccagccagccagccatgtgggcgtgccgcccgtggtggcctgcctggtggaaagtgctcccgcgcgtagcctttcggcgaaagccgtattaccccaccccgtctgcctctgtcgcttcggtccttcggagcctggacgccgtcgcccgccggcacgccaaccgcttggaaagcgtacgagtcttcctcgcgcccacggcggcacgcacgtctggcggggccgtgcgggttctgccaaactaccacttgtcctagattgcttgctcgtctcgtcggactcaactcgtcacctgggcgagcatgacataaactcctgtcagtcctgcatatttttcatcctatatattttctagtatgttttattgtatcccataaaagatacttccccgcatcagggttcacaatttcgtttgtgatcatccgaatttggttttgtcgacaaaaatttgacttctacattttgaattcgaaatctatttgaaaccggtgcgagatctgtttctcgtctactagcgaaaacgaaaaaatagtgaaatttggtgagcacgagaaagtaaattgtgctctgacataccagacgtctccaaccatcccctacacagttcctactgtaactcaattatttaacattttattagctttcaagattaattttttttataaaatatttgtatcaccgtaatacacattattattaggtaggaataattagtgcttcccata

SEQ ID NO: 849 - DNA, 1174 bp, Zea mays
  misc_feature (1)..(100): optimal_loci_76739_G1, chr2:151713398..151714571, Cluster 5
accattatgtattcatcagtcattcgtcgtcgtcaatccacagatgcacatgctacacggaattgggacacgacaggagtgctgacgatgtactacactagcgcgtacgtacgtgtggaaaacaggtgaaaaaggtgagcggaaaatctagcaggattcgatcgacgatgctgcaggagctagctagctagctagtcagttgtgtggtggtggtcgtcgtcgtcggcgtcgtcaatgctccgcccgccattatcatatggctcatttttgtcttaatctattatctacttaattgtgagtgttacgttggcacctgacgagtgcatccggccttacgtttgcatcatcctccaattaataattcctccaacacatatatgcatcacagcacgtgacacaactttgtccattgcagtacgtagtctatactccttccatatatacgtaattaatgcagttaattatgagagagagaaaacaagtcgccatcatcatcgctcgctcgctcgctcgctgctgcttctttactacaagtcgccatttcattacatccccaacctctggtcagagtcagacaagatttgttaaacctctgttacgtgtaacacgttttggtcaggttgcaatcttacttgtgtgtgtcagatacactaatattgtattgctcatataattctagtacgtacatggttgatggttgctgcgcgtctgtacatgttaattgtactgtgtgtaacctgaatagtgaataatacagtatattacagatcgatcgatgaaccctagctgatgctacacagctgctgctgatgactgaagagaaggagagagctcgatcgttagaaaggtttctttagctagttcgatcgtcctgccttcccggcatcttctaattagtgcctgcggctctgatgctgaatgtatgtgtaccatagcttaaccttagtggtgggctcacagtacctgctaccagctcaacgaccaacctatctatccatggagttgctgtcgaattccacgcgctatggtagtagtctggtctcgtcttgtccaccctcagtccatcacctacacccacacacggaggctacactggacagactccgctgcatacataaactccttgagagccgccatggacgatccagccccggcggcctactgatccggattg

SEQ ID NO: 850 - DNA, 1018 bp, Zea mays
  misc_feature (1)..(100): optimal_loci_77426_G1, chr2:155918255..155919272, Cluster 5
gggttgctcttattgaagtatcaggaaaggctgaccctaaagtttagcttttttgataggtctgaagtttagcttactggttgtgccttcaactcagctaatctcagagcctccgttgggaaccggggtgccagacgcggtggtggctgcggggggagcggtcgacggggccatcggcgccgacttcgccgagccggcagcccggcacatcatctccctcggtgacctacggtcttttgtgttgctactagatggccattgatttctggcgatctagcaggggcgtgcggttcatggcgttttgtcctaggccatcttgttttcacgacaatagaagtggttgtacctatacatcaaagaatgcatcaggtttatgtaccatgctgttgcaaagcaaatcagcaagacctgagctaatgaactttaggtcatagctacttagcattagccataaatcatcaagacttgaactaatcacgtactctcagaaattcttacaggttaaggttcataaaatatgtgacaatgcagaaacttaactaacattttttttattaatgatagggtatccctagacaataacaaggtggaaattaatttacttcaaccagggaaggtttaatgttaaatcccatttttattggtaggtggaaattatttcaagcagccttcctgtacatttgacaactacatgacaaggtggaaattaatttacttcaaacatcacgggtcattttataccagaaataactcattgtttgctctctggaaggactacttccaactgcactctcaccagtttctttcttctacatttttcttttcattcagaacagaatcgattgtcttcaaactccgctccaaactttcaactcctcctttgatgctctggtattcaaaagagtaatcactgattgtcaacacatcattgccactgaaggattcattttcaaatttcttgtgtttcatcaaatcaaacaatttggtgcaaagttggctaatctaagccttgcatctg

SEQ ID NO: 851 - DNA, 1094 bp, Zea mays
  misc_feature (1)..(100): optimal_loci_78701_G1, chr2:163553938..163555031, Cluster 5
gtttatgcttattttgtcccttgggccttatgtacctaagccctatgagtcgttgtattatggaaacatttttctccaataggaatgttgtcggctgtcgccggtgttgtcagtcttttgtactaagatttctatatttggttcatgagttactcatgtgctaatgatgtatcttgcacacagctagttattcttttgaccccacggattctaatataaacttgtgcaatatcttcatggaattgttacatacctaatgagctatggatagaatccatgtcttccatagtttaaaatttttccaaaccattgggttataatccacgatgagtttaaccgaataaaaaaactgagtaggcttggattattttgggatatgaattgtgacatggatttgattccaatccatgctaatctagagctggattagtgtaaatgaacaagagtgcaaaacaattgacaacaagcacaaaccgttaatgctgaagaaactaaaaaaaaggtttcgaatatggatgagccaaatctcccatcggagcagggagagttttcaccttcgaatacattaccggtggatgattcgccctacaaggctctgtgcaacccggtattaaagtttaccttttttatatagtatgtctgtgatttctgttaaatgcatggtccatttttgtaattcatgcactttgcttctgttgttttttttatgcggccaaacactgcaatcttccccaaaccctacagttacctgatgattattccttgggtatgttttagcatgtcacaacgctgtttacaatttgtagtatcatagtatattctaaatgttcagtatacactaaacacgacctggtgcagacattgttccaaattttgttcgggattaacccatctggccagaagtcgatcgcagagagtgatcgaaactggaaattctatgtgaaaacagttgccaatccattttatttgctctaaacgcgttggcctgtctgcattgttctaaagcacatcttcattattggtgctgaatacagttctgctcaagctgctagaagttggtctgtgatgatgagagatttaaaccaaacgaaaca

SEQ ID NO: 852 - DNA, 1138 bp, Zea mays
  misc_feature (1)..(100): optimal_loci_7937_G1, chr1:41226612..41227749, Cluster 5
caaaaaagaagaaaaaaaggagggaggtttccatctttgccatcagtggcggcgcctcctgcttcttcgttagtgaccacggtctccactgccattgcgctccatgttctcgttgtcgcacgcttctcatgtattttgcgtatttttaatgttacaatacacgcgcgcatgacgtgcacactatactctgtagttaccatatcaatgctggattatttaaaatcaaatcagccatatatgatatatttgaattctgaacagtcaaccaactatatcgatacaacaatatttctgaaattatcatttctttccaagggacaaaaactagcagtagtaaactaccataggaaggcttctactatatattaaagctcggagcaaatctgctcaaacacaatatccatgtcacctctttttcacgaactgtacaatcctttatcaacgacgagcaccagctgaacctttcctttcgtgcgctccgcactaaacgcatgtgtcctcctctaagcagagaaacagacgaagaagagaaaaaaaatccgctatccttaccttcgcaacacgttttgtcgagtcggtcagccgagctaggatgaaaaaaagaatgacctcaatgctaaaaactggtttgtagtttcagatgaaatagggtttgttctattgttattttttattcatatagtactagaacacaattagttggtcataatttctttcaatcggccacccccatcaataagatatatctgagtttgtcagttgatagcgttgcaatttttattacaggttatctatgacaaattgacaggaagaaactgtgaattcgggttgtgaccgtgtcttcgatcgaagaagttgaggcggttatctttcaaaaaaaaagaagttgaggcggttgctgagcaatttaatggctatgtgagttcacttcagctcttctagagctatgcacattcttttgctgtcatagtggaccattctcctgtttacttacaattgtaaacttagcaatactctatgaattatgtgatgttcatcactcatggcttcctaccagatcacacattgcataaatgaagttcaacgttaacggttagtcttcagggattcaaatagaacatttgtattctgtttcctt

SEQ ID NO: 853 - DNA, 1216 bp, Zea mays
  misc_feature (1)..(100): optimal_loci_8127_G1, chr1:42471692..42472907, Cluster 5
gctagactacgggaatcacgtgcgccatcaagatcaccgccgtatcctttgcctccgtgaggccaatattgccgcagactttttatgcaagtgcaagtgtattcatgataatccccttttgtaagtcaactttgtttattttgggcaaatggcattccaattacttctttcgtgtatggcacatgtacgtatgtgcttgtgttatgcaatctttgttttaaagtgtcgtgcttactgtacaagctattatatctggaaacagaattttcagcgtcaagctagtatacgtggaaacggttacttcagcgtgcaaaaaacttcatgccgggacaacaattacaaataaaacacttctagtcggaatgcatatttataactaaaaaatttctaaaattaatattattttacacacgtttcacttctgaaaataaaaattataaataaatgaaaaagactataccccgcatgatttattttaattagcatgtaatgaaaataaaacaaataaaaactaaagaaatggagaaaatgaagtttgttaatactgtagttttaaatggccgaatttagaggatattgatggagactgaaaatatagatgacataatcttttaaagtgtgtgaaaaatacaaagaatattttttatgggatggaatttggggatgttgctgcaaataacctgaaacgtatgaacattgaacaatgcacttgggctactgtgaatgcgcggcgtgatccgcacagcctggtggagagcagcaggcctccgcgttttccagagccgcgccggcatgcggatgcgagtctctctttgtcggatgctcggagccttcaacggtcccacttggtgtaagcaagcgtgccattcggtgcagagtggcagagtgcggtcgcaatgggcgcggacgcacgactcgaccgatcaggcgatcaccgaccgactgctgattggaaacgacccatcacacaactccataccatacgtagtagacaggtactctgcgataggcttttgtctgctcggcgcgcccacttgcgaggtcccgtggtggcgcacaggaacctaagcagcatctggttgcgcgtatgccctgagccctgttccgagtcagctcttggccagccgctcgggcttggtacttggtggtcgggtactttggttgatggcgctagtcttgaggctagctgcagcggcacccgccacactcgctctct

SEQ ID NO: 854 - DNA, 1249 bp, Zea mays
  misc_feature (1)..(100): optimal_loci_82590_G1, chr2:185008893..185010141, Cluster 5
tggagctagctcagggatgcgttgttgcatttacagaattcatttggcaatgtatactgagaaaagtaacttcaaaaagcagttgctgttatccttggttgcttctcagctattatattgttggctgaagctactttacttccaagtgttgatctatctctcttttttattcttatataagttgtaggaaaacaagatgttttagtttaggtgcggaactgaacactttatgtacttccaactgattttctgcctctccagtttatggaaaaagctttattgcttgtgagtttgactactctgcaatactatattgtctcagcaatacttacggtcttgtgttagtgatagcattagataatttgtttgcataggacacaacagttatgttcatctatcacctactcattaattaaatttcaaacaaaaaacatttagtttttatatatgtgcctatagttactaggcgacacttggattatgtaaaatgagtgacatccttgaactcctcactattgtcataccaggaaaaaacagtcttttgtttcattctgttataaacttcataattttagccaaaactattgtcttcaaattattattgggcgcccgaagggcgtctaatgttctagtacatataattatatatacgtacttctctagttctacaatggaacagaaccgtcacctcctgcgattgctgtgacagcagctaccgtcaagcttctcgatcgctactgcgcatcaactgggaaaaaggagggaagtttctgtatacttgagggcctaatctaatctaacgcagcaagatcatacatacatgtctgaagcgcctttgagcgagagatacgtgttggtatccttttccactttcgccaagacccaagcaataatgataccccgcacggtagaaagccgccgccgtcgtcgccgctttttccatggacagccagacaggaggggcaagtcaattctcctatcattttccacgctcgctttaattttttttcttctttcctcaagaaaattaagaagcgccaaggacctggggtccgggactcctttttcatgtgcacgcaacatacgctacactaacactaataacactagtgcactttctatatatcttgctgatcgactacaacctgtaattgaaccagatacaagaagtgaagccctgcatgcccccaggctttttttttttggccccctgctcatgcattccagccattcacccttggcagtataa

SEQ ID NO: 855 - DNA, 1035 bp, Zea mays
  misc_feature (1)..(100): optimal_loci_82774_G1, chr2:185870792..185871826, Cluster 5
acgactggagataggctcaagattttcggcatgttgcagaactatctactccttgtcgtctgatagtatttcggtggcatatctgacggattcaaccctcactcgtcttcggagcttgatgattcccagtagcaccccctttctcgtaggactagcaacgatttcgttgcttggctggactagtcaggtgatccccacaccacacgcacaccgacctgtcgtggagggaaaagtgtctcccgggattcctacttccacctaggaggattgacactttgacagctactgagacctgttctccttcgaggaaacagggcaagcagctctcgcccggtcaactcgccctcgcggcgagggcttgactctcttgccgcactccagccgcccacgctcccgtggccctggttcgttcgttcgttcgttccatgccgccctcgtttgttgacttgccgccgctaataatgatgggattctggatggtctccaactgccatatctgacggcgttttttctttctttctacatgcttggatttttctgtggaatttagatttatgtctacaatttcgaatggagaggcccaaactaacgagatggattaagaggcagaggcctgccagaaatagaatgtctgcacggaagtcgggagatccagactcaagaaaatgctgggccgtggcatgaacacgatctggctggctactttattatttgtttatgatgggacgcactgcagggaggggatagactcctatgttttgggaccaacgagcacttgcgccgttaaaaggtctatgctttctatgaactaatttatagtcacttcattctactatattttagtctctaaattatcaaatactgatcagatatattagccaactccataaacaacagtcaggtcctacaaacctattgggacacatgtttataccattttctttaaacttaattagtcaaattaaaaaaaaagaaaatgatttagctccaaattactagaagtgctttattttttgaaaaggagggagagtacac

SEQ ID NO: 856 - DNA, 1085 bp, Zea mays
  misc_feature (1)..(100): optimal_loci_82929_G1, chr2:186794652..186795736, Cluster 5
ctagtagctaacgcgcgccctgcgcgcgagaataatttatttttttggaagtgtttgacagcaagatagttgggttttctagtttacaaataattatcatgaacaattatagtgagttgtgatttacaaaataaaataacaatcttagaacttgaggacttggattgtgaacacggataggaacagatgtgattctaactcccaagtttatagatctgacaaagtcctaagacaaagtcctaagacaaccatatgcacatttttacctgcatcatttttaatatcatttttagacatcagtcgactacaatgaacattatttattttatgtctgcatgcagacaacatttaacagggacataccttttttattgtggccactgcttgtcaacaacgattgcatttctattgccataaattttgtcaaaatctgtaaatgttgcttctattccaccaagttcaggaatcccctaaggccaaaatgactcggtccaatcattaacaggaccaacattaataaaatcgaggccctgcgggcgctgaattacctgaggctgcaccttagaggactggccgaggaaagcgtcggtgagggagttgagggggttgcaccacgaggccctgactgaggcttagttgttcaggcccatgacgaggtgctgcagcgccatctccgccatcgaacggacgtgcgttctctgacgccggaggtgagacgctatgtctgccgctttggtcgacggcgatgtgggagaggatagaagagggtgagctggagccgtgcgaacaaaaacacccaagtagaggaagcgcgttggaagacgatggccggcgcacaacgaggaggcgctcaagaggactcaaagcgtcgccgacattgtggtctcctctcctcctttttttcccttttcccaagggtccttcacgtgaagtctcgaaagctcaagcgtctgatagctgaagcagccggcggtcggatgcatgagagatgcgcgtggctgctgagcagcgatcggacggtgcagttttttctgatgacgtggcacaacgtggcgagctccttgctcccgcggttaatatataga

SEQ ID NO: 857 - DNA, 1188 bp, Zea mays
  misc_feature (1)..(100): optimal_loci_83027_G1, chr2:187353960..187355147, Cluster 5
cttgcgacatgtctagaccttttctcccccacgatctggctagcatagcaccctaggtgaacaccatggatatcgttgacgtccaattgaatattagtaagcacgctgcacgccctagatgaaatattgttaacgtcaaactgaatcgcatattagtaagtgatagcatggtcaatgttgcatatggcctatcacacgcaacaagcaactagataaaatacatatatgactgagattgttgcatgactgagattgttgcatggttagcaagccacctagaatacatatatgcatcttgcagagagatgctacgacgaacagtaagagatacaaacaaacaaaaagagttaggcaaaaggagtagatgaaagagtcaattagatgttggacctctcgatcaccatgatcctcttgtttatttatacatagagtgtgtggcattgtccaggatgtactactactctcttagttttccacgtaacaaacagaggcgtcagagactggttgttggtaaaaccaaaagtcgctgatagcatgcttcgagtgtcaacagtacactcaacacaacagctgcgctacctcccccggcacggccttagacaaggccacaacgaactcctgcagctgaggcctgaggctgagcactgcccggccgtcgctcgtcggtcgacctgcagtcgttcactgccccaccgaccgacaggtggagccacgcatgcacatcttccgtgaagtgtcggcccggccatggtccaggtgtacgtattgaagaaggtcacggcatctgcgggaggcaatcagcgaccgaccggagcccgtaccgacgttgacgtgtgtctcgttggggtcagttctcgttgtctgggacggtcaagggggccggccgtttgggtgtagtacgtataggccaggagtccaggacgcgactggtccgtccgcccgatgacgaacacggagttgggtgaccacgctagctggctactccagcgtctcatgatggggttttctgcgagacgcgcggctccgccagaatggtccatggcgacgggcgacggcacgcggtggtggagatccgagctctcggaatggccgctcttgtcccttaaccattcgaaggacgcttctgcccttttgtcggggcgtctgttatcgatggacggggacgtcacgggcagtgttaacggtcct

SEQ ID NO: 858 - DNA, 1122 bp, Zea mays
  misc_feature (1)..(100): optimal_loci_83168_G1, chr2:188375623..188376744, Cluster 5
tcaacctgtacgttgagagaagtaaaccaaacaatacgcactttgagactccgcgggtgcagctgcagcctcccgcatgtcaaccaaacaggtacacggattcttcctcgggattcataatcaccaagtcaaccctgatgaggaggaaaaatgttggccgatcaaatcacactaagttggatttttcttgcatagtaatcttattgtgtgttactgaacaaattccatatactcttcttgtgttagtttaatgctcccgcatttaaaacgagcagccactgccacacaaagacagtcactggttctggcagtggggcacaccgaagattcgaacaccaagaaataaacggaaaaaagaaaaggatcgtcaaaatggcacgcaggtccaatccagcccgtcgcgtccgaccacggctgaccgcgagtgcggacggtgcgcctggctgccgcctgggacttgacgggcgcacgccccgctctcgtactacgcagtctacgctacggcggtgcgaggccggatttgccatcgctggggtcgccgggcggcaaatcgatgccggccacggaggagcaccggccacctgcgcgcgcggcgcccgccaaccgcggcgcgaaacgtcgcccccaccggggccgatggcgacgcgggccgtcgcgtcctgcgtctcgcccgcaccgcacgcctttcgtttcgtttcgtttcgtttccacgaatcggcggcgacccgaccggagcggagggcagcgggccgtggcaaccggcggtcgcctcgctatcgatagcgggcgcgcacggggctgggaggtcgacgtcgacccactgatcgatgcatgtcgagtggaggctctccgtctccgtgtcgcacggtcactccaccatgcacaaaagataatttggcgtacgggcacccaagtttgggctctcggattcgttgtttttactgcactcggaatggacgatggcggctgcagtgatgagagcgctccgtagcttcgtcgtctgtcagataactttcttccgtacgaagtagatgaaaattagtctatgtcaataaaaatcaactagttttattgatcagttagctaattttcgtcagctagctatagccgacaaaaaaaagc

SEQ ID NO: 859 - DNA, 1154 bp, Zea mays
  misc_feature (1)..(100): optimal_loci_83171_G1, chr2:188393067..188394220, Cluster 5
gaagattagtcaaacttatataaaacatgcccgccaccgtgctatgtagttgtagaaatactcttcacgatgtcaattatagtcctaccgttatcaattgtactcttaacactgtctcttctgttcatcacgtaactccattgcttcttgaatctgaagcaactcgtcttatgtgttgcttcatagactactagctccagaggtaataaggacactcctttttaagctctgacttgcctataccgaataactcttttaaacatagagtacctataacacaaacaatttagaacatcaattccgttgtactttcaattttttcacttccacaagtcatagctactctatgttagaaggatcaattgcatggtagaaggatcaattgcaatcctctccaaattgattaacaattttaccaccatatagtgtatacagaataaataactaagataacaatgaaatttgatacgacaaatacaaagtacaaacaactcacaagatgatttgcacacgactgactacatagctactctatgtttaaagagaatatttgaagagtctattctatgatgtctagtaatataaacctcgatgtcgctcgacactactccgatagcaactttatgatagacaagttatatgtgatagttgttggaaatatatgatataatacaatttatgatatatttcgcattgcatattggtcgtcgacaccataattgtgcttaggatcattgccacagtttcttctatgcttcttagacatatcatataacacttttgaaacctaaagtttgcaaggagcatggtaagccacttcatggttcaccatccatagaattgacatctacacatatacattctcaagtgcggagggccaaatattgcttaggcaatccttgatctagaccaagaagatatcaatgataaaaaaactcatatccctaacactatttctagatggttggacgcactcctcgatgctgactcctccctcgctcgccacgctacgctctaccactgcctctctgcactccacattgccaccgcgaggtccctcttcctctcttctttgcttcgctcctcattaaccacctcgctcacctatctcgatcttcctactggtgttgttattgatcttggatcatggggtg

SEQ ID NO: 860 - DNA, 1111 bp, Zea mays
  misc_feature (1)..(100): optimal_loci_8601_G1, chr1:45124546..45125656, Cluster 5
gccgacggacctcttcataacagaggtgagctagagactaatagtctagaactctcactagaaccaaaagggaagagacgggcaaaggtggtcaaagtgctcagtagatatgtgagcttataatcttcatctcagggtcaatcaatccaatgaatacaaaaagggcataagatattgtatatcttgtggctcaaacctcgagaggcgtagctaggatttttcttggagggaggaggatgggggcaaaccgatatataactatagttataatatcactaaataaaactagtcataacaaatgatatatgtatacactaaggccttgttcgtttacgccatctcaaaccacatgggacatctcggccggggtacaatctttgttcatagagaaacacatgctcgtgattttatcttgacatttccttaccacacggcccgagaaataacccacaagtctaacaacatggaagaaatccccgtctcacaaagccagcagcacacgagatgacacaaatatataatgatgttgtggcagcgagttaaacccacaaggggattgagtgataacgagtgtatggatatcccatgtggtttgagatggagtaaacgaacaaggcatacataataaattttagcttattataaactaaccccttttattttcaccacatatataaaaaaattctttgtagttagggggcacgaccctctagcccccttgcctacatcactgcaaacttctataaatcactcacgtgttaggccccctttggtagggctccttcaatagctccttcaatggcttcttgaaaaaatctatcaaaggagatgctctttgatgggttttttctagagaagagtgaggagctccttaaacaaacagcagcagtcgggagccagaaaaaggagcttctatcggctctgttcctatatttttctcttcgtcgatgctgcatcgtaggagaagctacaaaagaaattatatttctaaccaaactgggtgctctttctagagctcttcctaaaaataaagcggaagttgttttcttagaggagccatagccggagatgaaactccctaccaaatggaccttagtaactaggctacacc

SEQ ID NO: 861 - DNA, 1367 bp, Zea mays
  misc_feature (1)..(100): optimal_loci_86702_G1, chr2:209228081..209229447, Cluster 5
gatttacggggggagttgcagtgcaggaagcgagcggggagggagggactaccggactagggagggaaggagaggggtggtctggtttggcgtggcccctgggccctggctgtggctgcttcgctctggccttttgggtgctcacgtgaacctccgttgccagagtccggtctcctctgtgatggctgatgactgtggcagtagcagcagcatggatgcctcgctgtcagtgtggggggccagtgacagccccttgtcacccatggtcctggctgggatagacggacctcgagacaaggctgctcttttccttttgtactgtgtgctctggtcctctggacttttcatgatagggacgagagcacagtacttttttccgtgcgttagttttgacggtaatcccaaaaccagaactgaaccgtgagattgtattttgtacagtgtttcctactgtgagcctgagccagccagaaactgatgtgccataacaaccacttgcaatactggtccacaagcagagcagttacagtgagccatagctccaacaattactgctatctatataggtgtccagcaaatcttccaatacgagtacaactgcacaggtagcatcgaggcttcttttatgactcaagcgagtactatacgatcttttttgtaacaaaagttgtactcgtgcagcctaccgtgctcagtgaaatatacttacttgattatggtaacttgttgctgatgacatactcctatacaccgcataatgtcagtgagtcctagcctcttattcttcttcttgtaaaaaaaatgacgtacgcaaagcgatgctcaagcaaaatgtcaagaacccatgattcaaacggtaataatgggctaaagtcatcataagaaaccagggcaataaaataagaataatacattcaactttggggaacaaaaaaaaacacacaaaaggcgcaatatatgagcccgtgaccatgcatatggatcactcattttgcttgccagcccttttggacggtcatgatgccgtcgtcaggaaagaacagttgaccccaaacttaagcaaggaatcacacaagcttgtcctgttgtttccatgtaatccgtccatagctgcgtgcttttctgggtcctcgataacaaactattctttattggcattcagtgccacactgctatgtgattcggatttcggaccttggtttagcgcgacgcatgagacagcacagcggagagtggcgtggccttggagacgcaggcctcgcctcacctactagtcagtgtttagtcgtgttgtgcttagtggcggacctaggatttttatgtagggtgtgccgtaacaaaattttcatttaaaattgtatctaatg

SEQ ID NO: 862 - DNA, 1016 bp, Zea mays
  misc_feature (1)..(100): optimal_loci_87838_G1, chr2:215994965..215995980, Cluster 5
aaatcgcattgatcgagatcgacgacgatgactcacataaaatataaactatccgcgtgcaagcatgtgcgggtgttcaaacgcgcgcgaacagatggaattatatatcgaaaggagtgacggttaaacgagctaggaggctagagaggagtatccctttcatgcatgtctctctagagccatctcttagagcctaaatcgctggcttttgtttgattttttgtggggtgtgaggaggtcaaaaaagatggatgcatggagagggagccaacccggaaaggatccaaaaatgtagcgtcaatcgacgacgacccaacccaatgttgagtgtgtggcatgtgaggtgattcatatatgcatgcgaaaggacgctaagctagctagctacacgtatggtacacggattagctatagtgggatatatgccacctttttacccacctagctaatacaataattttgcctcgggctaggtaataattaataaacttcattcatcaattatgatatcttcgattcttgtatgtggcaatgcaaatgaaggctaattcatcaatgcaagtctctctttggaacttgtttcttcttcttcctgtttattacttctacatgtatatgtatatatagggcccctatttatatatgatgtttttctttgaatataaattattccatatgtactaggttcctgttgcttattaccagatggagatgacgaactattagctagctagcgccatatatgtgttggaatataatataagtaaattatctacatcttcctatcaatttaaactgttaggttaaaccagttggtgcatgtaacttactatggtatcaaagccagaggtatcctgattagcacaattaaaataaaataattgttgttcgctcatattttacgtctgagacgtacaaaagaaaggctcgatcgacgtaaggttgaaatataatataagtaaactgtccacctcttcctattagattgagcttttatatattgaactagttgatgc

SEQ ID NO: 863 - DNA, 1143 bp, Zea mays
  misc_feature (1)..(100): optimal_loci_88032_G1, chr2:217125335..217126477, Cluster 5
aacgatggggcacgaaatcgatgtgcggtgcgtgcgcgggcatcgcgcacggcgacggcgctggaatcatgtcgagcggggcagggggcaccaggggtgtggacgccttcggtagagtcttaacatgagtagtatagataattaggaaccatccatccctgcatagcaaataatatgcagtagaagattatgacttgaaaaggtgcaacacaggtaatgggcagttagcaataagatgtgttgttagagtaaaatagagtgggtaatcaatcctgcttcattatatccaaactctataaaatggttgcataacttaatgcacataccattacacaaaaaggccatgcttcatttctagttttatacatgtcttgaattgttagcctatcaatatgaattttgaaattcctttattaggctgcaggagtcaacttttttcccttggtcctattggatgatgcaagcagtttaactaccatcttgctacattttagatgtgttttgcttcctaaccttttgtgagtatggattactttctatttttgtttttcaacatgctctgtctgtagtttgtctccttttcaaactatgatattccttctattatcactcatgcagtcatgctacagttaggcttgtttttaaatagcaaagagacatgcaacactcaaactttatgagccaaagttttttctgcaagaaaaaaactgcaaacgtttaatcattaacccagaatagctattgatgcagtaatctagtagaaagaaagcacggagttcggtagaagtataataggaagcagtgaaaaaagaatgatatgcaggtgtgtttgagaaaaaactaaacccatgttttcatttggtaataggccttgtagtggaaaaggaagtaaacaacataaccatctttcatgtatggatcctcccttagacttgtccctagctaggaatatggctttgcgtgatgtgtataaagaagaggattaagttcggtgtctattcaatcagtgagggaactgaattttatgggatgtcaatgaaggaaattatatcatataaaatgtacgacaatctgtctttggttgttgtacattcatttattaattttatcgcttctacattttaggagcagagaacatcaagc

SEQ ID NO: 864 - DNA, 1003 bp, Zea mays
  misc_feature (1)..(100): optimal_loci_89294_G1, chr2:223265226..223266228, Cluster 5
ctagatgttacaatgttatttagaagccacctaaccttagttttaagagaactaaattaaactactagattaagctattatttcaattatggtgaacatggtcacaaaccatattatttcaacattaatagaaactctattatttcttagtgaataagcaatatgaatatcacacatgaacatatgtatcttgactaaaaatctaaatcttaattttgactaagaaatgacggtctacttttcctttcaatttctcatattagaaaaaaatacgcttaagcaatcacaacaaacataacttacattgatttgcggatatatgaacattgtcacaaaaaggtattttaacatgctaacacatatatacaaaaccggtatgacaaatatcgtttcatttgagctcaaatacgtacgtaaaatagagaagttgatgtaggagacctaaacaaaattaaatgtagacaccaggggtagcaagaaagaacatcgtggactagattgaaaaatcatcatcttcaaccttggtcctctctgttttcttgtgcagggggacggtgggtggtcggccgcgagggggtcggggtcaggctctggcgatgggggtcgatggggacggcgctctagcggcggctgacgacgaacagaaggccgacgtcgagcatcgcggagcaagggagttaggggcgcgggacgagcatggggtggctgagaacagaatccatgggctcggtgtcaggttttatagagaagagaagaagggaggggtgccgggaggagagaaatggccagtggtgccattaatgccatcaatggcatcggtggttacttagagcagagtggggggagaggagagggaaggggcggccgtttccgtgctccactcgcggagaaggcgagcaggcggggaggaaggcggccgggtggtgcagtgcggacgcgaccagtcgggcggcggcgcggcgcagcgcccatgcgtgagcgcgcgctcgaggcgatgcggcgc

SEQ ID NO: 865 - DNA, 1263 bp, Zea mays
  misc_feature (1)..(100): optimal_loci_89515_G1, chr2:224158234..224159496, Cluster 5
atgcctggttacaattggtcgatcctcataatggtggcgttgttcacctatttatagggttaggctagtatatattctgttatgaaattatagaaatgtccttcctactctacatcaatccttcctaactagagggatacaattatgtctttctacaaaagagatgtggcatacacatcttttcttttccctaaccttgttgttctactctcttttctaaaggtagcttcgcatactctgagacccatccttccttcagctacacctcttagcttcatcatattcaaactgttctccacctactttggctttttgatgaccaacttcgtctcgaactaaagcttcttcctcgtacttgaatcctttttttttgaacaattgttttcttaatatggacatttggccagagacctctccatcacttgagaagacatgagaatatgctcttggtgatattttttagaaagcatcgaacaagtatagtggtgcaccagacatgtacgccagacacgagtaaagctcattcgaactacacaattttcagtgaagcactatgaagtctagtgtgcaccaaatatggtgcattaaatttgtctagtgaagtagatgacccattatacatgatcagagagtatgtcaaacacatacttaagctctatagtacatcggacgtgtctagtgtggcaccaaataccatatcagataagacacccagagagcatgtcaaaggaagattttagctcaacacacaccataatatctaatcccatgtcgaatgactgcactggatgcctaacaagtgcaatgaatagtttataaatgttgggaaggcattaggtatgtcgagtgtaggatgcaaggtgcaccaaacgtgtttgttgccccgatttcagcccttcaagaggtaacgattggaatatgatatgggattacaaatagattcattggtcggccttagttggcatcccttcactccttacatttgagaacacctcttagggatagagaaacatacaaatatcacttgcatctggcggcaccttgcgacacttgcggaacaaattggattggttctactcttgttacccttggtgattgtcattacctagacagtctagaattcgtgggatcatgggaggccgttggagattatagtcggttatgatcatcattgtgtgtggggggcttgtgttcatctcccatgagaggttcccaaagagcaattatagtgaaatcgtgacttgttggagtacatgtttagtg

SEQ ID NO: 866 - DNA, 1319 bp, Zea mays
  misc_feature (1)..(100): optimal_loci_89825_G1, chr2:225685376..225686694, Cluster 5
gcgatgttcgctttggattgaagttgtttagattgttggggctttaatccataaagacaaaaacaatatagaaatagtgaaagccgatacaaattaaaattaagcaaacaagcaaatttagtcagtgccactaaatagtacatgagttcatgttttcctactacttttactatgcttcaagggcccgaatttctaaaaaaaaatcagatttttttcccgcacctattgtaaccaaagatcttaacctgagacgtaataattcacgcatttcagactttttgtaacacataagtattattaacattatcttaaatcaaataaaaccagttcaagatttatattgcgattgtaacccaaaatgagttacagaactcaactagtagtagagtctagttacaagaacaacaatccattgtcgtctagtccggttaggatatctggctttcacccagacgacccgggttcaaatcccggcaatggaatctttttttttatcatcggacaattttctgccgcgccccaatttttccggtctccacctgtcttaatcctgaccgtccaagtccaatcacagatcggacgggccatgctgccccgctttaagcaatgctatagtactgtgcagtctgcagctgatctattctataagccactgtactattgacaaaatgacaatgagctgtatggctcgatacaacgagctttgtattctagtgtctggaacttgaatgcgtgtattttttgtttgtttgtttgttaatatttctcacaatatgatctaatgaacatgtatatatgtatgctggttaatataccacgtcatccttatctcgatttcacattattaagtgctgatttggtggtaagggatcccaaggggattcatgggggaggaatccccttgcaattcaattttgaataacaaggggattcctccccccatggatccccttgggatcccttagcaccaaatcaggcctaaaggttgttgtgccactcattattaaagcacaactctgcactcaacacgtatgtacgttacatcccttcagcggaaacatggtcgagtgagcaaagcaacaagttcccggggccgtgctgctggatgtaggagacgaggacgatgtcctcctccggcgtccacggccctttcttgacgccggcgccgccgttatcgcagctagcacgatggcctccccatgcctgctgctgcgcacgtctgctaccgcggaagatgcacctgacaaccagctagctacgcctatagctagtcgatctagctcggctagctagataatagtagactaggtgcatgcccg

SEQ ID NO: 867 - DNA, 1132 bp, Zea mays
  misc_feature (1)..(100): optimal_loci_90930_G1, chr2:230563505..230564636, Cluster 5
ttttagtagtactgttagctagcgcgcggcaagagttgccagcgttccttgatatgcatcaatctaagattcctcaaatattaaaataatgtcagttttatttattttgaatgttgtcatgttattgaattgaatatatatatcatccttagtggtaatataaccagtaagatgactatatttagttcatccctcgtcatgaaacaaacaagagatgatgtagctccaacccactttaactcagtaatcaaataagaaactatgttcaacctgtcaatgaaactaaacaaaaaacaggttcaacccaacccagaaaaatgggccggctccggccccgacccaggtcgttccgaaaccaaatatatacttccattgcccgcttctgcatagcatacttgctaataataccattaccatggctcctcgacgacaagtgctcactggatgagcagaaactaaaaccctgactcgatcgatcaagacccgggagcggactggagtattgcagctggaaaaacaaaaacgacaagagaacggatcatacatgtcctgatctatcatcaatcaatgagcatccagtgcgggctcgggcaacccgtgcatgccggcggctcgcccagatggatgtcgtccaggaaatccaccgaccacaggttgttgggaagcaggcgccccccgccgacgagaacgtcgcccctccagatctcgacgccctgtaaattctgcctgatctcgcagccgcggcgaacgaggaaccctgcagagatgaggttcatgcatgcgttgtcgaagcaccttataccagaaaggttgactctgcccacggcgcgtccgcacaaggtggaccacatggcctcgccattggcgacagtggcgatgactgtgtcttcagagtgatgtaatccctggagcatgttggggttgcccgtcacgcaatggctggcgccagagtccagcacccactcatcatcagtaatgctcgtctgactagttgctgcaacccacggactggcagagagagagaaagagaagttctgtcagatcatgcaggcacgcagctgattatatataataaactaacgatcgagtcgccggagcgagcacaaaaatgattcctccgtaatgctctttg

SEQ ID NO: 868 - DNA, 1014 bp, Zea mays
  misc_feature (1)..(100): optimal_loci_91374_G1, chr2:232732136..232733149, Cluster 5
aataaaccagtacaaatttaaatttagtttggattatacaaacccatcgagttttactggttttcaccgatttactggcactaaaacattgccggtgggtaacggattttttttttacctaaaacggttttgtaaaccccggtgggaagcggacgtccgggttattctgaaactcgtcgaatgtgtggccagagcatgtcaatgacaattgagtacacactaaaatatatgtcacctcctgaaatatcataaatactctgtactttattaggctgccctatgtctagatataaataaacggaagctttataaaaacctttttttttccaaaggaacaaagtagattaagagatttcgattaatcatttggttttggggctttcccaaacgaacaaacagacggccgagtagggctgggtggtacgtcggggcccgtggtccggcagtgcgattggcaaatttgaccgtgcctgtagtcttcaggcctactcggcttcatcttcaataacatagccccaaagtgtatctggttatgtcagcaacactagcagcggctagacggaacctgcatggcgaaaggcaccaaagcagatcactgcacgtgacgtacgcgcctcacaacgtggacatggcaatggcaacggcgaagcaaccggaccaatacatggatatggtaaacggcagggcgacagctccacgccgtgctgagcgcaacacacagtgacagtgacacagcgcagtctgcacgcaggcagcaaaggaagcctaaggcacaggattgcggcagggcagaaataaaattacatacctcctaaaatataatttgttttaaattaaacatgtattcattaattgaactacgaatatacagtttatatgcagtctatctcatctgttttaaattaaacatctattttgacacagagggagtagcgaaagatgaacctcttacataaagttgaaattgtattgtaagactgtatccgatgggtaacataaaataaaggacgcaga

SEQ ID NO: 869 - DNA, 1082 bp, Zea mays
  misc_feature (1)..(100): optimal_loci_91447_G1, chr2:233096406..233097487, Cluster 5
aatatctagtaatggctacatgttgcatgctttacaaggtgaggacctaccgtcacatgagagtggtgtctttctttctactatgaacgacacagggtgggtcaagatagttcttaatgatatgttggttgttagttcgatgttggtagtttgctacttaccatgatctggagatggttcaaaatgataggataaagacataaagtggatgttattccttttatgaggatataacagcattacgatttgctatcaaatctcttgtaagttttagctagtgatattgttccgacgagtatctgcagagatgcaacagtatagtttgaggaaatgcagtatgttccaattgctttttaccaaaatcacgccatttttttaattccttgagtcaactatttccttaagccaattcaattgactagcattactctctttagagctagtttggtgaccaaagaatcatggattatgagaggatccatggaaagaaatctccttgctatgaaaaagaggattcctcccccatagatcctctcgtgatctttagtcaccaaatctacccgtaagaagattattcttatccttttgtatttacggtgctgagttatattagaggggttggagaatgtagcttggtatgttaggctatgactgcagaaacaaggatttaagactgttttggtcattagatggcaaagaaaggtgttgtgatgctcacctctcagtacagaagtggtggttggatggattagttttgccatcttagcatagcggttctgaaggctgtaatgcaatatgaatgattttgacatggcttcattgccttttttggcagtgtgtggtgattgccgacttgccgtagtaatatactaggtaggtgtccgtgcgttgcgatgtgagtaaaaaatttgtatgaaacatagaaacagaatgacgatatggaggagacgaatttgatgatgacgatatgtaggagacgaatttgttgcgagcagcaagaagagtttacttgccaatcttgataatatcagcagggcaaaggagcacgtcggggcttcaaccacggggtcgcgatgacaagc

SEQ ID NO: 870 - DNA, 1017 bp, Zea mays
  misc_feature (1)..(100): optimal_loci_92364_G1, chr3:1337774..1338790, Cluster 5
ctagaacgacgaagaacgtactagctagctagctagagctgctagtcatcaacctctagctagctatgctgttgcagtgacgatgaactgtcgtatgtttgattgtccggcgcattttactcaagggtcaacaaattagtgaggacgtcgggagcatgcatgcatggcagtggcaggtgaatatttggaagtgtgggaaggccggcgtggcgtctgcttgcgagctgactttagttgcgatcagcagagccctatctagctagctgattctaatcactctccattatcatacacgtacggtctcctagcttttgccttttgagctcgctaatcccttggactctagtgtatgaactctagcaggccctaggatattctcccatccggcctcgatcgtgcatttccattgccccccacacagcctttccaaagggacacgatcgagattcctttccaaagtccatagaaaaaaaatatatatatatttcgctttcttcacttctccctagttagctgtgtatgtcctatatgtatatgtctggctcttttatattttttggtcccctttggcctttatttgcctttgtccaaagctgccctttgtgccttcttgctatggtacccttctgctgctagggaagagggatgtgagagtagtagtagtatgctactttggaaaaagaaaaccaacatggaggtcagatctgggaaaaagagaagccttgtcaacatgggtatgtttgcttttgcttgaattgcttcgattgactttggccactgcatgaaccatggctgtttcattcttctatgccacctgctagctaggcttcaatgcaacaaccatgcgcacatgcatacatagagtactaagtttcatattaaactccctcctaatgttccgtaacgttatcgtgtctttggttgcatgattcctccaaagtcccctctcgtccgtccaattctgatggatagcgggccttatctcagtatttgaccctagaccaaacaacgttatct

SEQ ID NO: 871 - DNA, 1240 bp, Zea mays
  misc_feature (1)..(100): optimal_loci_93581_G1, chr3:7213896..7215135, Cluster 5
tattttacaaagagcacccctttgctatatcttctatcactttcactccgttcggatgtacgtatatgcgcaccctgatctatggtcatgcattgtgacgaccaagaaataatgagtacgtgtgtgtgtttgtctaaaccagaattgaattgagccaacaccagttagtcatttgtaaatggtgcaacgtatgttgtttgtttaaacgaaacagttagaggctcttgcgtcgctacggtttctacgtatcacataatagatcacatagttaggtatctatatgtcgctgtggcttctatatacaggtttagctatagaggctcttgcttccataatctgttggtttttgagaatcaacagagaaacttttgcttggttcttatcccatctttggatctggggtagtcctagggatatcggctataaaagtgagcaaataacccctacattgttttgactaatacaagaggtgacaagctcgtttattgccgtagacacccgtattgcaagacgaagtgacaaggtggtgacgtccggttacgtacagcccctatgtcttttggtagcaagagcctcacgtttttctgaaagagattattacagtatacaatgccactggccttgcactgcgcggcgacccctccaaaactcacatatggtttccaaagtataattgttttactagttcttttacccctttttccactcatcaaatttggaagtcacacaattaattaccatggttgccgccagcaggtgcaatcttctggatggagatgtcatggtgtgtcttattttctcgagagtagacacttttgagttttgtggtggtgcattgtattgatggagaaagaattagtgtgaagcaccggcgaggcggctagaggggtgaactggagtcaatcaaattttgccgccgaacactgaaaatgagtacttcatttcaaaagaagtaagcacttaaaccaaaattacatcagcaaaccagtgatcttatgattttaaaatgttcctacaacccacaggagaccaacaaaacaaacggagcgcaaatcggacactgaaaagtccgaatcggtccaaaaccatgtcgcgaacaaatgctgatttcagcagcatgaaattctgttatcggatgtgaaactaaagcaaacaaactaagattgagatgacattttacacatacctaaaaaaatatgtttccaaggtctccgcagattttaagctcaatcggacttgt

SEQ ID NO: 872 - DNA, 1034 bp, Zea mays
  misc_feature (1)..(100): optimal_loci_94602_G1, chr3:12636841..12637874, Cluster 5
  modified_base (589)..(589): a, c, g, or t
  misc_feature (589)..(688): n is a, c, g, or t
  modified_base (590)..(590): a, c, g, or t
  modified_base (591)..(591): a, c, g, or t
  modified_base (592)..(592): a, c, g, or t
  modified_base (593)..(593): a, c, g, or t
  modified_base (594)..(594): a, c, g, or t
  modified_base (595)..(595): a, c, g, or t
  modified_base (596)..(596): a, c, g, or t
  modified_base (597)..(597): a, c, g, or t
  modified_base (598)..(598): a, c, g, or t
  modified_base (599)..(599): a, c, g, or t
  modified_base (600)..(600): a, c, g, or t
  modified_base (601)..(601): a, c, g, or t
  modified_base (602)..(602): a, c, g, or t
  modified_base (603)..(603): a, c, g, or t
  modified_base (604)..(604): a, c, g, or t
  modified_base (605)..(605): a, c, g, or t
  modified_base (606)..(606): a, c, g, or t
  modified_base (607)..(607): a, c, g, or t
  modified_base (608)..(608): a, c, g, or t
  modified_base (609)..(609): a, c, g, or t
  modified_base (610)..(610): a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
  modified_base (623)..(623): a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
ggcaaatatgtgtaaatgttgcctgggttactttacaaatatgtacagaaaatgatccaggtgatcctcaaggcccattgagcagaatcgacatatgatcttttctcgagaccatgaggttgcatctggtgctaaaatataaagctaaaagtcaagcacaaattccctaggaatttctttacgccgtagcaccccatgaaaccttcaaattattttgaaaagaatctacggaaggggaaaaacccgtcgtaggcccctgctcgatcagcacatgcaagcgtacaatccatcccttctgtctgcctatggttgtctgtaaccggggggcaactgttggtaaggaaaatactagtaagggactttgttcgccctcaccaacgggcccggcaagacccatcctttcctcctgcggtatggcaccttgaaagaaaaaaataccaagcgaaaacaatgaaaaaagccttttgtatcgcgctccccttacgccaggcgaaccgccgtttttggcaccagaagaccctagcactattgaaattatatgttgactaacaacgcgaaaacccactcctcccacgccactttatatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcaaaagaggaaagttcgcctcccccttacgaaattaaactgcctagatagaagcacccgagaagagagaagacatgatggatctgcggcgaattctgcccatgttggtacgtagccagaatctaccaagaacaacagtttcctatgagcttaacacatatgatgcaatgaagagacgacccaagaaccaaacagaaaaagaaaattagcatcagaaagaaaaggaaccggaacgatgagaacgacggagtcgaggaagagaaaaggcgcttccgccgggtaccaggccgacggaaaagagaaatacaccagcgtaggggctccatatatgtagcagaaaagc

SEQ ID NO: 873 - DNA, 1044 bp, Zea mays
  misc_feature (1)..(100): optimal_loci_94662_G1, chr3:12993798..12994841, Cluster 5
accctgagccccctagatcatcaatgtagttaatagacaatatgtatagagagtcgtgtagagacagtttcttcacaaagagcctgtctcttgtaccttttcaggtaactgcctaaagaccctccaagagaccccatattaaatgaggttgtacatgttaataatctggtaaagcgcagcttacagtgacctctctcaaatgttgtcttgggcatgctaatagtcgtatgcaaggcgggggtcaggttttggctggtcctcactgcaggtgggcataattgacctcttgtaatatgtagttatggacttcacaccttcgcatgcacatctctaattcaactcgacaatggaacaccacgttttccactgccaacatgtcgatgtcattgaggagtcgatcatggatgtagctagtcctgaggtatgcatcggcatggttattgcttgtcatgggggtgtgcctcgtggtatactttccattggcaccatgatcacatcggaaccatggaagttcacttctcatgtattgaccatgtatcactcctgaagaggggtgagatcgtcttcaatatttccttctctcaagacgtagatgaccatgtagtctacatactcatctaggtcgatggaattagtcactctctcattcagattgaatgttataggatctgtgttgtatgctgtgagctcgacatttgttggtgtcttgtcacccgcgtctccattgttaaaactatagatgcttgccattaggacaatttaatatggatcattgttgcatggtccctctaggaactccttggctgtgagagagttgagatctggggtggtcatcatagattaaaggagccaattgaggtaagtggttgcagcatctttgactctgattggaaaatcgacgataatgcaatagggtagtggtgttggatccatatcttcaatccaacatggatccactattagtggtggcggatccatatcttgaacccatggatccactagaagcacgaggaacttgttgagaatgaacacttggttaaactt

SEQ ID NO: 874 - DNA, 1335 bp, Zea mays
  misc_feature (1)..(100): optimal_loci_98015_G1, chr3:31488717..31490051, Cluster 5
gttaaactatactattatatacattgaccttgcgtgaatataatgccagcgtcactgtgtgacctgctaacgacgacggcgaggctttgaccaccccagccctctcgaagggtttgcttgtactgaaaaggggcggccgtgggccaacccagttactagaccggcccatacatttgtaagataaatcaataagtatccatggggcttcattcagaagaaaaagaaaaaaaagaagttgtatgggctgccaaacgtcaattttagcccatccgatccaagccctacattggttatccaatgcaaggctgagattcagggggttataagacccttctcagtggtagtttcatcacatcatttttaatattgtcatgtcaataaaagtaagatgaaatatagaatgatcaatagtttcatgtcacaacttcatagactagcatgtgccttcaatgatgaatctaaataaccaacagggatcaatgaaatagatggagatgaaacaaattactctcaatggtggtttgacgcggtttccaatatcttggaaacgggttggtatagtttcatagtgatgaaactagtttcacctattttataataaatatagtgccataacatcaaaaatcatatattgcatactatttaatgcaatgaaatctctcacaaaactcccatcgacaatagcctaaaagtcgatggatccaaacataggcatgcatgcacgtaactcttaataccattcagtttttgagatgtcctttgcctacccatccaaaaatgtattttcaatttgcctaccattatctacaacaataaaacccatttgaacacccatatcaataaaatatcatttttctttccatcccacaaaactaggccccgcttttctctcttctctcactcatatcatatagaataggttttggagagaaaaaacccatatttaggtttcctctctccttctaaaatgagtatcatctaggtgctctcaactttcatgtttgcatactttaataaaggagccaaaatgagaatccaaggaagactcatattatggttcattttagagtttagaaaagttcttggtgaccattggaacactttggaactcagagataaggcatcattgtttttatgtgaagtttgaggttccaagtgaaaattggagcataaagttgaagtagagaaggcagctgaagttggagaatttggtaaagacaatgggatgacttagagtggttggtacaactcaaagaatattcgtctaagtcataaaagtgcacaatagaacaactggatcaatctgcaaaagaaaagccaaaggtaatttaacat

SEQ ID NO: 875 - DNA, 1172 bp, Zea mays
  misc_feature (1)..(100): optimal_loci_285621_G1, chr8:118321357..118322528, Cluster 6
tacaacaaaccgaattttaatttacaagaaaataagaatttttgaacaaatatatttctgaacttatgagaatctctagttttttttatattttttcatgctttgtttttgaattcgaaattccaaacgaaaaaaaatcaaaaaaaagacggtagaatttgtttctgtcgtttgttcggaaggggagaaaacggcgaaacccggcgaatcccgagcgggatttgtatcccttcggtgagcacgcggcccacgcacacggcagcgatcgtgtccacggtgttatccggcagcacaaacctgctgcgcaagaacttgcccatccgccgctccatgcgcaggtattggcgtctcgcgctcctctggttgccgctcgtcgctgatcaccagtatctactcgtacagtactccatggatgcgtacgcgcccgggaactcctcggcgtcgtccgggctgaccgacatggcacgcgcatcgaggatgtagatgcacgtgggccgcaggccaggtctggccgtctggggccgtgacgccgggagccgcgccgctgtcaaaccgcgtcagctcaatcctagggtccgttttctcaattcccaacgctgtagacgaaaggggtggtgtgggcctgagaggtagagggccccggccggggctactcgatccggccatcatcggctcgccggagctcaccgtgtgcgtgtcctacaccacgtgaccactcgcctccatgaatcatcatcaattccacccctttgccaaggcacaatggccaaccatgtgcgtgctgttaattaatttaatttaacggaaccttgagggtttcttttttgaaaaaaataattgaccagaataatccgatcgcatcaccacttcaccggcagtcctgcagtccaacactggaagcgaagcgacctctctctgtcttgcgtgcaacccggccgagcgcgtcacgcgtccatctgccgcttcgttctggcttggcgcaaatgagcatcacatgattggccgacaccagcaggcattgcagatcgcacaagcgggggatgtgatgtgacgtgaggcatacacctgtcagcgagtcgattcagggcgacacaacgaatggagtcgagtagaacgagaggacatgccggacaactacgcctcgccgagcctgcgagctgtaccgaccggat

SEQ ID NO: 876 - DNA, 1170 bp, Zea mays
  misc_feature (1)..(100): optimal_loci_100127_G1, chr3:44602104..44603273, Cluster 6
gtcataagcttatcatgataaccacatttaacataaaatatgttaatcagtactaaatgtatatatatttttactctacttggaggggtttgtgtatgcgtgtagagacttgtacaatataatataattaccactttggagcaagcttattatatatcttattatctatgttgttgtgctgtcgtcggtgagctcgtcgtcactgcgtgcgcgcttgcccctcagtcgcgtctattctgcttctagtcgtggccctacacccgcttgcttcgcctccaatccaaggtgtgacaccatgcaaacatggcccatgccatgcactgctccctcgcgtctggtcgggtgggctagatactgatgatcttttccttaaaccctaaacatttagatggagccccaatgcacatcacagagtcatcagccttattataagtttataacgactgatgaaagagaacctaaatgcaacagacatgaagcatatatagcataagtgtttacagcagcaaatcaccaggcagctaagggcactatcgtcgccttcgaactagtcttcatctttgtctgcaacgtagcccaataatccggacaaaagcaacaaatgtaagtcacctcagagggatccagaaacaattttgttatcaaaccaagctctatttcttgatttccaggtcacccatagaactgcaccacacccagctaatctctttactaagagtggatacagacctccaacaagtgggcaatgctactcggggtgctcggcagattgaaggcaatttgaacaattctccggatatacttagcaaccgagcactccagaaaatattttttgtggaagctttattcactttagaaaaattgatgtttttttatggaggcacttctcaattgcttatacactgaattaacaaaaagccttttgcaccaagagaccaactgactcgatctcttgaatttgaaagattaatggactcataggaatacttcaaattttcaaacatattggctgtgtcacccataattatccttctgaaccttagatttgtaaggttagcccagatagcatttgcgatcaaaatcattttatcgaaggttaaatcaaataaccttccgaatttttcagcaaagggagagcctccacaccaggcatcatcataataggaactg

SEQ ID NO: 877 - DNA, 1164 bp, Zea mays
  misc_feature (1)..(100): optimal_loci_100985_G1, chr3:49152540..49153703, Cluster 6
atccatgagctcatcgagccccctctcaatatacttgtgatgccccatccccacgagtgagcatattggaaaccaaagctttgttgtaccattatttcttgagcaatgaactagtgacattattcttgtatatcttcgctatagggttttcattttctacacacactggcaagcttgatatatagaagatgatgtttgtcaatgtttttcctttttcttgtggtgcataatgcctacatcgtttagatattagggtcatgacccaagtattaggggttagggttattttaacatggacatccactattctttagctcatcattaaaccatatttttatttttatatgcttttcataggaatcatgctaagatggataattgtgaaatggagaagtcgaatcataaactagcccttaggctagaaataagaagatagatccaactagcccttaaggcgattttccagtaaactagccctcacagttatgagtgatgttttggttgaattttttatttcatgtgctaatggctagtttttttgctaagggttacttcactagcaatagtgatgaggtgaagtcggtagcaatttgcatccttgtcactttgcctccttgccatttttgtcttgtaaccaacaccaagataatggtaaatgatgatctagtccttaggaaggcaatgaataggtgcatctaactagctcctagggatatgagtgatgttccaataaactagcctttatgactattagtgatgtttcattaaactagcccttagggatataaatgttgttccaattattgtttcagttagatgtaacatttatgccaaccctggccatcacacatagaaaaaatttgatcaaactctagctcccgagtgactacaaacatgttcgacataccatatggcgtcgttaaaccctagtggatctacgctggtgaataccaaatgccttgatttatgcgtcgactagcttgatggcctgaggaggaggggagaaagagctcgatggaggcatgcatcgtaaaggctacatacctatgggtaccgaacatgctgcaacaacaaagacaatgacttgcgggtctgactaactcggactcaaactgagtaacttggacttcgacgagggactcagatcgacgctaggggactcgg

SEQ ID NO: 878 - DNA, 1060 bp, Zea mays
  misc_feature (1)..(100): optimal_loci_114188_G1, chr3:137243383..137244442, Cluster 6
tcgtctaaactatccatacgctggaggttagagcccggagctagtaagtaggaacagctccggccaataatgcagtccgcggccggcggccaatcatggctgccgccgcgcgcgcgtgcacacgcgtcgccggagctggtgagagactgcgcggcgtgccatgtgcagcaggtgcgccgcgctctggacggtggatttggatcggcgcgccggcggcgaccattattattgtgacgacgaccctcccacaccttaacaatgaactcgtaaataaaaggccttgctggtcggttgcagtggaggtatgtgctgtgcatgcgttttatcatcgggaccggaccgaaatcgacagaaaaaaaccctattccattttcatatctgcattttatcatcggaaacggaaacagaaacggtagaaagataaacaaatttacgaaaatgaatgaaaacgaaaatactaacagaaactcatcatttaatataaataaaaatggtattaatgtttgactattgattgattggtaggataataacataaaacaaatagatatagagagacaacattttattccacttgtcatttatagtgtacttagtgacactaatttgctgtaaaaacttggtgcccccatctaccaattcggccaaagctacagtaatttaacttaagaccgcaaaaaaaatattttaatatatatatatatatatattcaaggctctgcagtatataacagattgctatacgaacgcttgcgttgcgcgtacatcacacacactaccgcagtatataacatgagtatatattgcatatatatgggccgtcgtcgaccgtggagaagcgccacaaagcaagtgagcgcgcgtcggtgcatcgcgcgacttgcatcttgcatgcgttttgattcttgcttcttgatgtgtccatcggtcattggaacacagatcccgagggaaaaatataaactgggggggggggggggggggggggttgatcggacaggaaccatttacaggctcacagctactagcggcggggattttttttttgtgttgggtggtt

SEQ ID NO: 879 - DNA, 1135 bp, Zea mays
  misc_feature (1)..(100): optimal_loci_116203_G1, chr3:150053319..150054453, Cluster 6
cagtagaaaccggtcgaaataaaaaatcgtcttctttgttatacggtgcatggaagaaactgaatgagcgagtgcatgtgagggagccgactattcggcttgctttctttttaatgcgaatgaacatcataaaaccactaccacctcaacagtcaacaaccagctgctgcaatggtgtgagtagctgttggtgttgtatctttattttgggggtgcgtggaagggaaagaaagaactgtatgtcccctctcttgcgccatcgttccttgacgtacagtgcgtcactattgcatgtagtcttggttacgtacgagaggttgccggccagtgatcgattactctctctctctctctctcagaccccagctgcatgcccagctgggttgtttctctctctctctctctcgtgtggagctgctagcttttccatgagacatggcctaatctatctttatggcccaatagtgcctctctgggctcacacgcacacgctgccaggaaactggtggggttcgcacagctgtggacaaacggatcccttgtcttgcatgttgcatgagcgtgactggacacgacgcatgcacgcgaacctagagctgcatccgtgttacatgtgcatgcatgctgcgttctacatgctttgtacagacatcatgtacacctacccccctctctctctctctctccctctctgcatattcacacactgtcaatatatagcagctactacatgtgctttgtacacacatcatgtatatacctctctctctctctctctctgtgtgcagtggcggagctctataaaattaacgtcccgggccactctataaaacttgaaggttaatttagacattccctaatatattatacggctaaatataccgctaaaaaaaatataccacaaacatagactaaaatagtatttacttcaaatcatcatctaaaaatacaataaacttgataaaaaaacataaaggtacctaattagagacgatttggtccttccccgcatctaataacttcatcaacattagcacgtgaatttaaacctacacattacaagttaaatatttgtataaaatgagagatacaacatgacaatatcaatctaccatcacataaacatttaacaatc

SEQ ID NO: 880 - DNA, 1179 bp, Zea mays
  misc_feature (1)..(100): optimal_loci_120316_G1, chr3:175697081..175698259, Cluster 6
taactcttccaatttctcagggtgtattggtatcgttacgcaacaaacaacaatgtcgataatatgccgtctatgtttgacatccttgatgtcggttctctgcgagtagggattctcagggacttgcacgttcgctcgcagcgtttggaggaccttgaggttttgcttgccgcgcgcccccactccatgcatggccgacaaaaggtcctatttgtcgatggctgctctgtctcaggtggcgccggccatgcctatcacttccagttccagcttggggtgtgggatcacgcttgggtcggtcacacagggacatctcttgctcggtcttgactggttcctccctccccctcgcttgcttgttggcttctgcctgcgtacgtagttgcagatctcgtgtagtacgtagttagcctcgatgcatgggcaggcatggcgctgagagttgtggcgtcgtatggttttcagcacccgcacacgtcgggtgagatgtgccaccagcttccagacatgagttcgagttgttcccaggccatcacacgtcccatgcatcctccgttggattactgggatcccatggcgtcagctggttgacatagcacccatgcaaaagcttgtttctccgtggcagactttggtccccgtacgtcataggattgattcctctggagcacgagctgtggtcgtcggtcagttccatgagacgttgtttgcccgtgacgcgtcggctttggcagtcgtaggtggcaggccgggatcctcgtgtgcacgccactgacgtcggtcgcacaatatgagagttggattacacctcctaggtagtttctgacctgttgttctctttgatgccgggggtgtcatcgtatcctttaggcctcgttcggctttgacggaacgacatggaacacgaccgattccatcaggaattatttgatctggactcaaattagaaccaatctaaaatggttgttcagatagacctgttctgtaatgaaaccaagctattccagaatgaaaccagacctttttacccactcaacgacttggattagagccacacctataatcacttggaatcaaaccaaaccaagcctttataggttttagtgaaacatccagatccactctatccggctcagattgaaaaaaatatacctgtcttcaagttggaacaaacgaacg

SEQ ID NO: 881 - DNA, 1287 bp, Zea mays
  misc_feature (1)..(100): optimal_loci_121889_G1, chr3:184002944..184004230, Cluster 6
tgaagtgcctgaccccatgaaccattgcaaagtgcatgttgcatgctttattttgaacggtggcgaaaaaagaaagctccaattgcttgcagaaaagaggaaggcacggatgcagctatataagctccaggatgtagagaggcaggtgtctttactcgaaggctgtttgagtttggcacaattcctctccggcttcactccccaggaaccatggctgcgagtttttttttcctcatcggctactctgttcattacctgaatcacatgcatctagaagtttacctatcacgtttacaggggtaagactgaaagttcatatggccacaggtggtggagctgaaggttggaatgcactgtgaaaggtgcgtcaaggccatcaagaaggcgatcagaacgatcgacggtaacaagccggccatcaacccggttctttcctacaccacaaaaaaccgctcgctctgagctcttgtgctgttgaccatgcttgcggtcgtgcgcatacagatatggagagctatcacctcgagacggagataaacaaggccacggtgacagggaaggttaccccggaggaagccgtcagcagggcactccgcaagagctatcactcaatcactctgagcttttctacaccagcgcatgataaacacgcgcacgcagctgtttgagaacgtgtccaccaggctgccttgcctaacagcgtcctagtagccttccatccttgaccaattctgctctgcaggcgttgattcagccgtgtgaccgtgtctcggctgacctgcctccattggccccgacatccgctgcaggcactggcctgcaccgccgcttccccgaacggcacggccgtccgtcccgttcccgtcgcgccggctcgttcgccagaacgctggcttgcggcggtcgttcgtttgaacagttgtgcatgcagctgcggcatgcatggggtgcctttgccatgccgcactcgtcagatcagatgccgcgtgaacgaacgctgtccatgcaaaagcaagctcggaagctcccagagtcttcgcccgtacgtctcgcgtcttttctcgtctactactagctagcaaccatttaacgacgagagtgccgtatcgcggcgttttgccttgcttgcgcgaaaagaagcacggcgcggtgcactgacagagacagagaagaactgttggagatacggactaggtgtcggttcatcatgcatgatggtgaaggactggttctttgctccagagtgcgcgcgagttgcgtacgaacgaattgaccagacgccgccgc

SEQ ID NO: 882 - DNA, 1170 bp, Zea mays
  misc_feature (1)..(100): optimal_loci_121919_G1, chr3:184117501..184118670, Cluster 6
aactactcttaccttcttaataagtagtatagattgtgttgcagttcagccattactggccattgcattttagcaagggaggctagcacaaccacgctcctcctatggaaacacacacagtttccatattcgaaagcagggacatgcatgcatgctagtaactcgatctactacactagagacgcttaacacgtcggaatgctgttgagttgcacaccgcaccggagggcgacaggattgcatgccgagcttcggtcccaggacgagctcgtggaaacggagcacgcagcaatgcgtggacggcgacacgtgtacagtgtagtcagacggatccaacatgtcaaacagtgtccggcaccgaggtcgcgtggagatggagctgcggccctgccaccgccatgtgcggcacctcaaggctcgtgaagtcaatgaaaccgctagattatctttcagcaaagacgattttttttaactaaagccggccagttcagatcgatccacactgtacttgttcagtagtcctagctgccgcgcgcgccgagcagtcaaagcgtgtggatttggatggcagcaggaactcaacgtcgtgccaagccattgcctgcagctgctcgtctttactttggttgtccatgccggcagcggcgaggcaatcgagcgagaatcgtatccatggcgttgctcgcgcgctcgtacgtgtgtgtgtgcgcctttaccgcacgcatagttatcagtgacactgtactagcgtgcatttttcttccgcgcttggtttcgagagaggctagggaagacttggaagcatcggcattgtggttgagtgtagagcgatgcaatgcaaggcggtccggggctgatcgatgaagctttctctcctgtctcggagagagcgaagtctgtcgggcacacaggtctggtgctgcatttttcaattcaaggccgagtgtctgtacctgactttaccaacttggaactcaactagcacgagtccgctcccggcaaccgaactctgcacgcaaaggaaaggctcctcgatcgtcctacacagcgcctttgggattgcaattagctagcaaatagttgccatcatgccctactcattgacagctgacgtccaatccatgcatgaaagaaccaccggccggcctcctcacacctcaatatgtacat

SEQ ID NO: 883 - DNA, 1155 bp, Zea mays
  misc_feature (1)..(100): optimal_loci_122567_G1, chr3:187219412..187220566, Cluster 6
gctgattagtgggtaaagagtctgatgattagctcgtaatgataatctgttgcggctatagatattatatactttgtagcattacgacccagcctgaaagtatggttttttattccatccaaatacagcattggcgtgttttcatctcataacaagtaattttatagatttggatggagttaggaccgttgtctcgttgttattgtttttttttttttttgcttttgatgagtttgagaaaataagtttagactcgttcaaagagaacttctaagtccagtatgatgtttaagtctttattgttggtttcacgtgttacaagacgaaatgttggactcccatgcttgtgtgagcaatgttacaaattgagttctcctacctgtatagcaaggccattgcccctttatatagccaaaggatcgagtgaccattgttatattatgttttttatgaggtaaatcatccctatcttcagttgtctagttgcttcagtgtgtctgcttcgtcatccttgagttgacctagcaatagaagtggttgagtcctgaaagtgtctaaaagccatgctgctaggtatgctttgtgagaagcgtgtgggtgaggcatggtgatgtgcctcggatgctttcatcacgtctagctttggtgtcttccatatccttagagcatgatcgacatagtatgtggggcctgttcataccttttaacgtgaagcagttggctggaggagtcaagtatcatgtatcgtacatgtttctaccttttgtatgtctcagttagagatggcagtcacacctacgagcgtgggtgcccacactcattgggtgtgattgtgggtgtcaaattgtacccatagaactacgcccgaactgactcgtaaaatgatgagttggatctaggtctgacttttcacctatggatgcttaataggcctcataatactaattttgagttcttgttcacacatgattttggtccaacccaataaaaccctaggttatgtacttatcttcatccctttaaaatgtgaattgatgttgcactatgtgttgtgtgcttctaaataattatatgtagtgtgcttttaaataattatatgtgttttccttgctatattgtggtgtttttacttaattgtttccaattgttaatcac

SEQ ID NO: 884 - DNA, 1341 bp, Zea mays
  misc_feature (1)..(100): optimal_loci_123505_G1, chr3:192405036..192406376, Cluster 6
tgagttgaaaaataacagagcatctaagaaagggcaagatgcagaacagtccaagatgaacggggcttcaagcccccaaatagtatcagatgaaggtggtggtaacctgaaatcaatgaaggataaatccaatcagcaagataaggatacaagagagggaccaaatttgcaggttgctgggcctggtggcgaaataactgcaggttaccttttgaagagaagagcaaaaaataatggatggagcaaaaggtggtttgttctaaatgagacgagtgggatgcttggatacactaagaaccaagaggagagacatttccgaggcgtcattatcctggaggaatgtaaccttgtagagatagacaaggaggagatctcaaagagttctaaggattcaaagaaggcgaatggacaagagaaaggcccaagtcttgtttttaagattactaatagggttgcctacaaaagtgtcttaaaagctcatagtgccgttatattgaaggctgagagtatggctgccaaaatagaatggatcaagaagataaaaggtgttattcaaagcagagggggctctgttaagggtccaactgaggatagttctatgagacaaagtcgttcagatggatcccttgatacaatgacccagaggcctgctgatcctgaagaacttcgatgcatgtctcaagaagttcgtggttatgttgaagctagtttggccgcaaatgttacaaagtgcacaaagcaatgcaaagatcgaagaactactccaagaggaccacaatgctaaacgtaggcggggaaaatatgaaaacaatcatccctctcgccaactcagcattcatgacaatagaacagcttcatatgtgaacgatagttctggagctgagagtagcccacggtctcctggccactctggtgaggactggaagtccaccttcgtctcagcagcaaatgactctgttaacgggtcgagttcacagcatgcgacaaggtcaagagatgctgacagaggccagtgccatgaaaatggcgatgccaactctggcagccgacgcacacctaactggttaccaccggcaccaccaagtgggaggagatactaagtatgttgattgatcattacctgtgaccaatcaacatcgtatgctcttgccaggttctcatccgctacagatattggtggaagcgcacatctgggaccaaagaacagagagcctactggaagatgtggatggatggtgtatatcaacaggctgattggttgtcgtgccccacgtgcccagactcgtgctgtgcattgaccgcgtgcaagcgcctgttcggttgcctgccccttcgtccacc

SEQ ID NO: 885 - DNA, 1284 bp, Zea mays
  misc_feature (1)..(100): optimal_loci_123860_G1, chr3:194252130..194253413, Cluster 6
gaattataaattgtattcatttttttcagtttgaatttaatatagtcccaggtaaaatagcagacgagacaagcgcaacaaagcattttttttctgtggcccagtccaagaaatgttctattcttttcaaccacacatatgctgggttcaaggcatttggtggctcgtaggcacaacaactagtccatccgatcaaaatacaagtctaccagtcaagatttgttcaaagttaagcaatttaagtattgactatgtactatgggaccgaactgtagctcggttggttctaagtgtctcttaatagcagagaggccacgttagaagggctaaaatagcaattttttccttctgctggggttaattagcacttgttttttgcgtgttattacgacgataagtcgataaccaccctgatcgcacacctttgcaatatcgcggagcctggtcatctacggtgcttgaagcctgttagggttgtcgtcgtcaactcgtcagtgccaccagaaccctgagcagcagcagcaaagcacgggagcacgcgcaggggcgcagccctgctgatgctgaagcatcaaaatgggcgccaagccccgcggcggcacggcacggcacagcaacccgcgccggaaagagaggcaggcggcgggcgcgcgccgaaacttaccaaagcccgcgcgccccggcgcacgacgcctggctggcgaagccaactggattattccgtcatcgacgtcgtcgaccaaccagcgactcctcctccgactcgccgtgcgcgcgcgcgcgcgcagccttcgaacgaaagtcccagctccaaagccacacgcacgcgcggcgacctcgcctctctaataaattcccaaagcggaggccgaaagcgcgacgacgcttttgcctcctgcggctgctgggtaaacctcacgggaatccgccccccgccccggcctttgatttggtatcctagctagacgactagtagacgtgacgcgcttctcttttgcagcgctgcggctccagacttgacgccggccgtttgctaccttcctctttcctgaaaaatggaggctggcctcgatctgtttgcgttcacctgcctttgtcgtccttggccaggaccgatttattagctaatagctagtctggagcatgagattgggcagtcatccaactctcaagagtcgggaccagtgacagatcctgcgtgaaaatgctcatctgccagcccgcaccgcaccgcgcgcacccgctccacgaaagacaaagtagtaaaattaaccgcgcagcgca

SEQ ID NO: 886 - DNA, 1271 bp, Zea mays
  misc_feature (1)..(100): optimal_loci_124188_G1, chr3:195944585..195945855, Cluster 6
acagtggggtggtagtgtgtgtggtacggctcacgagaggcggagcagtaaaattatcggcggaaagcgctgtgctggggcagcagggtgcaggtgcaggtgctccgcggcaggcggcacggcaggacctttttggaggcgcggcgtagcactggcgcggggggagcgcgtacactggtagtgtactagtaaagtaacatgaacaaatctgcgacggcgcagtgctttgcaggagaaggattaacaacaaacgcgaccttgcagcaggactgtttgctgttgctggcactgctagtgctagctcgtgttccgacttccgaggccaatcaatcttactactatataccgtactttaattcgaaaagttcgctgagctgccacctcccacctccggtgcgtattctttaaatcattttggattgagattcatgtgcaaaaggccctgtgatctttacctcaaatcattaatgaatttctgtatgtaggaggtactagtactagtatcagtagcatcggattagcgagacggagttagcccggattagcttggtgtggccgtccttggcagtttgactcctgtctgtcgtccggcgaaagcgaaaccaaccgggctaccatacgctgtgcgccgaacggaaatgaccgtccttgtcactggcttttgcagtagcagttcaaatgataggaatcgtgatagtgcaccaaccacagcatctcagcaagtgtttcccggttttagctttcctcgggacggggtaataaggagaggaaaatgaaccagagcgaacagagcacagtgaccaagcacgtacgcatcctttcatgggcctctcgtgtttcgcctcgcacccgtgcttgccgccctgtgtgcttggaccgttggacgtgctgggtagacgggcattccgattcccacgtttcggcacctttaggctttgttcgtttacaccaatcccgctctggattagcatggattggaattaaatccatgccccaaaataatccatgactacttaattttttttattcggttaaacccatcatgtaatataacccaaaggtttgggaattttttaaactatggaagacatggattctatccatagcccattaggtatggaacaaatccatgagatattgcacaagtttacattagaatccatggatcaaaagaataactagctttgaaagtcacatggatttgttgatggatttaatcccatcatgggattgggtgtgagatatggattcacccaatccatatccggatt

SEQ ID NO: 887 - DNA, 1277 bp, Zea mays
  misc_feature (1)..(100): optimal_loci_124354_G1, chr3:196856087..196857363, Cluster 6
gggggagagagcatcagggggtgagtgaggcgcgagtggtggatgtgtgtgaggggtggaatgattcgaacatccctggccgttagatgtgagtgggtaagagaaagaacgagggagaagagatctagggagttcaatgtgatggaggagaatttcttgagtgtataaaacagggtgcacaaagaaaacttatcttagcggggtcatttgttaagtggatctagattaatttgaactgatgctttatttaggggtatagaaccatctcccacggagatagctcacatgggtgttttaagtgatctagcagatggttcaaaacaaaatcacactagatgtttcatagggacgccaacatcactataatgaagaatacttgagattgattttgcttttcaaaggatcatgttgttggcgatttttcctataagtttattagagatttataaattaagaaaaggtgaagattgagggagatcattaaaaaatattatacatgataaaaagtcataattagatagatgttctgatttcaagatagaccaaaacctagcccatatttatttagatttttagaaacgcctcgctgttgagactccaaagtgtagcatgccacacactcaaacatgaatttagcctatcgatgattctgcacttttacacttggatctgctagttgccaccaaggctcgtggagactagcagtgtctccgctactggcgatcatggagtcggcgagttgctcgagaggacaaggatgttagttgttgtatttcttttcaggccttcttgtataagataattttgcctgctatatctagtataatataattgtaaaataagtgggcacaaatcaaacacaatgttctcaatgatagttttatcatgctatttccaatttaccgcaccaataagataagatgaaatgaggaatgaaatatgctctcaatgaagagtttcatgacacaatttcataggctaacatgtgacttaaatgttgtgtctaaataacaatagaaatagatagaatagatggagatgaaatgaattgctcccagcctcaatgtcgatttcatgcgctttccaataccttgaaaaccgtttgacatggtttcatagtgatgaaactagtttcatctatttcatagtaaatgtagtgtcatgtcataaaaaatcctatgtggtatactaattaatatcatgaaatctctcttgaaactcctatttagaatgacatagaaatctctagccatttaggttctgtttagatgcaggtg

SEQ ID NO: 888 - DNA, 1087 bp, Zea mays
  misc_feature (1)..(100): optimal_loci_125071_G1, chr3:201224555..201225641, Cluster 6
tgaccatagttcgctttcttcgcttcaagtagcggggtgtgtcaaggagagcctaacgcttgcggatagttttgtgagttcgggataggggttgtccccccggacctggttcatgtgtctttccacctcgggagcttgtaaatatcacttgtgttgtactttactttttccactcttaaattggtaatgaaagacaaagcttctgccagactgccattgcgttgaaaaaaacacgatacaactactgattgacgaggggtccagacgctagtgtcgctttgcatctgtaggcatcttgtcactggatatgaaagcaactcgctcgtaaaatatgcagctagctagagcacccacgaagagcgcacgggccactcggtccctccctcctccctcgtttggatggtcaaaaccgtctcggagtctctgtagtcatcgagcgtgctcgacgcaggacaaagggtgatggctacgcgcgcgtagatgggaacgttcagattacacggcgtacgtgacaggcaactcttgctagaagtcgaggatggatcggaggcatccaagttacctttcgaacagggcattcggttgtcagtgagccatgctagtgcgtgcgtgggggagatctgcctcacaaccctacgctacgcctgcaagagagccgagttctgaacgtttacaagctagctagtactgttccgccagcggatggtactaaaggttaacagtatgtatgtttgttgttatgtgcaagattcccaagttcgccgcaacttgaggttgcaaccaaagattctgcttatctcgaggacaagattcgcgtagtttcaagtgcagagacaagagggagggcaaaaaaaatctggcgaagtttgtatagtggattaaaaaaagcagagatagagagagaggataagctcattgccagacattcagactgcgcctctctgctctcctcctatccatggccgcacctctgattgtctgtatataaatagacaagctcccgagccgccgattcattacgcatcggcatgacgcggcgtattcagagggagaagatgagagcaacgtgggcttcgccgattccatg

SEQ ID NO: 889 - DNA, 1076 bp, Zea mays
  misc_feature (1)..(100): optimal_loci_125535_G1, chr3:203290605..203291680, Cluster 6
ggtgtagcaagcacggcctgcagctgttgaaacttgaagacccgtgggatggcaatcagtcagccatgctgggctgggctgctgctgcagactggccgttgcggcgacgcctaacgactgcctcacgtcttggaccaagaaacctgtggcaagggcgaatttggcacagcacagcaccgagctgctgtctgtcgtgatcactgttccaccatccagcgaaatagacgtgtcgcgcctgagctggaaggacgaggatgcggccaatattttcatccgcaccgggctccatgacaggcgagtactactagcacgcaatgcaagctaggaagaagcaaaccgtcataatcatgctttcccgtcaaaacgcttgagatatctagaattcatcaggagtttgcttacgccgttttcagtaatcagcttaccccgttgattaattagttggattacgttttgttcatttttgtcttgagaatgtttcagtagcaatcaaattaattggtgcaaccgtgcaaccaagacacaaggataataataggaggacattttagaatataccaattttttaaaacaaccctcctacctctctatgtatatttttaaaaagatactctcacttccaatcttgtgtcttgattgcaccaattcatttggttgcattagatacgttcccgtcgtggcattggggaatcgtggattcataattgagatacaatgtacaattatgtatgagcaaggatatgaacaccttattcttagactatctccaacaggtcctctaagagtgtgtttggtttgaggaatgaagtgatccatcttcttctcaatcctcacttttttatttggtttgtggaatagaatgggttgatccatcaccacatcattcctcataagctaataattagtatatatatgaggagtgggttgattccaccaaaattgatagaatgaacttatgatgcatcacctcatgaagcatagattgactccacaaatcaaacacaccatagagaaccctataccttaaattttagaaaagattttcgtcctctatgtgttcagcagcgtcctataaa

SEQ ID NO: 890 - DNA, 1191 bp, Zea mays
  misc_feature (1)..(100): optimal_loci_126711_G1, chr3:209014336..209015526, Cluster 6
agctatagcattagcctttttctttttataaacggttagctaaattaaaatacggtgttaaattaaaaataaaaaatttatccgagtacataattaagcaaatgaaaattatgtaaattcacaaaaaaacaaataaaatatcaaaactgtaaaaaaataaaaataacatagtttataaaaatatttgatacactttctcttctcgtcatctttctcttccacatctactttcttatctaacttgatttgctttaattaacattttcaaggctaatttataagctctttttttgtgtcatcgtctatgtcggcagtggagcaatccaacaacttattgaattacttaaataatttcgattgagtcattccctagctagccttgaagagtgtgttcaacatcctcttctccatgtctgaaaactcattgctaccctccccttatgttgagctcttacaatattgctatcaatagagcatactgggcacataatgtctggttggagctatagttatcgtctaaattgaggcatgattttttgctcctatcactggaatcatagtcatcatgcctcacgccaattatggataagtaaaaggttgaggaggaggagtgtcgtttgtaggatctttggtggtaggaggagcatcggtggtaggattttcattcgatggtaggagggtctttagtgctaggattttcattcgggggaggagcatccactgatggtcgatagggatatagaggaggaggatttgggtatgaaaactaaggttgtgaactaaggaaactgggataggtaggaacatcttcctaatgatgatgtacgaaagaaagaccatcgaaaaagatctgccccacaccaagagtctagggacgttgtggggattgctcattgagcaagtcagtgaaggttttaaagttgtaactccacctagaattcgtattgaataaatagtagtgggagtctttaatgtgaaggaagataagtgaaatggagtgtgagaggtgtgaatggatccaatcacccctccatttacagggtggatctagggtttattttttatttttttgaacttcaaatagttaaaatggcgcgaaccaatcaggagatgacatgtgccaataggctatcattaatggtcggtttggttccaacgtggtcagtataatctggactgacctgtcagtag

SEQ ID NO: 891 - DNA, 1137 bp, Zea mays
  misc_feature (1)..(100): optimal_loci_126715_G1, chr3:209019879..209021015, Cluster 6
aaaaaatatgttgcaaaacaccgtattcgtgccacggttagtgtccaaactctatcaaagctgatcatctttgacaattgctcatcacacgttgaacatcatggccacatatcgatcacatgttcgcaacctccaaagaagaccccgtgaagtcttcataaggcttaatgggtgcataaatggctcgacaatgacccaataccggaggtgcttctaacgtaaagtcccaagtgccattgacattgatcgactcttctggtactgtaaaaattgatatgtaaaaaatatatcctagttggcaacagttaaaagtgtatgagtgaaaatatataatcgtgccctataaaagagggacattaacttcaataaagacactttattcagctcaaaactctagaatacctatctcgacaatgtggttgtataagagcaagtataataataggatagtgccgaccttgtacatgtgcgacaagcgtgattgtacatggcccaaaattctgaggagcctaaaaaacttcttagctcagtaataagcctaaacaatatacatcagtgagcagactaacattacatcatcttagctgaactcagctagcagctagattgctgcttttcaaacacatctattaatacatttgtttatttatgtattctattacaatataatttcgtaaaaacggatagatttaatataaagagttataagtgttatctagcaaaacttttgcaattcagaatacatgaattctattataacgtaattttacaattatatttttctataaaataggacatttttcaaagttagtacatgcctctaaatttatcggctcgcccctgataataggctataaacaaagtaaatgccagggtgaaggagagataagaagagaagcgagctataaagttagaccattcttagtggtatttcattctcactaaatgagataacacatcactatatttgatgatatgacatggtatttatggtgagagatggagagagttccatgagagaagagagggtttcatccagataaaacttagaatacacggtttcatagacaaaagctgatgtgtcacttttaaaaaccgtgcaatgaaacttgcactcgaaatggtcttacagccaac

SEQ ID NO: 892 - DNA, 1162 bp, Zea mays
  misc_feature (1)..(100): optimal_loci_128775_G1, chr3:219186296..219187457, Cluster 6
caaatggtctcggatagagaaatattttaataatggagtccttgtaattaggggaggaataaatccccctgcacaatctcggagtagatttgagtccaaactaggcataattaaatcattgtcggttctctcgtgtatacgctgcccggccggaacaccaataaaaattaatacgtctgcaaccgccaataataatgttttgtgtactagtgtgggtggctaatttgttagccaaatacatctagctagttagccaataatagttcattgctagcagctagctagggatgtacgtacgcaccttaattttagatcaataggaaccaaatatgtatgggctaacagttttttagcttgttaatttttttagtctcttgactaatacagtagtaatttgtagtctttatttgaagaataatcggttgaccgagtagattcagttcatgtactatatatatacacgctagctacatacaggttgagtgattcattgattgataataaagaaagacttactactagtagtcaatcagatgacgattaaaaacaaaacgcgaggcagacacatgtggttaactaattgaggaagcggccaatggaaattagacaagaagggtaggacaatgttgcaatgtctgctagctagctctccagccagagccaagccaggtaattaacgtgatatatgacaagagagcgagaggaaaacaacaaggcacaacaaagaggctgccgaagaaacatgatccaaacagtgcatgggtcagtagacgtctaactaactgcagcctgcagacagcagtgcatattatatgtacgtacacaccaacgagaaacacccaagagtgagatttgcacattattactctctctctatatatatgtactactacaaaatgcacagtagtaagtttggcgcatgttgttgccatggacatggagagtttgcgcggcgcaggctagcttggaccccagataataataataattgtctgtacagtgtgcgccgcaggcaaagagacaagaggtcgagctgggtctgggtggagtgcaactgcagttgtcgttgaaaagggggctgtaaataaaataaaaaaagctttccccactattttacaaactgcgcgagtattttaaggcaacccttatcgcgatgttattg

SEQ ID NO: 893 - DNA, 1142 bp, Zea mays
  misc_feature (1)..(100): optimal_loci_128776_G1, chr3:219189329..219190470, Cluster 6
aatcagccaccaaaaaaccaaacctcacacaagtgatgccatcgagctaactagtagtaggatgttcttggtgatgactagagaacacaacggaatactcaccttagtggaaaatcgagcacaacaacaaagctctccaaaacgtgaaaacaagagtcatgcacttcaatcacaatgaagtaagagtctaactgaaaatcctctaagccaacaggggcggcttgaacaccgagaaaaagttcctaggcactattggaacccccaccgaaacaagcgaaagaaagagcaaatcaagggcaagctttggacaccctagaaaacaagcttcaacccatagatcacgtaactacaacgttggagtgcgaaacttcagtgttgtgcgaaagttatatttatcaatgtcctcaggtgtcagtcaccacggtcagtcatccaacttcttcagtctctcaattcaaatcttagctttcgtctttcaccactcttagtccatcggcatgctggacatcacaagccaaatagacatattacataaaaccatactcatgctaaggttacattaaactaaagcatatcatcttcttgacaattacttaccatatttgaacaccgtggcatatatcaacctcgtcattcttcgtcgcataagcacgtacggttggctatcatttgttggtttgcttgtaaaccgcatcatttttcaccatggaggagttagttattcgatgtgttctttgatttatgacgaaccgaacgatctagtcgtcctaactcgtgtatcactgcttgcgtcaacaaaaaaatgtcactcacctcaatgatactgctactggtgcattatggctgcagagtgcagagtaccatctcgatcaagtggactcctccgagtactggatctggattgcattggcatcatttagtcagggcggttaattaatgaggcgtcaagcaagcctggagaagcgacacgtaacggctctgaaattggcaagccatccctttcctttcctgcccgatggaggagcgtgcatcaaaaaaatccgagggggcgggcctccgccgagcatttggattcgtggaccacccccggacggccgtcggcgtcggtcggtccatccatttgccgtgtgcgagttatgcgg

SEQ ID NO: 894 - DNA, 1089 bp, Zea mays
  misc_feature (1)..(100): optimal_loci_129317_G1, chr3:221910396..221911484, Cluster 6
cacttgtcatattcaaagagttggtgttataaatgtgatcaatcagagcttgggagttgttttcaagtgtttaaatcaccaacgattgtagcatgtccttctactctaagtggcaacgcgacctggccatatacttgttttttctggttggccaatgtgacgaaagatgatatttgatgtaggtgtgtagtctgcagagttagtgggctttgatgcttttatgtttctggttgctagcaataattcataggccctgccttacatatctgatatattttttgctttccagcctttacactgtaaatctttctttcccgtggattcgtggaattatcttatttgatacagtgttctcctgctaaatatcttaatgtcagttgctaaacataacagcatccattgtgtactggtgttgacttctgcgcatggtgcgaagattcacttttgtatattttgttcctggaaacacaggggagagctgcttatcataataagaagaaacagtgctgcttggaaaatactagaaaatactagaaaatagtgttgctttggtctataagtttgaaactatattattgctatatggatgtgattcttacaattggatgagtataggaagcatatagagaaagatcctgccttggaaagaaggtttgaaccagttaaagttccagagcctactgttgatgaaacagtacagatcttaagaggacttcgtgagagatatgaactctatcacaaactgcgatacacagatgatgttggacgcatataccacttagaaccaactactatttgtccatttctttgtcatttttgacgaacttagcaaaatttctttgtttgtatgcaaaaaccctttcgtgagaactaactaagatgtcaaaatagtagttggttctcatgatgtcaaaaaaaaccctttcacgaacttagcaaaatgtcacacattggttctcattttttacaagcctagtgcatgcaaaacccttctcatcaattttctttgtttgttttgcagattgatcccatgatgtcagacaaacaccctgttaaagcaatgtgtgacatccgtgatttggggttatt

SEQ ID NO: 895 - DNA, 1241 bp, Zea mays
  misc_feature (1)..(100): optimal_loci_132358_G1, chr4:4732017..4733257, Cluster 6
gtcagagggtctatatagtgtggaacctcttagactagtgatccacgcaacacaacccttctagttcaacaatttctgtctctcgttttgcctaatggggcagtcaactcatgccagatgatattttgtcgatctcacaacagtctcaatcaagagcatgtgatctctgtcaatgcaaacccaggactctctcacaatgttgaacatagtgtgaaggaaattttgatacgaaattatgagtatcgctactggttcgaggatgagcaagtcaaccatgtcatccttaacatagttgggatacggtatcataaatagtaagatgttgtttggttcacatatttgtaacgtacaatgtaaccgataacgttaaatcatgtttgtttaagtacaaccgtaatcatataccacactagaaactgatatcgtcctattcaaacttgttaccacgggatattaattgtgaaccgttactattatcatttacgttacattttgtgaaccaaacgacacctaaggtttacttaattactattgatggtggtaaacttctgcaacgctggtgactcatagtcttcactaacatttgaacaaaaaagtagggttctaaatcaacaatctagtaagacagaagctcagtagaaatctgctccattctagaaaaaaaaaggccgctttcagccttgaagaaaaccgatagatcttagttttcctgaataaagtagtgatggatgagtcatatggccatcgcaatttattatggggacctgacatataacagcccagtactaccacccaaccaataatttcttcactaactttctcattcgttggtgaaggtactaactgctaccaatcaaaggactatcaaggttaacgccttaacggttaacctacacattggactattgaagcagaactgacagcacagtaaacctcaattcacgagcacaccctcaaatgaatcctgcatggttttcattcagtaaccaggctggagaatgctctgaacatgctgtggtttcgagatgaacgtctactacagtgatcacgaaccgacgaacagtttccagaaactgagactgaacccgcgatgctgaactgaattcatgctgttctcttcagccttgtaggacaccgaaagcgatggagacgactacgatgaggacgattatgatacgactactacccggacagcgatcagcgacttgtatcacttcaaacccccttgctcaccagcaccg

SEQ ID NO: 896 - DNA, 1141 bp, Zea mays
  misc_feature (1)..(100): optimal_loci_132417_G1, chr4:4838082..4839222, Cluster 6
agtatatcatggttcgttatcactagacatgtaacaccttaatccatctcttgaagatagtagagtaggggtagttttttcaaacaaaagagttgaattcattatttgatgcattcattttgggagtgtgatttttgtttgataaatagtttcaagaattatcttgataatactaatacttgttttgttaaggatgtcctatttctaaatacctcaagaacttcacgaagattttcagaacctatttttggagtatttggtcatgtgtagataaaaagaaaaagaaaagggattgtgctctcctgtgccttatccacatctcgatgtcgtcgtcatgccatcgccgtcgtggtcgtgcatctccggagcttccactctagtctcgaggccgctgatgtgatccccgaagctcgccgctgcttctccaaccttctctgagcttgctccgtccaccgatcgacctcaccgcgtcaccccgacttcaccggagttccacagtagtccaccattcgtcgttttccatcgttcttgccccttctaccccctcggtgaggactctaccgtgctcacttttctcttagctccatctcgagcccttccctagtcgcgttggccacccagagtgtcgttccaaccaactccagcgaggaatccggccgcgcgccgccgccgtacactgccttctccccgtcatcgccccctcggctcacggagccatgtgcatgaagccgagctgaaaccccctagccgttgatatccgatcgtgcggtcagttttgttaaagcccgagtcggctcgctcgatttaatatcggccctcggatttgatcgtgcggtcaccagtggccggtaccccttcatccgagccgcgtagccgcttttgcaaaaaaaaaaaaaaactgcattagtaattaagtactcgcatgtttttttgtagtttaaagatccttacaaacaggtcctaaaatttatgctttagcccatgtgcttttgtttatataaccatcatccgcgcccccaaatgtttttcacccgagccccttggttttcaaaatagaacccgcaagcccctaatcttttcagaaaagcccctagaacttaattttctgttgcatataggtccatgtagcattgttttttat

SEQ ID NO: 897 - DNA, 1254 bp, Zea mays
  misc_feature (1)..(100): optimal_loci_132563_G1, chr4:5414212..5415465, Cluster 6
ttttgatgtggtaacacatgattttgcctgctagctagggatcagatggacagacaggtcatggagcacttgtgcatgcactgggaatggagacggtttgcttgcccgcaataatctgcgaaaggcccaaagtcacatgccatccatcgagctccagctccagctggatcagaaccagatcctgctgtgacctcgaccgacctgaacagtgcagtatgctggggcaggggggcattagaaacttgaaactgaaagacgggcccggccgttctctgaatctccggcccaaacgcacttgcagggactttccatagaatcccccacccacccacacacacacaaaaaacccagagctagtgataggagactgtttaatttgggcattatatatattgatatgttaaaacgtttgaactttatttcagggcactatgttcctcagctatcccagcttgtgtacaggaggaacatcggtgtagagtgtagacaagcctatcattaacttcaaaggtttcatggtagagatagctagcatatgcatgatcatcaaaaactgatgaaattcacacgaacattagttcccatttcatcattcagaacctgacgagtcaaatggtttggaaatggaaaagaatccaccatgaacgtatatattggtatactgatccattattccaatcgttccaggtcggcaacggcctgaccgacgaccgcaccgacatgacgggcatgttcgagtacttgtggcaccacggcctcacctccgacgagaccctggtgagcgctggaggcgtgcccggggacctccctgatccacccctcgccggcgtgcaaggaggtgtgggacgtggccaccagggagcaaggcaaacatcgacggctacagcatctacacgccgcgcgccgtgcgagaagggaaccccgtacgcgtacgagcgcatcttcgaaaaaggagccgccgcgtaagccgttcaaccgttcttcttggtctccggccatcatcagtcgttctgatagctctactctctctctctttctcaccatgattggaacacacgtagcacgttctctcgtacgttcagccactgacgaaggctgccccgtacgatacatgcaccgccttctactccaccagctacatgaacctacccgacgtgcagaaggccatgcatgccaacgccagcggcttcaaagaatacccatggcactatgcaggtatggcttcatttaatttcctttcgtccataacatggc

SEQ ID NO: 898 - DNA, 1297 bp, Zea mays
  misc_feature (1)..(100): optimal_loci_132901_G1, chr4:6834121..6835417, Cluster 6
  modified_base (733)..(733): a, c, g, or t
  misc_feature (733)..(832): n is a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
  modified_base (745)..(745): a, c, g, or t
  modified_base (746)..(746): a, c, g, or t
  modified_base (747)..(747): a, c, g, or t
  modified_base (748)..(748): a, c, g, or t
  modified_base (749)..(749): a, c, g, or t
  modified_base (750)..(750): a, c, g, or t
  modified_base (751)..(751): a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
  modified_base (771)..(771): a, c, g, or t
  modified_base (772)..(772): a, c, g, or t
  modified_base (773)..(773): a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
  modified_base (787)..(787): a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
cgtctagcatcagttgagctgggatctctagcccctgctttgcacatggttgtcgtagtataccaataattaatgacatatataaatagtaaaataaattaatcaactatgtgactaattaatcacattcatcacaataactagggtatgtacaacctcatttaagtatagagtctcttaggaggtctataaggggttaattcaaaagccacaagagacatgctctttgccgaagagagagccgattctccatacatattgtctggaaagtatttgtgatctgaagtttcaaagtttatcatgtagtctgttagtgattttcggggcttcgaatacagattgaaggtctctggattggacaggtacatattagtaaggagtacaccagtcattaagggcgacatagagcttcagattaaatttagaaccataactgcagggatagtcagcctattgcatgttcgcaaatgagctagcgagatcagacaggtggtaactaagattctgcacatgttgacgaggtagcacacatttgtcaagtatttcagctaatgtgggggtagagcgtaattccatgagaaaggagaaagtggatcctggaaaaaagcccatccgcaaccatgatacaaggggcttccaccatttgtagtaacatggtatatgcatccctgggcagtgaatattccccacacacgccccggccactcatggcatggcttcacttctgatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatattcatgcagagtgttaagtgattttttatttctaagaaccagatcaaaagtgctagagtggtacatgtgtttatattatgagagttccaccagtcatctaatggcggcatggttatcagattaaatgagaacaataccgatggattcgttggaataagttaatcccatttctgaagtagtgtcagcagaggatttataaactagtatcatgtacatgttgggttagtcagcacgcctttcgcaaggctctcaactagtcgatgtgtagcttgcagttccacgataagttatactgttgatacatctaaaaaaaacagaagaacaaccagcctacaaaggggacttaggtcatttttagtggacattttataagaatttcattctcattaaataatataccacatacgcaagcaggatgccatgacatgagatttaataaaaaaaagatatgagatcatttt

SEQ ID NO: 899 - DNA, 1296 bp, Zea mays
  misc_feature (1)..(100): optimal_loci_133801_G1, chr4:11260073..11261368, Cluster 6
tccagcgctcgtacatcgtagcttggtaggaatactttctattcttaataatgaaatatatataataaaaaaaccatcagctagcacaaaacagagatttgattctcagtggaactcgcttcacggatggaaacacaaaacgtgttgttgtgaaacgaaacgaacctgcctctgtctttgcaagtacaccttttgtagcgacgcggcgttgcagacgaagcaaaaacagaagagacgtgggcgcgccgcgcgcacgtcgtgatcgtgacacgacaccaccgtgggcgcggcggacaaaggatgcacgggcgtcccctctcttcaaagtacacaacacaatcgcttgagcacgtagggctctgctctacagcctaccaggccctctctttcctataggccgtggttgccacttgctttaacacactcatgcaactcaaggtttataaaaccgaccggttttggcagtaacccatcggtttaccgaaaccgacgggacacggtttcgggacacggtttcagttaaccccggttttttttaaaattcaccacaatattcataaaaatgaaaaccatcggtaaaccatttttgaccggtaaaccatcattttaaatcggtaaaccacatattttgttgggaaaccagatttaatgccaagattgagatccagtttatgcatttagtggtcaatttaggtatattagtcttgtttattgttatatgctatatatgaagatgttatatgccatgtgtaaagatgagttagtattgttatatatgccatggcttatggtttatgtattagttattgataaatgtgttatggcttaaggtttagttagtattggccccaaatgagctattttttagttattgttatatgactcgagatgaatatatgagtattgtaaaacaagttgacctatgtgtcgttggagagctgtaaaagaacttgtatctgagtattgcgaagtttgttggttgtttgttgcatgagaactggagtttgtggttacatatgtatgttgtatgttattttggtgaacatatgtcgtgtggatcaattaatatttactttgcaatgtgaattgagcatattacaaataaatctctttcaaaattttccattttttctgtaaaaaacagcaaaaacgggtttgtttcgtggaaaaacggcggtttagagcggtttaccgctggtttttcgtcggtaaaccggtacaaattcaaattggtttggattgtccaaaccaggtggtttttatcggttttcaccggtttaccggcgataaacagtt

SEQ ID NO: 900 - DNA, 1052 bp, Zea mays
  misc_feature (1)..(100): optimal_loci_134904_G1, chr4:16377783..16378834, Cluster 6
gccaactttaatccgaagctaacagcctgctttgaacgttatgggacaaaatgtggcaatttatttaattcatagtcacgcatattgagtttcttttttttggttttatcatattacgtatgaagattttgactagaaccaaccttgcatcggatactaggtccggcactagtccattcacgtcggccacggcctgctagctagctgtagcatccacgaaaggagcacacactttaactttctttccaagctatttgtgcaacaaaaaaatgtttttcgtatactatgtatgtgttctcgcgtgtatgtgtatatattaccagtatagcacagtagcactacatatttttttgtcagcatttctctataaacatactcctttagagctgatttggtgattgggatcctttgagaaaaaatcctcttgctattcaaaattaaattgaaaggagatttctccccatggatcccctcgggatccctaataaccaaattagcccttatagagctgaattgtttgtattggaggcaaaacttttgctcctctcgtaccgtaacgcacggcgcaatcgctcggcttttgtcagttggatcggtaacacacgaagaaagcgacgcaggcaagaaagacggtgaaaggaaagggcaggcaaaagacgagagagaaggtaaagcgatcaccatcatagtgctgctgctactgctctctctctctctctccctactctactccctagcttaataaagccgccgtccgataaattaaccgttggttcagctcgaaattattgtgaacttctcgtgtgtctatatatatgcatgatagtgaaagatctcgcgtaatcgtcgtcggtatcagggcgtgattattagggtcacctgtgttgttgtaataatgggcgtacgctagctagctcgtaatgattctgtcagaattgtgagcgcgagtctactaggattaagtggctcggaataatccgtgtagttcatgttgccagccccccttgccgggtccgataagcattgccccaactagagtaaatgctgacaga

SEQ ID NO: 901 - DNA, 1009 bp, Zea mays
  misc_feature (1)..(100): optimal_loci_1354_G1, chr1:7047536..7048544, Cluster 6
aatttgttcatagggatagccttgaggcgtatgaaactgacgagtgtacatctatttatacgctttgtgcttagtatctctttctctccaccactagttatgcaggtcaataccagtaccatgtcgaggaataccaggttgttgtgactgtgacaagctacttaaaaaagcctcactgctctacatgagcagaaggcaacttaacgcatatgagatgtgagcacaatgccgttaaattctggaatattcgcttccacatgggtcaaacccagtaccctttgctagtaaataaaacagctctggcttggtagaccgtagaccaaaagaaaaaaaatgggtggattgaaaacaagatttcgagcagaaccatgtaaagaaaactgagttttgagagaattctggggagagcgtagattttgttacaaaactctggccagactaaagttctatgcgtaaatgatcttgaaaaaacgcagcatgttttttaagtatcccaaccacaggattcgatgctttaatagagatttttatgggtgctagttaaagaactactgtgcaaggaccacgagaaaaatcatcgaggttgatttttttataataaaaaacgaataaaatacctgtttagaggacaacaagaaagtcattcaggatgcatttgccttaaagtgaggttaacaataacctagaatcttggttttagatggggagatcacgatgagtgcagctatatgcaaacacaaggcctaaagaaaaagggttaagataacatatgtgcaaggggaaacaagcactccagggggctgcgccacaaaaaaaagaggggtcaagggcatatctgcaagaaaaaaaatgcgacatgggggtggtatatgaatgcgcaagaagttttttaaagacagcacaagccagaaggggcataccgcatccacgtaaggctaacgcggccagggatcaatgcgtaaaatctcaaacaaaatttggacggccagggatcagtgcgtaaaaactc

SEQ ID NO: 902 - DNA, 1062 bp, Zea mays
  misc_feature (1)..(100): optimal_loci_1362_G1, chr1:7072217..7073278, Cluster 6
aggaggcgagcgccctaatcctcctcgccggtagtggtgcagcagcggaagaagctggcggaggttgttgtgaaatggacgaggtttgttgctacagcgtcagctgcgagaacgttgttgttcaaacaaataggatatgatgagatatgaactgagatcacatgttgatttttgaaaaaatacaaggtttattttttaaaaagacgatgtggtagtacagttaaaactggtggtttaatatagttgagactactatgtgatcatcattatcgtttctgttccgtgtccatcaaggggaaatagcagccgatgcatgcgttccagggagcattcggcctgacgagggccaggccaggccagcagctggagaccacactccccacagttacccccaccacgtccccaccgctgcggctacttgagcacagtagccaaaaagctgcctgccctggaccgcaggaagaggatggagtgggcatcgatcggatcggatgccaccgacacacacactctctctctgtctcctacaccactccacactgtcattgtttaaccatgcacgcccgtttcctgttttgcttcagcgggaagcatccacttccacctccaggaacgaagaagatgcgtttccgtgactcacgatttccaagaaccctcttcgttttggaagcgaacagagagtgtggtgtcacgttaaaaccatatgttcggacttaaccttcttcgttttggaagcgaacagagagtgtagtagtgtcacgttaaaaccatcgactgtgtagaaacagtaaaaattaatcaagcaaccaaacacgaaagtgatcagactgacagtcaccggccccaccaggaaattccacccaaacgaggaaacaaaagaacatattcggatattccatccctgactcaaggtttccaagaatcttcttcctcttttagaaaaagattttttttgttcgtttaggaaacgaacagactagaaagctgcacgcaggaattccccaacaattttggccactgaaatgggaccacgactccccgagactcactccaccgttttca

SEQ ID NO: 903 - DNA, 1329 bp, Zea mays
  misc_feature (1)..(100): optimal_loci_138738_G1, chr4:37727784..37729112, Cluster 6
ctggagcgaaaatgtccgtcctaagattgttaagaatttgcccgagcaaaggttaatgtggcgagtttggtctaatttggtacttaatcgtctaacaagcaaatcttatagagattagcattatacatttcactggtaggtttgtgaggcaaaatgttctccttaaataagatgcacttggtgctagttggcaaaaaaatatatctggccgggcggtggttttcttaatgaaataagggggtttttttggcgcgggaaaagaccgaggaggatttttttttcaccccccttttcaaaaggtaatgtgtcatgcaaatttaattggtgttttccaatggggaatttttgggggggggggggggggggttcatgacgtaaaaaacatgatgacattgccagaaaagataaaaggataagaaaaattgatttgattatgttttggtatgagacaggaaaaagaaaacgattatatttttctatattgaatctatcttgcatatgggtatggtttcacttttaggtgcctgaccgtagaggagaatgtatgatttcggagcacccttttactaatatgatttcaaacatgccaatgcaggaccaattgtatctttactggattcaagcaatattagcatattaatacattgactcataacaaattttattgtgaacatccattcaacaatattttagaagtaataatctcaaccatacattcaggtcatccatacatgatacatccaactcagccatccatatacgaacagtgccaaaaaccggagcaaattacattttttattgaatcaatatactaagtaatagtagcagcaagctatattaaataaaatgcaatgagctaaggctaacacggaggtacattaatccagtatgactgtgtgtgcatgatctccagatcttcgtggtcgtgaacctgaccaacctccatagtctgcttctggacatcatagatgcatagatccctatgaccagctactaagtggaccagaaagtagagggtgctccctcttgggttattggtgcatgcatagcaccaagttgccatgttggtgcccgtcaagaggaaaaccctgtccccaacatcatccaccaggtgccaggccacaagttcctcgtcaccacaagttttctccatcttgaagatacgagctgagctaatgttggtaggatcgaaatccatgtataagtagcagatagccaaaagctcgtccatggactctaccaagtggatggaggcagcacaaatgccctcgggaatgaggtcgaactctgcatgataccgtcgccacttttggtgttcaattacgtgca

SEQ ID NO: 904 - DNA, 1348 bp, Zea mays
  misc_feature (1)..(100): optimal_loci_139557_G1, chr4:43164295..43165642, Cluster 6
taacgtacggggccattcagtcgagcttcaccaaccttttcgaccaaacgatcaaaactcaagtagctatagctttatctgaggagctcggctgcactcgagaggaggagctggagagggaaaaatggatcggggctcctttctttggtcggacgactcggacctaggagcagtgtgtggctgttttcgcatcttgaattgcctaggtgatgtgagaagggcagctgcgtgtttatggtgtcgggataaccggataaggtagagagacagagagggcaagggcaaattttgggaggctccatcctcatacacattttagtcctttggatatacgtaaagtagtagaagaagagaagataggtggacgtgctcctcctacactaatccattcatcatcacattactaaaaagtcgctaatccatccatcatcacatcacataagtttatctccattcacaagtaatacaagtctcttcattaggaactttggcattaaaataaattatgagttaactcgttttcataagcttcatgtggattgccatcgtatttccttctccatgttgatttcttatgttcctttcacttagcactatgcaagtaacatatggttacataaagagcatggttgcatacacagccaaagcaacaactagcaatctgaataaacagttcagagctcagtgcacacattcaactcaaaatagcaattggacacatatatgatgttatatgccccaggtgaccgaaacattggccataggaccgcaaacaacactttctaatgaggcacaacgaagatagcaatatggccatcctctttttaataggacatgcatctctcttgtattcttagaatataatcaacaatgtcatcattataaatgtttggggtgtaattaaggtttaaggtggagcatatcgaagtgacgaagtggactgaaatggtatggaggtggagcgaagtggactgaaatggtatggaggtggagcagatctgagtggcgtcttcctattctcgatattgagggcagaacactttttatactttcagcggcattagtacaaattaagggcctatttagatagactaaaataattattgcatggttaatggacacctgattctgctattccataggagtatgaaagcattgggttctctctgtactagagttccgttgtagagatacctagactagataatatataaatgttcatagtacaatttccaactgatgaatatactgagaaacaattcttgataatagaataattgtactattatgtgaaaatagacttggacatacatctttgcaacaaaaccaccgaggcgacagaaacagg

SEQ ID NO: 905 - DNA, 1138 bp, Zea mays
  misc_feature (1)..(100): optimal_loci_157993_G1, chr4:162864429..162865566, Cluster 6
ccgctggcagagcggcagtggcaggtggtttggttggtccgctgcttcgacggcgacggcggtctggcggcgccggcgaccatgcaatgataggggttggggatctggatacgcgcacacgcacaacgtggagaaggaagaaccgacgtgtttttcttccccctttcccaccgggcaactaattttggaatgagaatatgggtgaatattgcagtgacatagacatactggcatcgcatcgcaagatgctgaaacggagatgagaacactgcatatcatcggttcagccggcaccgtagaagaatcttcctatcctaaaaaaacgtgccgtggatagcgtgagactttccaggtctcgccagcctccccactctagaatttcgcttacgagtcggcccccgactgacctgactacctgagacgaatccatatcatgttttaatttaaagtttgtttgatctacagattattgagatgatgtattatttaagttgtatggttgtacgtatgaaaatacaaaaggccggaatgatatttccacctccaaaaaatatcaaggaggaatgtcggtgtcatggccagcgaccaaccagactggctcaatccgacggcgcccagccaaagtcaagactcaaagagcaccgggctaccggcggcagcaacgagaccggcgtgggcggtgggaccgacgacaagcatgagaaaacggcaaaacgccattcacaatgtgcgggtggtggttcgcatggcatgtgcctcgtgtggcgtccgaacatgtttgtcgacgcgacgaagatgagtgcgtgtggagtgtggacagccaccgaactctgcgttttttctacgcccgcccgtgactagcgctctgctcgtgttttccgttaacacgaaggcacagaaagcacaacaaacgacgtgcccgtggatgctcatgagtcgtgactgaaaataacgatagactagaatgaaatggaaagaatagatgttcgtcataaagttggggataaatattggctgttaaatttagattaaatatatgttattttttcttcttctaaaataacttatagcgacggtcaggacgacaatctagttcatataatgattcagcttaaatagcttaagaggcaaacaaact

SEQ ID NO: 906 - DNA, 1093 bp, Zea mays
  misc_feature (1)..(100): optimal_loci_158148_G1, chr4:164095030..164096122, Cluster 6
aaggtggaatatatatatggaagggatagggactccgagacttgacaatcaaacgtacgagcgcacaacgggagccatactgcgtacgtgcgtatggtaactagtctagtaacaattggcgtggcgtaaggggtcctgtaccgctgcatgcatggctacaggcatgtatttcgtcacgacgcagacgcaggctgtacgtgcagccgtgccgaaacaaaaatagacctgacctcacgcggtcgtgcgcacagtagagagagagtgtgtgtggcagcatagggaaggagctagggttgagagagagagctcacaaaacaaggcgagctgcggtattcagttctcgaaacagcagcgagcgggggcatgcactggagcaggggaaacggaaccaagaaggccggcctgccgatactgcgacgcatgcatgcatggcaggatgcacagcatgcaggtctcagcagcagccagaatagattaagtgggtggtgtttgtttctacttctacccaactaaaatttagtttctgccctcatcggaatattttataataattatagatactaaatatattctaattatagtaaaataattacgcagacaaagattagagaagacgcgactaaatttattaaacttaactaaacatatatttgatacgtatacttgatattcaaatatttaatataggacacgatctaaataaacaaactttagcaagagtgaaactccaaataggaatcggatccgaagacgaagacggtgtatatatggagagagaaaaaaaactctagttttggaaatcctgcatggatcggacatggccgccgccgccaccgccaccgccgccgccagaattagtagagcggaaaagctgcgcgatcgccggcacttgatgacgcgcatgcatgggtgtcgcaatccatggcattttcacgtaggtccagagtctgaaacacatgcgccgccgccgccgaccgtcgccgtcttccctcccgtcggaagccacgcgaacacctcacctcacctacaggttattataggctgtagtaacagcgacaacgaaggctttagaggtcgacaaataatagtgatg

SEQ ID NO: 907 - DNA, 1036 bp, Zea mays
  misc_feature (1)..(100): optimal_loci_159036_G1, chr4:169413572..169414607, Cluster 6
gcaggagtgagctcggcgtttcccgctaaaactaagcgaaaatcgattgcgaagtggccaaaacctcccgagaaaatcgaatttcaagatttcaaatttgaaaaatccaaattgtttgggatttatgaaattcgacgaatttcgagcagttttttttgtcttcgaggagtaccaaaaaatattttcctatatattaatgtggggctcaaacgtgcgattccacacgtcaacatcagccaacaaaacactgttcattcgatattacatccacagttgggaatcaatgcaccaaagcgcaaggctgctcgccgtcgtagatggacttggagtcttcccgatggacagatggcttccacttgcccgctatgaaacaaaaaatactccagacaattttcccattgctcgcgaggggacgacacctccagcgcacgtttcacaatctcgctcgataaccgccggttacctaggaaattttttgttctcgatgttcactggattcgggtcccgcctgcaaatttcgaatggtccgttcaaaaaatcataagatcagaaaaaaaatctataaaaactagagggtctgagagttccaaaagtatatttgttgttgaaaaggtcatcttttggtgcgaaaaaataaatatatttagacctgttcacaacggcaggaacaacagcgcacccgtcgtcgagactcgggcgtttctcgacgggaaccaccatttcccgctccatatttattattgcagttgcagttccaatgtttgctgctgcaggttacaattgctgaatgtgcccacgccacacacatctagatcggacaatccacattgcttagggtccaccacgcttcgaagcgacgatgaagtagtgagctcagcgtttcctggtaaaaactgagcgaaaaccgattgagaagtggtgaaaaccgcttgagaaaaccgaattacgagatttcaaattcgaaaaatccaaaccgttcaggatttacgaaattttatgaatctcgagcggttagaggagcaccgggcgacctacc

SEQ ID NO: 908 - DNA, 1317 bp, Zea mays
  misc_feature (1)..(100): optimal_loci_160000_G1, chr4:175222157..175223473, Cluster 6
cgacgtctgcgggccgatgatggcctgcacctgctcgttcttgatcaggtccaccgctgcaaacaaaccaaaaaaaacgaaacaaaagctttctgttcaggagtcgctaatggttatggagcagaagcccataaacatctcggccgaaaacataatctggcccctagatcatcatcaaggcgttgaggggaaaaaagaaaaagatttggttcggcatctctgcaattgcagaacgcaaacctaacccatccagttggtccctgactcccttccctagacaacgacgacaacaacaaaaaataaaaaaatgcttatatatgttgatgatcagattagtagttcatcgaagttttccgttgttatttggaatcactgtcgctatcagagtataggcggatctctggcacctcacctgctcccgtacttggattggactgaagtcgtctgtgcagtgcgtgaatgtttgaaggtttggacagtgactcactcgctggagtcagtctggaccatgtcgctcgcttgcctcggtgacggactgacggcgacggaacagcaggacaggagctagctagacatgcgtggaggtgcatgcactagctagtcctgccaagtcggtctgtctgactgtctctaacagtataatacaataaaacaaaagaaaaacttatcgcgtcgacggccggctgacacgtatggagtatcttgtgatcgaaatctacttgcgtttatttatttttttgtttgtttgtcctaactgctaagggaagacgaccatggcatggatcgagtagttgggccggtcagctagacgaccctcgcgctgtacgtacgtgtacgtacgtacaagcacacacccatcaaagctcgaaagcaactggatagccgattacaacttccgagacggcggcgctcgctcgcacgcagcgcctatatatgtcttaccggcggaagcggcgccgacgacgtccccggcggagtcccggaagctgagcacgaccctggtcctggacgcggcgggccgcgcggcgtagtagtcccccacggccatctcaatgcccaccttccgccgctgcccgaccgccgacgtcaggttgaggatgacgcccacgcgcaccggcgccggctgcgcctgcgcctgcgccgcgcccaccggcaggctcgcctggcaccagcaccaggccagcagcgcggccgccagaacgagccccccgcggcggcggagggaggaggaggaggatgagggcgagtggtggcgcagcagcctccgtcccatttcaacttactacttactgctcagcagccgcggcggctagcgag

SEQ ID NO: 909 - DNA, 1030 bp, Zea mays
  misc_feature (1)..(100): optimal_loci_160010_G1, chr4:175272468..175273497, Cluster 6
cgcatgggaatcccgaggcggcgtttatctatcgcggaggccgagatccacgtgccgcgtgagaccgcagttaatatgtttctgtgaatctcgatgctgcatggaggccgtggcgtaactagtagccggatttctaccgtgccgtgccgtgcgggtgaaatcacgagccagcgtccaaaatgccaaatcactggctcggctaccgagccgctgtacattcgctgaaacctcatgctactattttcttttgtctgccgtcacggactcactgcgacgtgggacccaaagaccaggcggagatgacaaacgtgagcggcagccggcaggcagatgttgcagcactacagcggcgcgcgccgggtttttattattataataccgtatctaaaattaccgctttgtaatatactaatagatgaattgaagtttaaaacaaaaggtggaatatgagttgccaatgtgggataagggagccgcttgagatagcgttactaacgcatagccggaatgtactgcatgttcaccgtacttatggctcgcatcgtcactgttttgtgtttcttttcgctctgatccagctcatcgtctataaaaaacactcgtccctctcgttgccccgacccgacctccgcctctgcctgctcctcccgctttcctcccagctcccatccccgcaagcccaaacgcgacgcgacgcaacgccacgcgaacgtgacgggagcgagccacccgaatccaccagaccacgcgcagccgtcacgcccgggcgcttctccccccccgaccccgtcctcccgtttggcgtctctctctctccgtcgcgcgcgccacgcgaacggcacctaggcaagggggcgcgatgaggccgggcgggccgccgaactcgcgggcgctgcagcagccgggcacgccggggcgggtcgcgccggcgcccggatctcacgctgccgctgccgcagcgcgacctggtctccctcgccgtgcccctgccaactggggcggcggcggctggattcatctctctcctcac

SEQ ID NO: 910 - DNA, 1072 bp, Zea mays
  misc_feature (1)..(100): optimal_loci_160028_G1, chr4:175373804..175374875, Cluster 6
ggtctgcatgttttgtgtgttgacttgaaccacgagaaaacagttattgtggaaaaagcaggagctagatggaagacctttgggtgctgtttggttcacgaaatgtaacgcaaatggtaatagtttacacttgattactggcagtaacaagtttgaataggcatacaggagttagatgcaagaactttgagtgctgtttggttcacgaaatgtaacacaaatggtaatagtttacacttgattaacggcggtaacaagtttaaataggccggtatcattttttagtgtgctatctgattacggttgaataaaaaaacatgatttaacgttatcagttattcattacgttataaatatgtgaaccaaacgacacatttctttaccgattttataagtaaatgtgactgaatgaaggggggggggggggggggggggttcagggtacaacatgagaacaggcttatgagtagtctaggactggacactaatctatgggggtgctcagatcattttgtcgtagcctgaaactccacaaacgcgcctcatctttggcttggcgtcggaggcgaagaactgaaggcgtattgttgtggaagacgacttcattcctgtgtttccatattgcccagcagcataagtggatgaaactgtggtggtgatcaagggagattgtagggggggagtgatctcggaggggcaagtggccgagtgagagtcttcaatatgtacgccaaggctgctccagaatgcgttggctgttgggcatctgaacaaaatgtgatctgagtcttcatcagctgagcgacatacatacctcgcaggttgcattggttacaatcttttttttcttgagcaggttttgcttgtggtgaatcctgttttggacgagggtccagatgaagactttcacctttgggagtgagaaggggcgctacatatcttggcgagttggatgaggctgaactttggagaattctgtacaggagccccgttttcatatttccatcaggctcaaacagtctgtcaggtttactgaactgatgagatgttgtagctccacaagctcgctggt

SEQ ID NO: 911 - DNA, 1098 bp, Zea mays
  misc_feature (1)..(100): optimal_loci_160368_G1, chr4:177307561..177308658, Cluster 6
tagaggctcagaacaagctagtcaaagcccgaaaggtacgtgttattattaatctcttatttactttgaccttgctgcatcacctctcaacaggcaacgcttatacctggcctaatgctggatagaatctccaaccatggcagccttacctccatgaccttgttgcatcatcacctctcaacggggttccggtggacggttcctcaacactaagcagcaacagcagtctcacactgctcccagcaggtccaccacaaatgacacaagctcctcaggttcattcaactcgtctacggcttggtggtggcgcagctggagatcgatctattctggcactgcacccaaaacaatggcctcgccgcctcgcaagatagtagcaagaaggctctttcttcatcagctcttgccttcactgtgactccagtgtcgcgcagagatgacgccttcttgtatcacccaggccaatctcagtttctctggaaatttcgggcagacaagcgcgcaagctgggatgcgtaatggaagtcagcatagggttctagttatgagatgacggtctgtgggccatgcatagctggtaatccaggcttttaggatcctagtgtccggtgaccggtgtggtttgtcttttatgttctgtttggattttaatattggaggacatgaaattgaattagatttaatgctaaattaatcttaaaattgaaatgagttgtaattccgattctattgtttggatgttactgaattggagtttagaattgtgagatttaattccacacaattcaaaagggtggtgctcattattaggaggggaagtttatagttatagtccaattttctggtaaattgggtccccgattctcgatcttaattccacaagcagctaaacaacataatgtaggaaagtttattccaatttctaattccgtgctctaatacttacatccaaacggggtattacacaattcatccttggcttagtttctggcttgttaccaaatgtgtcgtccacagaagagtgcaactatatattatccgtgtcagttactaactcatatttgaccaaatttacagtatattatgccctaaataata

SEQ ID NO: 912 - DNA, 1381 bp, Zea mays
  misc_feature (1)..(100): optimal_loci_160644_G1, chr4:178822758..178824138, Cluster 6
tggttcgagccggcgaatcttgcacgatgcaacgttgcgggtcgtcacgactcacactcacgaggaagcacgtacgtatgcatgttttggacagcaaccctacaaattccacgccaccagtatacaatttattcaggcggcgtttggtttcacccaaattctaagaattaatccagatattctcgagaggttcttgctaaccatagtgtttggatctatggattttttgcatcggataatgtgacaactcttcaatatctcctattatcaagcatgaaagagattgttggattttgctttggataaaagtgccacctctagtctgcattacctcacacagtacggaggccgtgccagctgtgcacaagcacatggcccctaaattgacggggcctccactttttttcctttgaccattaacaaacagtaagtagatgtaaagatcacggctgcttttgacctgttcatccgtctcataccatggtgattagattagaatacaattacaatgaaccgtcatcgtttgggattaacgtgtttctctagaacatgaggtcaacactgtgtttgctcttttagcattggtatatgatatgaaacaatacatatctaagttatttgagtgagtgaaaacatgtcttagctatactatacatatagattttcatatatattttgggtctcttgtcgagttcgctccgaggccccatatttctgaagaccgccctaacctcacatgcccaaaatatgttggtactaaacaaggccttaacctagtagacaacttatttatgtaaaatcgattgttctggtatgaagagcttgtttggaagaaaaacatttctatattttctgggcaattccatgtttttaataataatagagtattttatgccatgagttctttggttgcatttctaaaagctatgttttaaaactttgatattctaaataccatgatatttttggagtattttaaactccactccaaccccaagttttcatggcatggctatcttttgcctaaataccatggtttataatgttttatccaaacattaggtagtattcttggaggtgaccaaaactatggtattaacatgacaattgcaaagtatagtattgtaaaaccatggttttaagaaatattgttgccaaacatgcccgaattgttggacattggtcacagtttaccacgttacagttatagttgtagtggaaatatgtccctactaatgtggagaacgtaataagtgtgaaacaacatcacacatgattcgaacatattctcattcacggggttgatctgttctctatcacattattgaaaggagatgtacacgattcaacatagcgaagggacaacaaacatacatggcaa

SEQ ID NO: 913 - DNA, 1010 bp, Zea mays
  misc_feature (1)..(100): optimal_loci_161527_G1, chr4:185314220..185315229, Cluster 6
gtacagacgggaacatctgcatcattgacatcggcaaacactagccagtcaactttaataatatggagtatgtatactaatctattaaaaacataatgtaggcatttggtgctactatgctgcatcctcccccgtgacactctggactcaccccacgcgtcccacctgatccccgtccacgcagctaccatgagatcagacgtaccttagtacctataattatatttagataattaacttagtacctataataatatttaaaactaaacaataattatatttagataaatatcttagtacctatttatacaatatataaaaaacgtagtaaatcacaggaaagtgttaaaactttaaggacagattaaagtgtgccaggagccaggagggtagctgtgaggactgaggagccgtcccctactgagctttttcaatttgtcggaggacaagctctcaggcttcttcatccatgtccacaaccgtctctacctccaatcaagacgtcgtatatatatactcatatacttataaataaaagtatcatttcgataatactttttatttttattctttgtcgctagaacaccctggtccttaacatcctgcgagggtaaaggcgcagcgatccccacacctaatgaaaggcgaggctgcattcaatcagctgggatcgagtgggtgagagccagtcccctccattcatgtcaacctcatcatctttctcttgcggcaggcaaccagacacagccacggcactggccagcctctgggcggcttcagcactggcatgtttcttgtgagttctgacggccgcggcgggtgccggcggtcgggcgtggccggagccataaattgtggcttgtccaggtgactgatatactatactgtagattacagcggccggtagctagctctagctgtatggggtggttgtggttttaaaggcgttttttgcttgcttgtgatctaaacagccctagctgcactttagagtacgagatccaacagtg

SEQ ID NO: 914 - DNA, 1019 bp, Zea mays
  misc_feature (1)..(100): optimal_loci_161875_G1, chr4:187049147..187050165, Cluster 6
tcgagtccaccggcaacaacaaaacatttcacgagccattggccaagttacttttccaaagcaactactatttatatcttaaccatcgttttgttttcttcttctgcgcaagtaaaagagcgaagcgaatttcgggtcgggtgcgggcgaccctgttggatgaaatagaaaccccgcatccacgcccgtgaaacctcggattcagggcgcaccccacgggtggaaaaaaaatcttcacctacacccacacgtctatcgtgtcgtcggataaccggtcaggttttcggtttagggttaagtacgtgaccatccatttgttttggaaagagggggaggggagcccaccagccccccaccctcaacgcaagggtacgtaactggtccatggtgaaacgtacggtgaccttgcgaagtctgagtgtggcccggcccattgctattccagtagtggcagagtaggaaaagtctcgccaaagctgaggagctgaactatactcttggttttaaaataaaattcgagaaatagataggaaaaggaaaagacctgtggcctggcctgtccagatgtgacacctcctcgcgtcctgccctgccctggcctggccctctgcatgatgccagcaagcagcagcccggccagggttgatgcatgcagccagcggcgggacgcctgcctgcgcgatcgcatcgtcagctgcagcctctgctccgaattattggttcgttaatcggccagacctgggacttgttagcagctttactgcacgaacggtttttagtgctggtcaaaaacttttgtatctctaaatgactttatttctgtaaaaatatatccagcgctactaattactaattcaacgtagtaaacaaaagcattgatatgtatatttggtgaaagtttagggtcccgtttatttccccttgcttaagtttagctcctagtaaaccaaacaatctgttatgctaaagtttaacacccattaacactctagggagtgtttagtttgagatcaaagtag

SEQ ID NO: 915 - DNA, 1136 bp, Zea mays
  misc_feature (1)..(100): optimal_loci_162150_G1, chr4:188516749..188517884, Cluster 6
atgacgtttattgctcatgtatataaaaatacacctgcaacaaattatgtgctcaacacattgatagccctgctcgctacaccttttcttttctctctcatgtagtcatgtttcatacgaccagtgggggactcgcaactcgcaagtgcaagagagtcctgctttcaccagaaccactccctggtattcttctaggagatgagcatcgtctatatgccaggtatctgatcaggaaagcttgtctttgcagaaggtgatgatggtgaatcctttcatggctcgatttatggatcttagggttaggtttgcttaggatttaggagttttattaaaaaatgaataattgaagttcaatttcctcttcttcaacttgttgtaggagatatcgatcagatttgagctgatttggagatttggcacatgtatgtcctaaatctcgaaggatttaggttctaatgttagagtataggtgcaaaacctcgactctgatatcaccattaggccatctccaacgtcgcccctacccctcccccaccccacgtagagtgtgatttcggggtgaaaatcccctccaaccgtcccttccatagcccacctcatgtgggggagagagactgctcccccacatatggaggatttctaatctcctctcactttagttacttcattctttgtgatattaacctttttaagtaccataacttgataaaaatgtgtattatggtagtacgaatagtctataattttttaacttgaaaaattgatgaaaaaatatcaaataattgaactataatatatagctagggggagttggataagattaatggttggaaacgtcgtggatgtgagggtatcttttgaggtgatatagtaaaatataatagaaaatatagatagtaggaaaaatatggagggaatggttggagatggaaatgcgtatgatattcccttgcctaaaaccttgaatttagagtagagagagaaattacctttgggtttgtaggaggcggctctaggtggagaagaactacttgtcacttgctacaatctagattagcttagatatatgtatttgttaggatgaagaggtatcacgaacgttggttggttcgtgtgagtcttagtttatgggggcg

SEQ ID NO: 916 - DNA, 1313 bp, Zea mays
  misc_feature (1)..(100): optimal_loci_162628_G1, chr4:190372399..190373711, Cluster 6
atcgtcagacgatgattcgtccaaaagattttggaagatagatggacgacgatgacccatgatgacaatcctatctagattaatcaaacaatatgcagaaaataaaagaacaatatttgttaacaaaaaattgataaagtttagcatcaattattttaatcaaagcattgacaaaataaaactagaataatgagcaactaggaaacaaaccgctaggccggttttggttttggccctaggcaaccgtacccctccttcaattgcttccactcgatgtcagggatctgtgtggcgtcaacgagatggcaaaaggcagttggcgacgcgcacatttgttagggtttagggtaataaacaagtagctgttggagtattttaattactgtacgagtaaataaaaaaaggtaaaacgaattttattttggaagagtagtgattgggaacctccagtgaatttccgcgtatgtgtacagcaatttccatcctaggatcggatccgtccacgtacgtacgtgaggcaaatctctacagctaactcgtcatatctactagactgacaggttttccttccatggaagcgatgtgatggtggtaccagtaggccgggcgccgtcgcacgcgcggacgacgaggacgttgcctttacattgcattgcattgcctctagtactagtgcatctgcatgcatggcagttggcaggtcctgcgtcggccgtgctcgagctcgactgctcgtgagcccggcgcgcgccgggcaagcggtcgagccacgtccatcttcgacgcatgaacgggaccccggccccctccgatctgatcttgctcggccgccataaatggcggcagcagccgatccaccactttttgtttcttgctgcagcacatgtcgacccagcacctttttgttttcttgctgtgctcatcatggacgagacgttgtatttgcgtgtgtgggtgtggcgctatactagcgtccgccggccagccggccggccggccccggcctcgagccctcgaccggcgccatggccgttcatttgtgctgtactgtaccaccgcgcccgccgcgtagtacgcgtacagttagatatacatcagctctagctgcagacgccggccgtgctgttcctacttgctagtacggcaaagtaccaccagcccatcatgatgcgtgtgccggccccttgatgaatcggtcctccgaaacatttctaatatttgaattattttcgaagttaaacagcagaatccttgcattcatgtctgggcggccgtgcatgcatgcccagtgttgcgacaacacttatgtttta

SEQ ID NO: 917 - DNA, 1122 bp, Zea mays
  misc_feature (1)..(100): optimal_loci_165139_G1, chr4:203017761..203018882, Cluster 6
atggattgtgttgtgtgccatcgatccatccataccatccatgatgtggacatggaacggcacgtgccagaccgtgacggtgaaagtctccatggcacgacgctgcagtgtgtgccgagatgcctggagtagtgtttgactcgatagccaaaaggttctactttgaggcccaatgtatgctcaggattgcttgcttgggcatgttgggatggaatattaatactataataatacttggtccgaagaaagattaccaaaaagttcagtacatttcttttcgctggaaacccctcttcccttgccgtataatcatcaagtcagcagcaaacgaaacgaacatattgaaccagcagctagacaaggcagcaagagccaacacatgtcacgaattataatgtatcagcagcagccacagatctgataggagaggacaatcttctcaggctactaggttttgctctctgaggtcaagagccactgatatgacagtgccgagccaccgaacaaggtcagtcgcagccgagcattcattgacagacttgttgatgcgggacaccaccgccggccgtcggcgatggtgcccttgagtgatcagggtgtccagctccaggggctgatacgcctcaccttgaggttcccagccagctcaaggacctctgctgtcaggtactcgaggattcgaggatggctgccgcgtacacggtcgccgttgctcccagcggcctgtgcttgtgaccttcctttcagctggcgatgaatgcgtccggcggggagctggatgtaatcgtctatcaatccttattcaaacttcactctgcaaaaataaccatatacaacatactctcaggactgtagctgagaattagcatataataatttgaaccaaaacgctaaatataaaataacgatcaaattgaacattgtggctgagaattatctcattatctgcttgccccagggggcacaatcaagcaaggttagcaatgcaggacaacttgtaacacccatgtaaactagaggtcaaaacagacgtacaatagtttatttcttatcatatcctaatatattttaatcagattcgaaattagacacgaatagttagaaacgagacggataacagat

SEQ ID NO: 918 - DNA, 1112 bp, Zea mays
  misc_feature (1)..(100): optimal_loci_170193_G1, chr4:228934128..228935239, Cluster 6
aagccagatgccccgatacttaccacaggttgcgcaccggtatcgcggtagcttgctgttgcccaggctcagcaccccgtccgaggaggactggatgctctgcccgccgcgtcgtcatcaggagcggccagatgggaagaatcgaggactggatgtgctctgcccgctgcgtcggcatcaggagcggccacatgggaagaatcgatcgcgacaccaacacgctgtgctgtgcatatattacaaagaacacttttcatttttattcaactcgacaaaatgtatattcgccgatttgcgaaactaaggcgacatccgtatacattaacagtcgttccctgtcctcgacctctgaccacgcgccaccgactctagtcttaaacagcctattgcttgcaccaacccaaagaactcggtgataaattcaaggggcattcccttcgtctcggagaacacaccaaaaaaaaaatccagcgcaagtgtacctttggcagcgctttacaacaccagcttggcttcactttttttttgtcataagccgtacaaaacagcagcttaggaaatatcttttactatcccttgtactggaacgctgaagccaaaaaaaaaaaatggctcgccctgcagccctgattgctgctttggctcacgttacttttgcaaatatcccctcccaccaaatcaatcaagatctcaaacgttattctctttcttctttgtttctctcgcacggccgcaggattgctccttcctgctcgattcgtggagattgcagagctgtgaggctcttcggcggccggcggtcgggcggtgccgttacgtgaagccacgtcctccacgatctctaccatccaaaacctccatattccaccggctccgatctcgtgacggcgacgcgcggccagaccgtgtcccgcgggtctcaccagcgccgtccgtggaatcctcacgacgcacactgctgggcgtcagacatggacatagagagaagtgctttttagtcctctttagtcacctccttttaactaaagaacttaaatttagtcattccactttagtcaccatatttgtttttttagaactaaaagtgactaaagtttagcaaaaccaaacgg

SEQ ID NO: 919 - DNA, 1143 bp, Zea mays
  misc_feature (1)..(100): optimal_loci_171119_G1, chr4:234202010..234203152, Cluster 6
tcttcacttgggcaagtttttttaaaaaaaaactgataagagatggttgtgtgcaagaaataaattataaggacctgattgaataacttgggtgtatggacacctttagaacaaaattatgatgttagaacacctggttgaacaatcatgtcacaatgacaccacgttaaagttctctctgtgcaagtgcaacagaactaagctgtctttcactaaggacccaaatgagatgtaacaatttgatcaagaattttacacaaaaagcacatgtccaagggttaacagcactaatgttgatgttgaaacaagaaacaacaatactactgtcttagaaccaccaagtgataacaaattaacaatacatgactatgccattgttctaacctgtgaatttgatccaatctccaaaataacggatggtatcctttgatgttgataaattaaaatagaaaaggaataggaagaaggatccatcactcatgcaacatgctattagaaaaagtgaaatgtgggacctatctgtgtggcctaaattcaatggcgtgctggcccatccattggtaagcacataggaggtacttgatcgcaccaaattccagctcataaaaagaccatgagacaataactgcaagggttgggaccttccaaaactagaatgcagaacataaaaaaatcagacatgaataggttcaaaaagttcaggatgcatttgtgtttatggaaaaaagacaatcaagaaaatagaagttttctgtaccacctaactggcacagttaaaaataccaaaattgtaaacagcaagtgtttgtaccatattttgagcaactacccacttgattttgattcagctataatagtaagtgtttgtacgtacatgttagttccactctccgaaagggcatctagctgagttggttaggtggcctgagaagcactcctcagatcctctagtcctgagtttgaatcccagtgggagcaaatttcaggctgaggttaaaaaaaatcactcactggttcccctggttgtgtgcacatgatatagactgacctatggggggcggatcctcgtgtaggggttgtgagagctcaaaacacgagtaaaggtctagcctatagggagcagaccctcatgttgcacgagga

SEQ ID NO: 920 - DNA, 1013 bp, Zea mays
  misc_feature (1)..(100): optimal_loci_171996_G1, chr4:238793030..238794042, Cluster 6
atctactagtattttctagatgacgtggaagctataaaaactataattaagtgtcttatgttgggactgctctaacgagggctagcatggcaaatcagggagttgatatgctcgcatggtcaatcggtagacgatcagttaggttggattattgatcggttggtctaggtgatatcacctgcttttggaaccagcatggtggtgaccaagataccgactactggtagggtcgacgccacgttcacattacctgttgcactggcaccagagcaaaataatccttttcactagcaaaatatttttaaccatttatttataagatcatgtgtatattttttttgaggtgtgcactatggtaaaaatgacgttggattcgccccttattactagcggatgtgttggagctagccgtttatacatatgtcatctgattcttacattcaatttcaagcgtttaaatttataaaataaaaaaatatgaactcacactctgtaattagagagagggttcttcccttctttcacccacattcagagacgatatagggatatgccatacctcgcgtacccaacatatacgtagtatgtctagaaaaaagatttaattttaaaatgtttgacagatttgtaaattgtacttccattgtgtatacttttttattgactcaggacctatctaataaagttttgaaatagtctgttagacggacatatgataataaaattgatagtccaatgctcgatcgcttggattcttcgatagacgtgactcacgatatgcgctagagcctaagctgttaagtgtaggctcacgaaaacaacaaaatgtcaaacaaaattatgataggtcttgaactttcgagagtccagaggcatgaagggaccctacgcacataaacggtgtcttgcgtgccaaacaacgagactcaaagttgatcaatctaaccaccacgacattcaatatctcgctatttcttctttgtatattaaaaaatatatctacttcaatcgcc

SEQ ID NO: 921 - DNA, 1169 bp, Zea mays
  misc_feature (1)..(100): optimal_loci_173358_G1, chr5:5571562..5572730, Cluster 6
acacatctaattttagtgatgttaataaaagtataaaataataattaatgttttttgcatattaatatattttatcatattaattccgtagcaacgcacggttatatagctagtcaccacaataaattcaggaaaaaaattcaacctgaccccagggggtgtcacgactcacgagctgagcgttactggcgcgctgccgcccaaccaatccgaaacccgctaccagctttgctggtcctcccctcctcgacacagaggacagcgtcgccaagcgcaagcgcccgaggcccggcatggaaatggaagaggggtcccctcctcaagacactggaccactgcatgtacattgcacggagcagaagcagatgcatttccatcacacggatacggcaggtccggcatgaagagccgccatccatggctggtcctggccccgtccccttccggcacctctgatcaatgctgccatggacactgcacggccggtcgagctgcgcagccggtgatccggtgaacagtgttaccggacctcggattgattgcctgtaataatcgtcgagccctgggtgtcgcttggcgcatcgctcgctgctcagctcatcggccgcaacgccagaggacaggagcacctctcgtgccgtcgtgcgtgcgcgcgcggtgactctgggccgggctgtcctacacgcgtgggtacgtatcgccggcacgccattactcggtgtcgggctccctgatcgcgatcggtgatagggtaagtgttgtgagcgcagcagcagtgctataggtccatacagtactgaggtccgtttgatagtctacaagtgaatcaatatttgttaaaaaaaagtaacttcatcggtggagttgaaatttttatataaacatttggtagggggtcgatcgagaaaaactagccttttcagcttcactcggttgcacctggaaaattttgacgagctgaaaaaaataagttttatgaataagtatgtttggtagaagaacctcaaaacagtttggtgaagctagcacaaaagccatactaggctctaatcctgtatttacgttaaaaaaactgatttacgttgtaaactgcagttttgtatagagtggagtttaaaatagtgattaagatagagattgagatagaaagactcatggagacagcataa

SEQ ID NO: 922 - DNA, 1153 bp, Zea mays
  misc_feature (1)..(100): optimal_loci_173359_G1, chr5:5572894..5574046, Cluster 6
actagttgggatagaaagtacaatttagtctacagttagttcccttgcttgcatacctattgatttaaatcttgaagtactaaagtcgagtttggtagcacacctcttagcttgtagcctttacaaagattttcatctgcctcgtgtcttttttttgttcggtactatttgtcgctactttttttttcaagtaaagaaaggatatgccatgacgcttaggttcgcattccggatgcccccaaaatgtaatatggcaaaacgctggatcgcattttggcaggacacttgtgtagccgtgtctcttcccgcgtgaacacctgcattcgcggcgggcggtgagggcgtgggacgacgagagtagctagactacgcgtcggcgagggtgtgctggcagcggcgaggtcacggccggaactgggcccacgcagacaggctagagacttatctgcacagtgccacagtggaggtgacgacaaggcgaggcggggcctgctgttaattgccgatttggcatgtgttgtgttacgtgacattgcaagcggaaagacccctaggttcaggcacttttcccctgccgcaccgcacggttcctctgcctgcctccttgtcctcgctccttcgccaagaataaatttaccatcagctaccgcgtattatgtagaccaagaatagacttacatgtacgtggattgttatacagatacatttcctagtccattataggaaaaccataacataatctatattgtatcttgttaaagtcaacgtaaattcgctcagtccacactgagtttgcgtggacttgccctaaatcaattattattaactttgaccgaatatgctagacattttataagattttataacataaaagtaaactcactaaatccatcatcagtcctactatgctttactttaaaacagtatgattttacatgtattatccgttaaaatttaattagaatgactcagaacaagctctagaacgacggactcatgtgaccgaagggggtacaaagctgacaataatgtcgctgtcagaacgggaaacgaacaagtaatgtaacgaacaagctagcgacagcgagcaccacacagcagatgtcgttgtaggtggcctcgctctcacagtcacactcacgtgcggcgttcc

SEQ ID NO: 923 - DNA, 1026 bp, Zea mays
  misc_feature (1)..(100): optimal_loci_173990_G1, chr5:9620048..9621073, Cluster 6
ttgactacctgcaaacagtccccctcaaaccacatcactgattgcgatgttgtcccctctaggaactggctgctcaaccaatcgcaactaagtctctaattatgtggccggtggcagcatatatagttttgctctgcactgaatgtacaacactatttaatacatcgtctcttgagggttttctaggggataaaatgtaaaaaatacacacgactctttatatataatgtcttttgatagcatttatgatgtaactgattttaaagaccctgcagatgcagttttttatgtatcttttgtgtatagaaaaccgaggctgtagattgtgagaagttgtgaacgattccacctgtgaaaactggaacggttcatacggtagtctgctgtcaaaacccaaaaagaaatagcgcaaccatgctagctctctctggtcagagaacgattgcgtgggaggagactggatgggcgaaaagggtatagtactgtaaggccttgtttggatgcacgagtatacaccttaatccatgtgaattagagctgtttggtgtagaatttagtttggaatctacaccaaactgcttcaactcatacggattggagtggacacatgcgcatctaaggtgattgcgcgtggcgtaaccgggcgttggcaacgtcgttcgttggggcgctggcgaaagcaattagaacgctccaagaacggcgacaggctgttttcagactgcaggtttagttttcagtacaagacatggtcaaggtgacttcgttgtataatatcttttgatctgcggcagcaaagtatttggtggagagtggtattggtatgttataaaaaggtgacctaacaggcttacatgcatgatctgatcagtttgtacaggcatacgttttataagttcataatccacatgatttgtagcctgcaccatcttgtcttgtcttgaaccaccacatgtgtttctttgcttaaacgcttggttgcttgaatacaagaagcgtggactgcatggacaggtgcaaaacaac

SEQ ID NO: 924 - DNA, 1215 bp, Zea mays
  misc_feature (1)..(100): optimal_loci_174762_G1, chr5:14133935..14135149, Cluster 6
cccccctcgaggtcggaatttgtcaagcagctgtagggtaggaaagtttcaatgaaggtaggacacacacacgcacagcacattctgccggtaaaaacaacatggatgtgggcccttccttagatttctgctgctgactttcgttgaactaggtgtgctcatctgtttccagcttaggaattttccgtgaactggtgtgctcatctgcttccagcgtaggaaatttccgtactggaacatcgtaggaattttccgtcttgtagtctgtagggtcagcaatgggcgctgaaagtcaagggtgctgagcttgtgccagatctaatattgccgttgccgatggggaatggatggactaccctctacccatgcccaccccacttgaacccagtgattaatcagaagacatctctcaaactatccccaaactccaggaaaaagtttatttttagcccttaagttgtctgattaaaggagaacatatcagttacaaccaggcacattagtgtaaccgtgcaaccagacacattgagaacatttgtaaagttgtctgattttattattgtaaggagcgtgaggcctaaaagtccagacttcgtcaaaactttggtagctaaaagtagacttcttcatatgcctaaatggacatagattatccaatgggcaattagaaaatgatgtaaagaagagtagcctttcgcgttagtctccatccccatgtcatgcctccatggtttcgttaagtcgccgcttatcgaccaggttgggatagttgcctgctctagtccgggatgtggtcgtctaggcggcgcgcggactcggacgatgactcccaaacagaaatcactgcctccgatccatcacttgttcctgtttcttccgcatgcttcttctcgcgggtcgtgctggtccaggtccacacgcggcaggcaggccgtcgacggaactcggaaggatacggtagcacgggaacaggaagccccgtcttctcttctcgatgctgggcatgcatgggtaaccatagtattttttacataagtaaaatctaagacctgtttggcaacaaagtattttcgtatacacagttttaatcaattcataaattaaataaaaggtcagacctgtttggcaacaaagtattttcgtatacacagttttaatcaattcataaattaaataaaaggtctattcaaatgcatgtatacctggtatgattgt

SEQ ID NO: 925 - DNA, 1179 bp, Zea mays
  misc_feature (1)..(100): optimal_loci_175265_G1, chr5:16842122..16843300, Cluster 6
cagcatccttccctaaaacaccatgtgtactgttgggcgcttcttagtcagcttatctgtacattctgcttatattgagtcactggattcaattagtacaattttgaacctacatgccaaacaaaattagcattccaaatgttctctccgtgttatctttgaactatgaagatttgatttgtaaagttctgatatgcacatactattctgtttctgcagtcgcttgtgttgtgtcttattcttataagttgatgatgcagtggttataatgaatctttgttttcctacttagtatattttgcataacagttacattgttttgatcctccatttccacaggctaaactgaagaataaagtacccctagaccagctgtagcagtcttgcttaatatctttagacttatatggtatctgattgtatccttctagactataggactgtacctgtgtttctatatactcatatctgttcaaacttcaaacagaattttgttggtctcactaatttaatgcagagatgtcatatttcaagatccttggtggttggtgctagtcctaaccccaactccgccgtttcataactgatacaatgaacaacaacaaaaaacacttcaaattggttgtgccacttgtgcccctctttccaggctaccttagaccatatgttgaactatcctccagtgttcactggcatcaacgcctgctcgctttgcccagggcatgcatattgccatgtctccctacatagacacagatcaagcgtgtctcgtgtaagcccagggtcccaccaagtatcttcgaggttaatgttgatgttgtcgaggatctggacatggctcatattctggttctgaagacctcatgccatgcccaaagctgtctgccgtcaagtcaaggttattagtagtagtattcacattagtccagaatctgaacacgacagacacttcggttacgaagataccaccaccaccttaaaaaccgaagatattattccatgtgcccaacctccatgtttcctgcgccgcaagtagggccgcgccatgtgcccaaagtgttgagttgttgatccaaattatgcatatcagggttctcggttctcactgcatcatcattattattcttgtaaggccgctaaaaccggcgttatgtaaacactccatattatactctacat

SEQ ID NO: 926 - DNA, 1256 bp, Zea mays
  misc_feature (1)..(100): optimal_loci_175582_G1, chr5:18702562..18703817, Cluster 6
tactcgtgtgtcgccgaaatggacgcagctctagcccatgatggttaatcctgcaggtcacgtcgtacgtgtcagaccatgtcggagccaggccaattaataatcagcgtacttttccatttccagaagctggcttggcttggctttgctggccggtggttgcgtaagtgcgagcgaaactgatgaaaatcagaaaatgctctggagagacgaagcacattgacggacgctgcaggctggaacgtgtggaactgaaacccctatgctggcaggcggcagcacgcacgcacgtacaagtacatatacaaatacaacacaaaaaggttggagtccaagcgaagcagctctcgagaaggaagggaggattggaggaagcagcagaagccagccttggccatgtgtgagtgtgtctgtactctgtactatgcagctgcaactgcaagaggcaagagggaaacagtagacttgtttttacaggattcagatggaccgttggtttccagtcagggccgtacgtactgacagtgctgtcgtctgccgctccagacaggcaggcacttcgtcgcacgcacagccgaggaggcgtgacgcccacagttgcagttgcagccgcagatgcggcaggcagcacaacgtagaggtgagtaatgaaagagacggccggactgagttgcgacatgtatgtaatcaagaacttgaaggagcgtcagactattacaacaagggattcatttagacctactgttttgtgtaataatgaagaccacgagttgactgcccccattctctctctctctctctttcaggggtcactcgccttacatccttttaataactatagtgcaaactgataagggttgtaatggggtcacagtgagagaaaaaaacatgtctagacagttgtgaagtaagtggtaaagaagccgtcatcacatttttataaaaaaaaaactgcaataatagctctcgctcttactattaaagcacatcagacatgaacatggcggtgttggtaaaaaatagtatgtcacaactcacaatgtgtaaagattatacagacattatttagctcgaagagagccgacaaagatgacctggccgaacttctaaagttcatagcctgatacctcatgttccttcactcatcttatcgtcaccagattattgcagcaaactgttataaaaatgtatgtacaaaaaggcctatattaagtggatttatatctgcgaaactcgctatcaacttttctattgta

SEQ ID NO: 927 - DNA, 1373 bp, Zea mays
  misc_feature (1)..(100): optimal_loci_178388_G1, chr5:32870080..32871452, Cluster 6
ctggaattcttctagaaaatggtccaagtggtttccgtccatgctagttaggagacaaaaaaacatgcttgccttatttggtggtcctttgttgatcatagaccatgcagtaatcatgcaggtcatttacaaggtcaattagagaatatgtggaaaattagtgcaacttgtcaacagatcatggctacgacgaagtggtgttataaacattttagtccatggaaatctaatttgatcaggtattgttctgagaaaatttcacccatggaatttaattatattcaaccctagagatggcatgcaacaacaactaagaatagcaaatttggtgttcgtaccgttgctcgagtctaagagaaacaaagaatttcaggataagctagagcaagttgtagcacaaatgctcctatatcagttcgttggtgccaagcgtgaggcaatcaatgttgagtcaaatgttgagcgccctgtggaggtgttggaataaaatttggatttgagcaaactacaaaacaactgttcaactgaaaacgcctcatcgaatggggataccttactcagtgaaaataatccttctaacccaacagttggtcatgagactatcgatggggagatgctttcttcttttggtcctcgaatttatgtaccgacccaaagttatgaatattcaatagtgaaacaggcaaaaaaaaaaactaatggatctcacccacatgtgaaatgaagtaacttttggggaaggaatggtgcagggaagagccaaaactcagaatcagtcgattcatctggagaagagcttgttattcaaaggctagagattgcgaagaatgatctacaaaacagagttgccaaagaggttacagggaatgcaattctacatgcgagtttgcaaagaagaaaacaagcactacatgaacgcatattagctttggaaaaggatgtctccatgttgcaagaacagttacaagctgagagggatctgcgagctgcattggaagttggcttgagcatgccttctggacagttttcaagtgctcgttcgatggacatgaagacaaaggcagaacttgaggagattgctcttgctgaagctgatgttgcaaggttaaaacagaaggttgtagagcttcacctccaactcaatcaacaacgttaacaccactatggctctgtagtggatacaaatgatcaccatcaccgcctccctggtcacttctcacagcaaactttcttcaacaaggatttgatatgaaccttgcttttttgcaatcaagagaagtagagaaatgaagagagatcagtggagtcatcaatggagaaactgaaattaacctttccatgggacccatgcagccacagttcaagctatctaa

SEQ ID NO: 928 - DNA, 1212 bp, Zea mays
  misc_feature (1)..(100): optimal_loci_195119_G1, chr5:146427130..146428341, Cluster 6
tattggtttgttttgtgtagcttcgttgtcatgttgaaaaaaataataatgaactagaagacttaaggttgagtaatggagcaaagatcacctaattattgaaaaaaatgttaatttcacctacaaaatacatgggttgttttccttagcttcattgtcttattgaaataattaattaactacaagattttaggtaaagaataaatgaaccacatgatcacctaataattgaaaaatgtacgtttcattgaataactacattgttggtttttcttttatatatcaatacattagtctagtcggtgttgaaaccatatttctctcttcttgtgtatttctctagagcctagggttctctctgcaaagttacctcatgtatttttgccctttgggccctatggaatagatgagttgatgttttccttctctaacatggtatatggctagggtttggctactcccccacctagcatgccaccgcccatgagcctgtggcactcatttgccagcgcgtccccctacgtccgtgcgtgcttgtgcggtcacccctcccgtggctcccacgcctgccctgccctcgttccaccccccgcccatgttatgccctccgcccgtctctaatgttgtgcctttcttcctagtgttctgtgctcctctccctttgatatgttttatgctcccctaccttccttcgcccagccgcatctttgtccacctaatcccacctccacatcccactccacacccccctcaagcatggcaactcctcattccgcacctcttgtgccacttcccaccatcacatttgatggcaccaactttcgggagtggtccatcatgtttcacgtgtgcctcaccacagcataaggggtctccatttggagttcgagcaacttcgtacttagctccacgcttgttctcctctcccatccttggtcgaggtggtcaccttagcctagacagaggatatttgtctttgtggtgtgatgttgtcttcctcgacaattcttgctacttcaactatgtcgcttgacctagctcctacttatactctagctctagtggtggtgctcttgcctaaggggtgttgttgttgttgtctctgccatgactgtaaggcaacaaaacataccatcgagaagtgtaggttatgtcctccatgatgccgaggaggtgccccgctattgctgctcctgccttgcctcaatcgcc

SEQ ID NO: 929 - DNA, 1277 bp, Zea mays
  misc_feature (1)..(100): optimal_loci_197223_G1, chr5:157796748..157798024, Cluster 6
tgtaacattctaaaattgtatcttggtaaattaagaaaattccctaaagatttagaatttcaagtgtattataacaatgttatgaattgagactatcttccctgaaatttaataaagagtaaatatacaaatttggctacataattaaactatattttaaataaagggtggtgaattgttttacctaaactattccttttgggttatatgggtagtgtttggttcggtgtcaacgaagaatgggacgggatcaaccctgagttgacctcgtcccttattttttgagagatgaccccatccaccattttttaagaatatttcttgaccctgactctgaatcttcaaaccaaacgcaggtcaaattaaaatgatctcatcctatccctcttcattcatcctcgtccctccatccaaacacataattaattcctttcttattgaattttatacatgcaaataattatttgagcaaagtaaataagaaataagtaaatataaaataatttcattcatgttgtatgtttgtttcattgttgcatctaaattggatttggaaattcaaaacctagacttgaattaaatctgaaagtggaaaactaaaacagaaaagaaaaaaagacaccacctgggtctcgttccatagcacaagccgagcgcaccagaataccagatcacatcgcggagctgccgacggatccgtcctcctgcgtcctcagccaaggctcgcaggtgtgcctcctccgtgtggggcccgtaggtcatccctagctacggaacccatgctctcagactccaaactgcctggccgagttccatgctagctctcgtccatcaccatcgtaacaaccccacgcttctcctcgacacctggtgcataagaaggggagctacgacccgaccctgactcataggcgcggtggaaatccagggaggtcgttcgcatccgctcgattatcctcaatgggagtataaatgacagctcgcgtactcctcttcctcaccaactccacccccccccccccccccccccccgctggccccgccttcgcgtcctcccgctctcagtgtggagttctactgctactcaggctccttgttctcctactctggcgcgtcgacgaggtcgtgcgtttccaactcggcacagcgcggtcgccccgtagaccccctacgcgtactctctgtcgtcgcctccctccgtcgcatcgaccctatggtgctagttgaggtcacaagagtgctattccataccaacacagagaagaagcgaaagggcg

SEQ ID NO: 930 - DNA, 1034 bp, Zea mays
  misc_feature (1)..(100): optimal_loci_200537_G1, chr5:176994861..176995894, Cluster 6
catttctctctaatccatatccacatggattaagattaaaacatacacgtgtcttttcaaaaaaaatgacaatttttttgctatctaccagcttacatattacattcctgcttgtaattcaacatcgtaagagatcaagatacgtggcaaggctacgtcgtagattgtttttggcactagaagttcgtctaataaggaggtgtgtgcggcgactacaatgaagagacatactacgttattaacgtgctggcgtttatcgtttgttatcactagccgcttgggtgtaatcacaggtatctcaatctctgtcatcattcgtcacaactcaccagtcatcagtcatcaccgcgatcgcgagttgcgacccaccactctgggcctagcaggccacaagctattcttatgcgtcggcctaacaatgagtggccggcggcccagtcacagcaggcccaaggcttctcctcgttttttgagacaagcccgagccttctttcttaaacgaaactcacaagcatgaaaccgagctgtcggcccaagtaccgaaccagctagccggccccaccttcggcaatatcgcgccatggcttggatgttggctctgcccagtccccctcccccctcctagctgccgtggttttctacctgtgtatgaagcgcgcccatgcacacgtggcgaaccgtttagcagcaatatataatgtatggtgattgtatgattgacagagattaaattaggatataagggcaaggacagaggaaaaccaggtttagtgtttgaaagagttgcacattgtgcagaggtgataattatagcagttacgatagttgcatagtcaatcgacatgttcgtgggtttctataaacttatatattacatcattagcaagattcaacagctagagatttgttcaatatatacatcactacgaaagtttcagcggtctggttatatatacacaaaagcattcgtgctccaaaagtgacgatgctcgtcatattacctgtacaaaaaatatgagcgtcagtacttaaag

SEQ ID NO: 931 - DNA, 1333 bp, Zea mays
  misc_feature (1)..(100): optimal_loci_200728_G1, chr5:177660033..177661365, Cluster 6
tctgtgtgtcaccactcgctagagcttattgaaatgactttgaaatttggttaaaaaaaagagaactagctaaatttagttaccaaaaatatggcgaagtgatactgtgtttgtgtgtcaccgctcgccagagcttaatgactttgaaatttagtttaaaaaaacaaactcagagtagcgagtgtcttctccccaaagttcagaacattgcatctgacccattagtgctaatgcatttcatcatagcttgttgtacgcccttgagattaaccatcacagtacagattatatgctcaggtatccttgatatttgggccatgtggtactagtgttgctatttgctagcgattgtggcggtgtctgtcagcactcgccagcttagccgcatgggctcgcgcaggaacctctattctgtttctaaaccatatcgagcctttagtggagcgtttcatgggccatgttttcatgtggtgggctaaactgaagcagcgagtccacaaagcatcagttcaacccgacggcgacactgcattgagattgacagctagcggactgagagttttccttcacatgatgagtacatgacatgatagcgcagtgatagcgcagctagggatgatgcagaggctgggcgcggagtgacggcacatactgaggcgagtggcagcaccagcgagtcatctgcggcggcggtgctggtgcgggtgcggtcctgcctctgctgctctgcatgttcgcatgccaccctgctcagcgacgtgcgccggtcgatggtctccgcgatctgcccgaacgtaatgcatagcacgggcactgtcacgtcacgcagcctgcagcatggcaatgatcaaccggcacagtccctgcggctgcgtgcgtcgagcgatcccacactctcacggttgctgcggcctgcggtcgtcaaagcagtcgcacagcccggtgggccaggcggcgacggtgcactagcactgccatggaacgatcacgttcttctctgccgtgtgggctcaacgtctcaggtagtcaggtgtgcctggttcggataagatcgtccaagtctgcctagataccgacgttcagtagcgtaacatgtttttttcttaagaccaaagaccattgttctccggaaacatgattgatcgatgtaccacgacattaggtctggtctggtacggtcatggtcttattagtaaagacagaaccgttgcgagctagccaaaaggctcgcaacaaatgcaagacagcagaaaaaccatcttaggtctccttttcctctgcagaaggttagtggttgtgggtgttaatttccaaagaggagcgtcatggtaag

SEQ ID NO: 932 - DNA, 1109 bp, Zea mays
  misc_feature (1)..(100): optimal_loci_201044_G1, chr5:179547759..179548867, Cluster 6
tgagggacacatgaatataggcgccacgccaagtgcacgagcattccggcaccggcagcgcttgcagagttgcaaggacactactacagtaggcatggtcgtagtcgtagaccactcctgctgtactgtagaccagctcaacctagggcggccaggcacccagtggccgggcggcgcacgcagttttgactgacggggagcagagcagggaagctgctggagagtaaggacgcacgccggcacacgtggagtggaggagaagcctagccatttgaaatacagttacttccatgtcgtgctcgtgctgcagcttcagagctggtgctcatatatgcggccatcatcatcagctcaccgtttcttgggtgatgcagctctgcgttgcagtacagtggaccacatcttgcaaaatgcaagggctcaggactgatctatctacacatcagtcgttagcaagtggaagtgctgcttatttcaaaatgcaagggctcaggacttcatgaattaattgtacactttaggatcatgtatgtcagctccttatttcagttttgttacatgtagatccctacaacaccgattagagttggggaaggcgaacctcctccttcttgggatccggtaccaacttcaaaaggtactgaactatgtctatgtatacatagtttgctttagtccgtagtagtttgctttagtccttattacttgcaagaaaaggaaccaaagaagcctagaaagactgacaacatagaaaatatgatgaacaaatacctagaaatgaggagcaagcaagtagaagatgaagctgcaagagaaaaggaagcaagagaaaaggaagcaagagaaaaggagacaagagaaaaggaggcagctcaaagtgaagatttctccatcaaaaggtgcatatcagttctgaacacaatggaagaagtgaccaaaatggagaaggcaaaagcatattcagtcttcaccaagagcaaagagaatagagagactttcagatgtgcatgtgaagcggatcaagaattagctttgatttggctaagaaatgagatgacttagtaggtatgatatttgtgtctttaccttccactcaaccatattcactt

SEQ ID NO: 933 - DNA, 1024 bp, Zea mays
  misc_feature (1)..(100): optimal_loci_201690_G1, chr5:183868874..183869897, Cluster 6
agctcgacgcgggcgctccagaagtccagagcaaagttaattgtcgggcagctagctagctaggctttaataggcaagccaccacccatctccttcctctaggctttccccatttggtctgttccgaatggcaatcgagagctcgtcacatgcctgctatatacatggagctggaggatggagcggaagacaaaaggacattgccatacatactctacgctgctgcagcctgtactctctggaccgccctagaagatagataagcctagctggaccttcgaggaaaggacccaaagccagcagagaggtagcgctagctgtcgatcggggactggtcgggcctcgctaaaccactagtctaatccagcgcgcggcgttgttttagtttactccactgtttatatataggcacttgtttaggccatcacgcagcagaactcgccgttttgtgtatttaaaatttcgtcgattaggatacgataagtgctactggtacgcacgcacctggcccatgacagctgccgatcgagattgatcggtcttacgaagaacatgttccttttaaggtaggacgatttgacgaacataaccacttctgattataaataagcggaaaaaatacatgatgaggttacgagcacagattggatagagccatatagaggggaaaaaacacagattaggccgggcttgcagcaccccagagcactggaacacagcaagccgattgagaaccttcaaaacgcgcgtcttgatagtaactagaggtcatgtacgagtgttcattatgatagatagagtggtagaccaaagccgcaagatctaagttagtttctttaatatccattcgtttcaaagactagttagaagttggtttattttgagaccgcggtacgtgggtatacatgtagtttataaatcaaagcttttttaaaaaaaattgtctaaaggtaacattaatgcacatgcccaacgtacttagtagcatatacttagataattattaattgggtagctatgaccc

SEQ ID NO: 934 - DNA, 1294 bp, Zea mays
  misc_feature (1)..(100): optimal_loci_201693_G1, chr5:183870768..183872061, Cluster 6
  modified_base (360)..(360): a, c, g, or t
  misc_feature (360)..(459): n is a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
ctatacatctagtatactcctaaatacagtatgtacgtagtacgtacaaggcaggcgaggcggtgcgagtagtcgacaggtgtaccagcgcgtaggctttactttaatcccgcgcgtgattggtcggtcgggcaggtacatacgtagggtgggcaccacgctagtacagctagtaagcgcatggtcgatgcacgacacgacgcagagccccatgcggtcgggcactgcggccggacgcgcgcggtgagagtgccgtgaatttgggggttgcggcgacacagtacagtgcagtgtcgtcgtctctgagtgatcatgtcttccatgtgtcatgtgtgtgccactcctatctactctatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgcgtggtgtttttctcggccccccagagagaggaggggggggcaaaaaatcagtctcctcaatgggagagcacagtgttgatttttgggcccccctattttatcccccccccccccccaaagatttctccccgcgcccccccccccccccccttttttttttttttttttgggggggggggggggggggagaagaggggggggaaaacggaaaaaaaaatttccctcttgttgtgggggggaaaaaaaaaaaagggcccccaaaaaggttttttttttttcccccccccccccccccccccaaaccccccaccccccaaaagtcaatacagacgtcaagatgaatacctggtgtacttccattccggaaatcggggtaggggcccccccgatcgggccccgggttcaaaagggggaaaaacccatggggccggaaaagctggccccataagtacggataccgagcggctctaatagcccagcctaggaatcgtaacattaaaaggggtcgctttttctcaaatgaagccccatggttggtagccgcttttccgcaggtcccccccgcgcgccgcgctcgtcgaggcccgcacatgccggtgcgggcggcgggacagcccgctccccactgacccgaggaacgggatcgcccactcaggcgaatggcgatcatcaggccttttcgcccgaacatccctgctacgtcttcggcttcccgttgaaccaaatactcgattcacatcggtgcctggaattttacgcactaccatgggccgacagacattaactacgctgtttctttcttaaggactaaaatggccttcttattta

SEQ ID NO: 935 - DNA, 1031 bp, Zea mays
  misc_feature (1)..(100): optimal_loci_201994_G1, chr5:185535300..185536330, Cluster 6
tccctaatcaaaatcaggtgcgtcttgtttctgcatgcgctggaaaagatacaaatctaagatattatgggtcaactacttgcaaacaggtctagtagtatcgtgcataacacagctatgaacacaggcctagccgcctagcacaagcagccgcatacaagcaagcacatgccaggatatcgtgcataacgcagctatgaacacaggcctagctgcctagcgcaagcagtcgcatacaagcaagcacatgtcagggaagagcacgagcagtatgtgaaagatgaggatgagcagcacgcaactccatagagcggagcggcggcaggctgagaagcaggtgttgtgttgtgcgtgcgacggttgagcaaagaagaaaattgcaggcagaacgtaggcacaaggcaataccaaaatggcttgggtcagaccaaggtatggctagttgctactcagaaagcatttgtgtagatagtacaagcattatgtgttgctagttgctactccagcaagcatttgtgtactactccagcaagcatttgtgtagatagtacaagcattatgttgagcgcccgatttggcactggatgcccgaacggtccgggtaccgtatgcgggatttaaagatagttagtgcttaacctcaaaagatgccaacacattgctatctaggagcgctaggatagaggcatctagatcttacttatcactgagtaggcgtttaggaatgatcttgttaatccgtaaaatccaaccgtccatccgcggccacagttacttcatcctcctccttccagttccagctgctcacatccttcttcccttggagcgacggttggcttgcgcgcaccaccagcccaccagacggaggtccacagccaaacgccggtgcctgtacgagacgcggggaggcggcaggacgccccggtcgaggcggctgtccgatcgagtgagcacaggcccttctcgctggctggcaaaccaccgtcccaaccccaagcgcgactgcgcgagcaagtaagacgaagcttcag

SEQ ID NO: 936 - DNA, 1235 bp, Zea mays
  misc_feature (1)..(100): optimal_loci_202272_G1, chr5:187027363..187028597, Cluster 6
ctctttgtaaaacaagatatgtatttatttattttgggacggaaggaataattagttttgggatatagggagtagctagcttagctgctgttgtctagtgttagcgtgaaatcttatatcttgtttgacagggctttttcatggctgctccctttgaactccgatcctccggcactatatcatagagctgccaaatagggccttagtaagtttacttgtgatttgctaagcaaaaaagcgccactttaattccaatcctaagcaccggagaaactttctgctagctagccgtgcatatctaaaatatgtgtgcgcagactgttagaaatttagatatttttatgtttaatttattccataaataagacagtatagttgtagcgacgcctataagcacgtgtgaaatattactattcacaaactatgcttgtgtaaaatcaagacatgacaataagggtagcattttgttctcccactaaattttacactagtacaatcaaaattttgatgtaattttatccataaataccccaaccactataaaagagagaaaaattaaaatccctaattgcatatcaatctaccactgtctgaagcttcagatgtaagctttgagtaccattttatttaccttttatataaagcctccactatgaaagaaatcaaaaccaaaatatttccttagctagatttgtattttttgcaaggtgacctaaggctctttctttctttttctcctcgaggctctagatagtgtttttttcgagaaaaaggtagatggaagattacatacattcaaaagcttcagtagacaccgtctattcaagtgatctttagatactattgttattagcatttgactgtgaaccttcacaagcgggacccgctgtgatggtaccgtggcgtggaaattaaagctaagagcaactccaaaagccgaccaaaacatgccccaaaactcgttttagccttataaaccaaaaatatctcgtccaatagttcctctatcttacccaaaatttgttggtcccgcatctgagtcccgacgttccgcaattttccgcgttgccattttctccccaatccgtcggctcccgcgtgttgctgctgtttccgtgttgttttgctcgcgcactcagtttagttggcagcggagtggaaagcgacgacggtgagagagaaagcagaggcggcggatgaaccgtcgaagacaatatgctgtcaacgacggcagt

SEQ ID NO: 937 - DNA, 1033 bp, Zea mays
  misc_feature (1)..(100): optimal_loci_202593_G1, chr5:188709286..188710318, Cluster 6
gcttgtggtcacctgaccaaaaagttctttttgaagcaaaacattaattattcccaaattacaaaaatcatcacaaacatgagatatgttgtgaattgtgatgcataaacgagcactcatgcgttgcgcgaaagacttcaccgtctagagccgccaaaggattgcaaccgaaaggacatcgtcaagtaggctccatggggtggtattccattcgcctgcatctgccgccgacccaactgaggcagtagtaatggcacattccagggtcgaccttgcactcatgatgggggagctaaagtgtagcagtacgcggcgtcccttgccctgaatcgttcatttgctggtgcctggtggtcttcggcagaagaacatcctactttagaacaacagaggattagtaaaacatatagatagaaaaaaaaatgtaagaatagagttgcatgttacctttaatttcataggattttcttttttgaaaggttagatctcatgtctaaaatcctacaaaatctcactaccatgcttaattttatagaatttgtagcaacttaatcctttgttccaaatgacccttcaaaattcctcatttttgctttgttccaatggagacatggagcttgcatgatctgcgattgcgaatcacacgcgctggtagcaaaagctgagacggcgcacttcgctcctggtgctgatgacatgctcgctcggtggtgtcgttcccgctttaggagaaatcaaacatttttagtaatatttatactatataattagtattattagacacatcgttcgatctgttgttatagtaaatttatttgtaaacataagtgtcgttgatgttatctacaattgtggttaaattttaatagagttaaactggtataaatattatcatttttttgacgaaggggagtgctccctgagcacagcttggggcctatacggcgcgcaaggccacaccaggagttcaggactaaaggtgggcaactgggcatggcgcagctgtgctcatctatgtccaccaaatcaatcc

SEQ ID NO: 938 - DNA, 1172 bp, Zea mays
  misc_feature (1)..(100): optimal_loci_203813_G1, chr5:195488021..195489192, Cluster 6
catatttataacgtgatgggtgactgataacgttaaattatgtttgtttaagtccaaccgtaattggataccaccctataaatcgatatcggcatattcaaacttgttaccgctcgtatccaagcgtgagtcattatctttgtcatttatgttacatttcgttaatcaaacgacaccttatcatttaggcatcgggagatagaagaaagagcttctgtcttttgtaattatgccaagaaagagcttgtgtctctttacaatgcccctcacatatgatggatgtttggttgatagtgagatagaggatagggtgcaacagctataacggcagggctagaaaaaaatcaatggagaccaacctgagtgcagagccacgacctctcttgttcgcgtcagaagaaagaggggcatgcgactttttttcattatgtccactgatatgtgggagccaaatacttataaatctatcaactctatcgcaaatatgatctgccaaaatgatggatctacacgtagatttatcacgatccctctactagtctactctatatgttggggtggataaaaacaaagagtccgagatcttttttattatgccctaacgtataagcctagattatagtgagatagatagaagcttgaacattatcttaagggagaaaaaaatataaaaccgtcgtgtgaacgtcgacaagccggtctatcgtagccgcagttcgaacggcactggttcgcctctgaaccagcgttttagtagcaagtagcaacggctgcgcgagactcaagcgtcggaccgtatataaaaaatagagaatttcccatcacatgagattgatgctagaactaccacacaccaagcatcggttgcaaataggcattcacgaacccaaatacttataaatctatcaactctatcgcaaatctgacctaccaaaatgatggatctacacatagatttatcacgatctcctctactagtctactctatatgttggggtgaagtaaaaaaagagtctagatcttttttattatgccctaacgtataagcctagattatagtgagatagagagaagcttgaacattatcttaagggagaaattataacaccgtcgtgtgaacgtcgacaagccggtctatagttagttcgggtatgacagaccgcagtttgagg

SEQ ID NO: 939 - DNA, 1018 bp, Zea mays
  misc_feature (1)..(100): optimal_loci_203953_G1, chr5:196255003..196256020, Cluster 6
gacccttgtcggtgtgggacatgtattcttcaatgatccttctactgtatactgttgccagagcatgttcctacccatctccatttcttgagtcagcaatcgctattttcatatacatactatcctcctctgtatcgctaccaatcattcgtggatgctcatactgacattgaaaatcctaccaccaacgataatgtcaatgaaattaccatcactaacgcttctcctcctaccattgaagctgctaacactacgctcctactcaaccttttacttatccatactcatatgagtatccatatggtgcttctccatatggctcgtatggtgctcctccatcgtttggtgctcgtcctcgtgcaagcatgatagtgcccttaagcagtcccaatgatgcagttttcgaaccaatccgcttactatagtgctcctcaacgacagagtatttttaagtttacagatttatatattcatttgtggctattgcattctatgaacctagtggaaatggcaagaagttatcggcattctaggccaaatagacagaacctaaatctccacagaaactcctcaccatcatatctctattattagtagctgataagcaaccagaagatcactctcttcaatggaatctacaactacttgtacatagtccaaccgagtggagcagattatgctatgctactcgaagtggccaaggagaactttcacaacaagctcgacaaaaccgacttcaatctggagtatatgtgacatgctctttgccatcaacttcaagtggtgcgcgaggcatggtaatgacacctctagtgatggaagcaaaatatcatgtctcaatttggtcggtgactatagctctgcatcactagctagactgtgttgtgatagggaaagagctcaatgcaagggaaagaggccaacaattaatgagtagcaacgactccctagtcacaaactctatatggctagtcaaaggatgacacgaccgaaattgtttgaacaatataacaactcg

SEQ ID NO: 940 - DNA, 1137 bp, Zea mays
  misc_feature (1)..(100): optimal_loci_204292_G1, chr5:198201760..198202896, Cluster 6
ttatcatgcgcgatcgcccagggctgaggggcatcgtcaactagagccatatatccacacatcatgtttgccatccaatgatccaatccaatacaagtacgtgccgtgacagacccaggtatcgctctcgcgccgcgtcaggactgtagactgtagagcaacagggatcggcacatttaccgccatccataagtttaactcgtggacgagcgagcgcggggcgctgctcggtgtcggaggttgcgtcgacacccgtggactggccgaacagcggctgccgattcgccaccgctcgtataccagtaaacctgagctcgtgcacttgtcgttgtcgctctcggcggaagcggggcggcagcgattcgccggtgccgcgcgcgcgctccggcctgctggccctgccgattttcacggagcagtgcggggactgactaccgagacggcgctgtggctcacagtgcccgtgtgttttacagctcaacgtgggctcgccgcccctcccgtcggccactgttgggtgtggtcaagcaatgatgtggcgcctgtcctggtctgactgttagtcggcgcccgctgtcagatcttccctcctgtcttctctgtctctcggagtccacactcgcagttgcagtgctcaaggcgattcacagctgtttgcggcgaagcatggtcaactagcactcgtggcctgccgtacacgtagccgaactagacataatttttatttttttcattagtggtattagtaccatgtagcctgtttgttgtaccacgtcactgctaggatttagacaatcttttttatttaaggactgtaacgtactagagataaataagaaaccaaatattttttttgataactttagtattgtttaaaaatttcttatatataacaaagaaatagcttgattaacaccggaaagaacggatcaatttcaacgttcttgcaattcttgaccacattttagccgatattgtatatatatattggagcccttagattttagggccctgtgcagcgatcatacagtcagcgtttataggaacgcctctgccttttcagagcttggaccgtatcgttcaatgtaattggtgcaacataagtcttttgagtcatttacacgaaacaatgtgtgt

SEQ ID NO: 941 - DNA, 1079 bp, Zea mays
  misc_feature (1)..(100): optimal_loci_204448_G1, chr5:199160383..199161461, Cluster 6
gacctgaaatcttaacagattaaagtagataaagttagacaactaacccacctataatcatgtcgatcggacttcaggatctaaagctattagcgaaacgagactgctgcaacagagtatcatgaaaatcaatcattctctaatttcgagataaatcaagaatcacataagattaattcatcaaactttgtcagtcattacttgatgccttagcaatgatctagatggtccgaatcaagatgaaaatttgaaattaacaaaactaatccagaattaaaactaggcatgcaattaattagcaaagaaagaggaacgagaccacactaatcttgcataaacataaccttagtcatcaatactatgtgtacaaagttctctctaaaagcatcatagttttctctcaaaatctcaaaaatatctagatcaatctacttttagatcaaatctattgatattcattctctaattcgcgtctgggaaaagcaaaaattgatctcttatttataagaacagagagtcctattttagtccaaccgagccctccctgggccagccaatgccagctccatgggcccgctcacccatgctagcattgggccgagcgtgcgctggccagccgccgagtgttacattaatatcaaaactatatatagttgcacgcatgcacaagatgcaatattatgttacattcaatatcacataattcactttacaaagccaatgtcaatattaaatcaatgtttcatcacacacgatttcacacaaccataccaaccttggtgggttaaccactctggtctctgatgggctccctccccctcagccatcatcctttccttgtcttcgtgttaacatcggttgcagtggttgcaacctaggtatcagttacccgtgctgcacctgtgaggatatatgtgttcctcatgatggcagaattagcagtagagacagtctgttcagccgcagctaatgcggacttggtcttctctgcaaccatccatttccttcattttcccattcaccactcccggtgctgaacttctggcttaatcccattgtcctatactcctatcaaggga

SEQ ID NO: 942 - DNA, 1110 bp, Zea mays
  misc_feature (1)..(100): optimal_loci_205576_G1, chr5:205538487..205539596, Cluster 6
ccgcggcgagccacaccttcacgcccacacagtacgtgcatgctggcgccgccgtacgggcgcccggacggcgtctgttcgcttgtgtgataataaataatggccggcggccggggcaagggcaacgggcgagtgacggactggcctagcccgcgcgctcgtacgttccgagagcgtcagtgatgcagatgtgttgaggtgcgaaataagtcaaataacgctgcacgcccaactactcgtgcgcgaccagtgctaccactgtagtatctacacggtctacagcgtgtggccttcctgctccgtgtgaatctaaaaaaacagcactaatttgagacattgtttagaaaatagcactcattttcaatcaattcaaagaacatcaccagttttatcaaataaatttagaaaacaacactacatctatattttttttctcagctcacaagaaaatggaccaaattatccctatctatagataaagtgttgtttttcgaattaatttatttcgtcttaaacatcattgctgttttatgaattctccttccttgctccgcgtcgggtacggtcaatgatgatgtccataacactgtccgagtgagagtactgctactacgtactactacttccgaagcttctcgtaaatgctagtactcctgctacccctagtgcctatattattagcaacatggaggaagaaaagaaaacgagaataaaacaatactgtatttgtagtcatacagagtaggtaccgtagtagtacatgactagatggcatgcctttcacgtacatggaagccttctgatggcctgtccagatggcagcagccagcaaagcagtgggcagaggctccgggctccggcgctcggctctgggcctcgtttctgagcgctggcttcagctctggctgctggggcgccgacgccgtacagacgtggcctgcctgaacggctgagaagcttttgcgccggtggcgactggcgggtcatacccaggggccaggggcacgatgctgggcccttttttaatcatgaccccctctctccgcctccggcctcctcctcctccctgcgcctgcgcatcttttagcaggtcgcactgttcgcgtccaa

SEQ ID NO: 943 - DNA, 1221 bp, Zea mays
  misc_feature (1)..(100): optimal_loci_206017_G1, chr5:207888173..207889393, Cluster 6
  modified_base (671)..(671): a, c, g, or t
  misc_feature (671)..(770): n is a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
  modified_base (710)..(710): a, c, g, or t
  modified_base (711)..(711): a, c, g, or t
  modified_base (712)..(712): a, c, g, or t
  modified_base (713)..(713): a, c, g, or t
  modified_base (714)..(714): a, c, g, or t
  modified_base (715)..(715): a, c, g, or t
  modified_base (716)..(716): a, c, g, or t
  modified_base (717)..(717): a, c, g, or t
  modified_base (718)..(718): a, c, g, or t
  modified_base (719)..(719): a, c, g, or t
  modified_base (720)..(720): a, c, g, or t
  modified_base (721)..(721): a, c, g, or t
  modified_base (722)..(722): a, c, g, or t
  modified_base (723)..(723): a, c, g, or t
  modified_base (724)..(724): a, c, g, or t
  modified_base (725)..(725): a, c, g, or t
  modified_base (726)..(726): a, c, g, or t
  modified_base (727)..(727): a, c, g, or t
  modified_base (728)..(728): a, c, g, or t
  modified_base (729)..(729): a, c, g, or t
  modified_base (730)..(730): a, c, g, or t
  modified_base (731)..(731): a, c, g, or t
  modified_base (732)..(732): a, c, g, or t
  modified_base (733)..(733): a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
  modified_base (745)..(745): a, c, g, or t
  modified_base (746)..(746): a, c, g, or t
  modified_base (747)..(747): a, c, g, or t
  modified_base (748)..(748): a, c, g, or t
  modified_base (749)..(749): a, c, g, or t
  modified_base (750)..(750): a, c, g, or t
  modified_base (751)..(751): a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
tgtacatgacaagtaaacaaaatagtaccctaccgtgttttgcatcctacatcaaccttgccacgattcttcatgtacaccctctaaacatgtctcagtatgattgctctgttcctaactaaaattgaaccttgataacataatgctttaaagcatacctgaactcattcatgctaaattatatgtttcccactatcattggagtagtggcggatccaatgttgaattagggggggtaatgtccaaatgaccaatggtgaaggcaacacaagttgataggagggctttatttctctctcttcttcttactcattccttctcctctaccttctacctatttctctaatgcagtggggcttatttctctctcttcctcctctatactccatctctatatctattggagtttcatggacagagggggactagatccccctagccccttcagacctgccactacattggagggtcttccttatcataaaagactgaattctcaccgggaagcaaatggtgaacaactaactccccatggaccccatcagtcatgttcacatccacaacagtagattccttttcctttttgtttcatgtgcatccctagcttgttcaaccatctcatgttcttttctaagtccaagaaattcatacttagattcctcattcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaacatcgaccaacaaatgcatcttattctcactatttaggtcacaaaatgcaaggaacaaattaaaatagtctaccaacttctcttcctctatcatgcccagttatatatatatatatatgattgcttcttgtcaacttctcgaattcaccatttcagcaaggttcttctgtagatctgacatcttatacaagtgacaatctacaacccatccactatatttgcatggcacaccagcaaagctaccataatccaacttagtagtaagctgactgaactgaacacataatgtaaatgccgcgtccaaaccaatcatacccattcaaaaataagatcaaatcatcagtttaagttcactaatgctctcccctcccaccaaagaaacgacatctcaagtcaaatttaacatgatctattaaagggttattgagagggactagggtcttacc

SEQ ID NO: 944 - DNA, 1108 bp, Zea mays
  misc_feature (1)..(100): optimal_loci_209699_G1, chr6:13100394..13101501, Cluster 6
ggcttcccttggaacaacaccttctccaccttcaaagagtgctcctcacctaccatttagtagacaccaaaataaacccatgagcaagggcaaacacacgtgattcacatgagcagcagtgacgaaagaaaaatatctgaaggaagagtgtgttcatacaaggtgtcaaagtattcaaacttgcagaagtatacattcctcacagggcagataggccggggtatggatctagcccctgcatacgtcaaggtatggagtacatatagatacagctcttctgattttgtctcgatcaaggacagcgaggcaggaagtgatgtgtatgtcggcacgtgcagctgactcacgtcctccctcccttgtggcagtttccatctcaacccctaagggatcaatgtatttgcaactgtaaaaagtctctgatcagtggaagtaatatactaagatacatgtctgtctgtaatattaaattggaaactccatggtgatatgaaagtgcaaaatgtgatactgttataggtgtgacctgccatggcgatgtggtaacccccaaatgaaaatgaaggagctagattaacgaggatattattgaaacaggtaccagttggctagaagcaagatctgattatgtataactggagaaatgtagatgtacatagcagtatagcactatctgttctcatcaagtggtagggtcctaatcttgaagctagcaagcatcaatccttgcccagggctgtaacaatcaacagttttatcctagctctaatcataaaagaaaggagcagttagtgactgcctcaagaaaagtaaaaacataaacaagcaaccagagagaagttcagcaaacacaaaattcattttctcactttaagagaaaatattagtggtgcctctgagtggtatagatcaagtgaaatcttgttacatggtcttagtctgtttgaaaccagatttcagaattttcagaggaaaaacatttcacattcctttcatcattttagtagcaatctatctagctcaacaaaagatgcatgcccgtgctgaaatatgtgtgctttgtaccataaaacaataaatgcaggtgtaatgcatgtgaaaccaatga

SEQ ID NO: 945 - DNA, 1054 bp, Zea mays
  misc_feature (1)..(100): optimal_loci_2099_G1, chr1:10966932..10967985, Cluster 6
aacctaacttcactgaagtggatccgtgaacagttgttgatgcattgtacactgcagtccgttatgcaagattacaagtggcagcgttctgtttaacaagtatgctcgtcagctattcagttatcctggcggcaacgctctgactctgatgtctgatgtgcatgtgctgcatcacattggaaaaagagctcatgcaccttactctgaaggggctagatagccaaaaaaacgctggctgctacatttcctagctcccaggagttaatagatgcctgttaatcgtggtttgctggttgcaagtgtattaatgttagcatcgggcaatggccacgcatgttggcaggaggaggaggaggcaggagctggtccaagtgatggaggctggcagtggcagacgagagaggcattcaacagaagagtgagtgtgttaccggctggaatcccaatgggtggtagtacgtttctgttcatgagctcatcggcctgcaggctgcggtcatgcgttgcgtgggtgtcctgagctcctccgccatacgcatcagagatggctgcgccgacagttaatgggcgccctgctctgccccgcggcagcgctggttgaccgtccggtaacatcagacatccccagagatgactgcgtcggtcatgttctccaaaaacttgcagtgcccggccgtctctttcacgtagtacttactactgcatccgtcatttcgttgcctcaacagttgcgcgcgcctcagagtgcggcagaactagttccagtttggagtggaggaaaccgggtgggtaggcaaccctgcctgttcttcagtggctgcagaaagtttccttgattcctcagctgtgctactggattgcgcatgggcgcggctacctcatctcatgccatcgctatctctgctaccttgcattggggggccaagtcttgtgaggcttgtcaagtgagtgctgcttctgctgcatcggggtaagtgatttgtctgattgtttctctgtcatccccccctcctcctccgactggcttggcttggcttggctgatgggttgttct

SEQ ID NO: 946 - DNA, 1250 bp, Zea mays
  misc_feature (1)..(100): optimal_loci_210220_G1, chr6:14762553..14763802, Cluster 6
gacaaaatttaccaggtctcgtgaatccttctaagctcctgaccagcattgacgaacagatagcggaaagccagggaggagccgtccaggagagaaatcatggagaagataaacaagtggctgctggcttgcgaggaagagaaatggctggatgagtacaatatggtaggtccaaaatgtgggtttggatacatcgaacactgatttcaaatgtggaagacagataaagaccaggcaaactatattgaatgggagaggataaagccaatcaacatatgagaggtgattattttaatttgcaatttgtctacataataaattagatacgaaattgtttgtcatatattcttatatgttgtgttgtacgaatcatactttagttttacattttacttttatatatgcttacgcctttgccataatttttgcaccattgatgtggtgagattatgaactcttccgtacattattatgcttatcccaaacatatgaaatcaaataagtacaaattgatatgagtccgcttgcatattcttattctgtacctaggggtgaatattcggttcaagtgtattgttgggtatgagctgatatcaataaatttagcattgcaagtgaatgaaatactgaattgcatccaaagggtcagaatatagggtgcggtttgaattcaaatacaatcttacagatagctaatggacagggtgtatgtatttttgtctagatcgacttaccatctatgtgctgattctttgactatcattatgcattcatacttttgacaacagctgcaagttcggataataactgaatcacagattgctgtgagcaaactaattaataacagccccaaaagttgacaccatttttgtgcccgcacactgttctgtgaatcagaagcagtttgaattatcgagtcctgatgtttttgtctctgctacctccaagcctgcagattctatcaagaaaaattgatagaatgtttttgtctctgctagccttgtccataacagccccaaaacgtttttgtctctgctaccatggaccaagtctttggagtcatgtcctgactggaccacgtgaacacatgatactgggaccgcgtgaacgcaagaacactaaaattgacatagaaaaattgattatgtcatactccctctattccaaaaaatagggcgcataatttttttcacaaatattaatgcagctctttacgatacttttcttttctctaatgcccctatgctaga

SEQ ID NO: 947 - DNA, 1181 bp, Zea mays
  misc_feature (1)..(100): optimal_loci_213435_G1, chr6:34606735..34607915, Cluster 6
taatccggtaacctagttatatgaaaatctaactctttccataattataaatgtgtcttacttatctattagaatcgtgttctatttgcctagaactctgcctttatggttggattttgtcctatctatttagaattttagacttgtctcttctgttctggtaatatctctgccatatctgtactacttctatagtcatcatattagaccttcgaaaaaccatgacagctgagtttagggaccagatagaagatgactccgacaaatttgaccctacacgtcaatcgatgagaatgaaagtccacatacgtacgggcgtagcaaaattttaaagttattcgaatttttttgtattaactattttccctatcgaattattagagaatttcagggtatggcatttactcacccagccaaccagctcccgtgcaaagtttacaattcgaaggacgatcagcgagcagcagcacattgacatggggcagtggctcgggtttctctgctggaatggtcatgcgcgtgcgtgtcgtctgcaatctccttcccgcatttgccagcaattaattaataaatgcccggctctgcatggttggcaggcgtaattctcttctcttctctggtgttcttgagctgcatgcgccgcgccgtgcggtgcggtgcgtgtgttttgaaaatggaacctgtgtcgcaaaagcggtgtgaacatcgactcggccttccttgtgtgctctataccggtaggagcactcggtgtagtgtagacgtcatttttatatctacatgtaacaaaaaaaaaaccgaaccgattttcgtttctgggtgagtaccggtaacgataaattttaccgaaaaaacggtgcttaccgagaaaaaaaatgtaatccgtttgtatagttgcataaaggacagtggacatcgttgtccattcccggccggttacataaaaacaatgtaaggaaaccagcagcgagaaattccaataataatagacccaaactaattaaacatggtaatatagtagtgtatatatatcatccgaagataaactagtacagtacgtttgtatatacatgtttttgttgtacgctgtccaggtacgcttaacgaggatattatatttatttaatcatgggatatgtatggtttgccgcgtgtcctcatcagtcacagtcagtcatcac

SEQ ID NO: 948 - DNA, 1023 bp, Zea mays
  misc_feature (1)..(100): optimal_loci_2145_G1, chr1:11134920..11135942, Cluster 6
ctatatactgtcataaaatgttccatagaaaaaggtactaattaccttatctgtgtgaaattctaattcgataaagcctgaaaccacaggcaggtgaccgtggtagtgacatttgtcacataaaaattcgatgagtaccgaatatggcaaagcaaactgatctctacttgctcaatcgtacaacaatttctaggataacaaggcatttcggggtggcgggaggtccgaagcagttgtgatattcaccaagaggtttggcagaatggcagctgggtcttcactgccgatctaaattgaagtagttctatagccttctgccagtttttcataccaatccaatctcatagcatatttgacatgtagtgtttggagcattatactcaatattaatctcaggtctttgttgcatgtgtatgtgatgtgtggaatgaaataaatatcagtagaaatcaaactatatggtgttttgtagctcgcctggtaactcttggtagtttgcagtttcctagacatgcagataccattgttgaagtggaaattatcatttgttttttttttcttgtacgttcagataaggtaaatgtatattcgtacattcagtcgccatacaaaagctcgaagccgaattctcgggaaacgaatctggtcggtgtgaagccaaatcagcatggaagagagattatatagagacttcatgtccgatccagaatctcaccaaaggcatactccgcgatgccgcgcgctccgaagtcgcttttcctaattaatacgtatttgaatactggccatagatcgaggtggcattttgtatggataaggagcatctgaaagagggtagcgatcgattccaggcaatgcaaagtgggtaccaagagatccgaagtgtggcagcttgtaagtggctactgaaaaagggaccatgtgacacagcgatgctgtttatgcttagatcacaacaccgttttgtacctgtccgtttacttcactatgtatatagtcatacaaaacactgttttacactgt

SEQ ID NO: 949 - DNA, 1240 bp, Zea mays
  misc_feature (1)..(100): optimal_loci_217402_G1, chr6:63762351..63763590, Cluster 6
agtactctatctaccatggataacaatggagaaaccagaaacaatcatagtagcaccaagagggtgactgtaattctagtgtggaataaagatcattttgggtatgttacatgtcattaaggacataaaaataatcatatgaacaaaagaaacataaacaagaactcatagttgcatttgtacatctgaaaggaaaatattggttgaatatgacttcctcagtggtcatatgcagccaccctcaaacgatgtttcttatctgagcttgttctccagggcactgatgttcattaatacggtttctatatatcacatagactgtgtttaaatgagattatatatgacaagtttgccatttgatcctaatgtaactatgagtagagattatagagaacgaacttacatgttgtcccaacaaaactttccattcaagcatatagtcaggcaaggaaagtcttatcatataagtatgaagttgacatatttcaactatgtttcaaacctttataattatgaagttgacatattttagttgcttgtccaggctctttataaaatagattcgccactgctacatccgatgcaccttcccatgccaccacaccacgaatctcctcctcgagcaccagctgcttggtgcacgcccactaccccgcacacaggtgtgcatgagccattgacacactctccatgtagtcgaacatcgacgcgtagaaccgctccaggaacgtgggcgtgttgtggttcaccttcgactctgccaccaccgtgatctttggcatcagcgcccgcaccgcacgcaggaagctccccagctccggccacattcctagagcgcccacactctgcatgagctttatcataagcaccagcttgcttcgaattaggagtggatgtgatatccctgacattggtgtccacaaggcccctgccataccccatgaagctatgcaattctagttaaaacatgttaagacttctaaaactaccccatgaagctatgcaattctagttaaaacatgttaagacttctactaaaacaaatacgtgtatgacattatgcctaaatgaagtagctgatgtattaaaaaatgagttgcccatgatccaagcatcaaccatcctcctgactgcaattcagtagttgcaatgaaaactatccttccggtaagacatgaaacaaaaatgtgttgcgcaggatcgactatagcagcaatgtccatagctggttttaaggaag

SEQ ID NO: 950 - DNA, 1080 bp, Zea mays
  misc_feature (1)..(100): optimal_loci_220933_G1, chr6:85610295..85611374, Cluster 6
cttacaaacacagaacctcatcggactaaaattttgtctgacattagataatatatgctaaatgtagactagctaaaaaattctttcttctattgagttctacttatcaataagtcgattagtttttggtagaccataattagttaatatttagacattcaaaacatggatcaacaactatagaagctagctaatgctatgtgcgcctgcctttgcgtgccattagccacctggcatgttctccaaagtaagatgacgatatctacggaaaaaaatcttcctgtgagcctggcaaaagaaaagagttaggtctgtatccgcagttgcttttgttgcattattccttttttttacaaaaaacaacacatgccaataaattagtatggtgccgttcaaaactaaattctcactaaaaagaattaatttcaggtaaagtatttccatgattactactccaatataatacctactgatctaaactaattcattattagcttgtcctgagcctacattttttttgaaaaaaaaaatcatgctttttttgtgactgaagggagtaccatgtagcagctattgggccaaagcaaagcatgcggttgaggagagtgcgttgtactatagtatatgaaatcaaacaccaaggcaagacagctagggaggcgcacacacacaccaccaccaccactattgggtcccggtttacaaacaaatagaaccgtcctaggttagcacttgcgctcatcatgcagcacgctaatgcaatgcatctccttttcagaaagtaaaccaagttgtttctaaaaattgaccagcagcacgtagtgactgagaaagatacttccgaattagggcatgtgggagttgcgataggttatttctaacacatctccttctgttgtttaatgttttcttgactgatagaggaatctccattgagtgccatgtaatgacaaaaggaaaatgttttagtactgtgcgatgtgtttgtcagctggtggtaaagcatacccatcctgctgaaaatatcagaaggtaattaaggtgtgtttagttgcgggacagctaggacagggacgtccc

SEQ ID NO: 951 - DNA, 1358 bp, Zea mays
  misc_feature (1)..(100): optimal_loci_224336_G1, chr6:105344327..105345684, Cluster 6
aagaggcgaagacttgactcctgcagcatgatatcaggagagatctgctgcacgagtctttgaggtcccaagggtgagctccagctcatgctcgtccgaggcgcactcgtgtatccgctccccctcacacgccttcagaagaccagctaggcgacccagcggccagcgttgccgttgcgctgccgccgccgccgctcccgaaggcgaaatcgtctggggcgccatcggtcatctggacatcgtcgtgacggatcggcacgccacccatcacaggagaacacgtcccccgctcttcccagctggggtgcacatcctcgaggcgccgccgccggtctccctggggcctggacacaccgaacgggttcggcggtgtcagggattacagtggggccgtcatatgggccttgggctttggcctggtcgaatagcacacgggcattttctacaagaagcaagaggaacagcgagaggggggaaaggagaagagatacaacatacaacatcatcttcctcctttctagctgcatcatcttcctcatctgtagctagctgcttctagggttagatttccccttcgttaatcccctacgtattcccgcttagcttactcctgatcttcccatcccgaggtcgtgtatcccggcttgtactcattgtaccgtgaaaccagttgtgttctgcgcatctgtctgtctgcgatctgcatccatcatggagtgggtgctaacacggtgccacgaagctgtagacgaagggccggcggacgaaatcctggaacccggccagccacgccgggtccggagcgaccagctgggctcggcggctgggacctgggagttgggaagggacgtatacctcgccccgccagaccatggcggccactgatggacgattggccggtttctcgttctgaaccagactgtataagatttgcttcctcaacatgcatgagccctggttgttgcctcccaaggtcgctttcgctttcgagacgatgcagcaagcaactaacggtcttctaatatggggtccgtacgtagtacgcccaacagtcggcgctaggccaaagcatttgagccaacaaaccccgttgcctgcttcattctgatcagctgattccatagcacagggcagaagggctcaacgtgtttgctgagacaaggcatttcctatatatgaacgccggttcaaaccggggctctctcaaggtgtccacgtcacccaaaatattttcacacgttcgaattctaatcaacagtcacgacctcgttcctgtgacttcgttcttacttctctatatgcctacagaaccttctttctaaagtattctccttccagccgcacaactgtgttacaac

SEQ ID NO: 952 - DNA, 1047 bp, Zea mays
  misc_feature (1)..(100): optimal_loci_229440_G1, chr6:131756759..131757805, Cluster 6
gtataaggccacccacaagacaaaggatatgcctagccgcaccaagatcctcatggcccctaaaatagggacgccacacttgaggcgtactcttgacaaccccataacagtaacattatggataaggctcccatttgacatattaaatatgtgatgtgtagcctaaaagatatattatcgccatgacttaggcagtagggtattcaagaccactatttgatatgtgcattagccttgtagccaagtgtgggcaaggtagtataccataaaatattatcaagtacagatcactgcactagatagcaactacgacatatctaaaggcacgaattccaacgtccatggaagcgacataacttgcccctgtgacaggtatggctactactgaagaatgacatccccgacattgtgccaccaaagacatagatttatgtactactacatggccaggataagatcatggttacctatggttcgactatgtaaactctttcatctcgtgctctataaaatgagaaacaaagtaatgattgaaggagattcacatgaacatgttccaagcacacaaggtcggatttggtcctcacaagtcaaagaagtcaccccacttcatctaaagagtgcaatgtctaagggaacacataaaggtgaattatggaccaaaatggtacaattcccatcggaaccaaagtgaaaagggggagctaagaggtcatggtgctcagttaatccttgaacttgtaatcatgttcacctttatattcatcaatcgatggatagcaagataatgtatggtattgcgcacaatacagatagaacctctctaaacaacctacgtgctagtttccgttcctacccagacccaccacactgctcgtctacgtaccctctcctccaataactttttttctctttggtacttcatgtactatgatgtcgtaccacgatgacggtgctatttgtatcaattgttgcatataaccaaatctcaagaattgcaatattcctgtaacaacaacatttgttgttgacgaggattttccattg

SEQ ID NO: 953 - DNA, 1094 bp, Zea mays
  misc_feature (1)..(100): optimal_loci_229553_G1, chr6:132185102..132186195, Cluster 6
gatacatggttttttttcaaaacctagtacagacgtacacatatgtactagccattgctaatgaggccacccatgattatagtgaggcctcccaattgaatagggttaatgtatagactagctctccactgtaggaacaatactaagggttcattaagacctagaatcagttgttctagggtaagatatcagattgccctctagcgctccaatgctatgcaattaagatctggtgcctcccagaggccttctctacctcacttcttctacccttttgcaattgtgctaactctaaaaatgtttcagcgctagtgcaagtgagttaccatcttcacaataattttgaaaggggtttcacatcctcactagatctaatacacatgcatagagtcaatccacctagtggcacataaataaccatttttaaatatatcctaaattcgatcatacaatgtattgtatcttgattggaaaaacaaaatgacttagcttataactttaccttgaacccaagcattttatttttttctctttcttttctaagaattgagcacatgatcatcatatgtgggcatccctgatcatctccaagagtgccatctttctcaaccatggtgtggatttaacttatctcaatcacaacactatagtagatgttagtccactagttttctcaattatcaaaaccaaacatagggctttcaagggtggcaacattgatgtataccccctaaatttgagcacatgaggttttgtatggtgatcatcattgttctttgttctattaattcttagatgcagtattcactttccgtatccctctctccaactttctctcccttattgttgtgcttgtagaagatggtgcactatgagtaggtgcacaatggaggatgggtttggcagctaagcgtccatgataggtggtgggtaggccggttgggaccctagtgtcaatgatggcataatgatgctggcgagtttttgtgactcatgcacatgcctttcattggcatgataccttgtgcggcagcccaacaccatgactgcaagagatgaggtgacccagagggtgcgcacctcatttgagatct

SEQ ID NO: 954 - DNA, 1062 bp, Zea mays
  misc_feature (1)..(100): optimal_loci_229777_G1, chr6:132980468..132981529, Cluster 6
gacgcgacgcattttctatccctgtgtgtgtgagagagatgggaatgaatgtgacacggcgaaaatgcgtgcgtgctcatcgttccggacacgccgcacgaggttggccgggtggtggtggactggtggcgagtccagggcggcggttcccgtgaacgtgccaggccggagtgagccgctctgaaatcgtgctgtgcccggacactggtatggcatgggggtgacgacggcgacggggattggtgtggtggtggccagccagctcgcgtcttggtcattatggtcagatttttctccgggaacaggttttcgccggagggtccatggcctcgctgtctgcttgtgtcggcggtcactgcactctggtagaagcggtaggaggaggatcttctcagctgagcccctcgcgctcccatgggccggccattcattgattgagaagtacatgcgcttgttgcgtgactcgcagtgctgttttggccagcggacgtcattaaggacacatcacaaggcagatgccgctttgccccttcttggtatctagcccttcgaaaatcaagtcttaagacttaacacttggccgctaaaattagatgcacacttccacaaaacgtcccagttagccaccttttccacctatctttttcactcggtaagaagaattaacaactcagacacaataggatcaaactatgcgagaagattctaaaggatagtcttatctgtcttagctaatgactcggccaaataagcctcaagggcaaccgttaaagataggtcatgacagctggatctatgtgctcagcgacgagtccagagactcggcccacatgatcagggacataccctattcacaaggaagttcaggaagataaatatggtaaagatcctattagattagaagattagtttggcatccatgcaaatatggcaaaacccatttgataaggataaaacccatgtaccaatagagataagcaaccatgcagatgcagtacaatatagatttagctagacttggtaactatccatattatgcaaccaacccagatacatattcta

SEQ ID NO: 955 - DNA, 1162 bp, Zea mays
  misc_feature (1)..(100): optimal_loci_230092_G1, chr6:134561819..134562980, Cluster 6
ctaaaaaaactttactagtacatgtcatataaatgagttatgtctaagtaattttttattgaataagacataaggtttacaaacaccatatcgaacctatgtgtgtcttagttgtgtatttttactgtaaaaactgcgccatagtgtcaatatgctagtgtttgagattattattatttatgttctagttttaatctagaaatcgactatttacttaatggccagcagaaaaagagaagtgcggccgtgcgggacaccatggcaccatggttctcgggcgggaagccatcgggattcgggagtgcaggcgggagcttggccggcgcctggcgccagcgaggcaaagtgcaggcacgtcgttctatcgccagtggtgacggaggcagtaggctcggccgttggcgcacgggggcggagatgcggccacagattatcgatgcgacgtccagtaccactacctttcgaaacaaacacgtttgaaatttgaatgaatggatgtacgtagccactagacacagctttggcgccatgtaggcacttggaaaggagcacacaccaaactgcaatgcctcatttatgtctcgtttgatgtgatagggatctgatgcgtagctagccttggaatgaagagccagactggcacaaatccaacggaatgaaagccctagctcctagctgaaactttgtgcaccttggaactttgcaggtatccatacacttgcgctctctctattctgatttacttaatcagcagtacttggaatcacaagattgtaggtatggtactagtagttaagagggagagtaacggtagcttttaacctatgatatctaatactttctttagaaagaaaatcttatttactatttagggcatgcatgtataaaacacataaataacctctatcttaagaggcatctaaggggataagtataaaaaaaccatataaaacacgtatattagtgaatgaacgtctctaacatggttttctaagtctaatatatgattccatctatacaacccaaataaatgagccatgtcttaaaggagttctagtgaataagatataaggcttagatacattaggttgtataaacaagtttcttagatgtatctagtgcttggagaactgtaacctagtatctatattgtacataccct

SEQ ID NO: 956 - DNA, 1118 bp, Zea mays
  misc_feature (1)..(100): optimal_loci_232110_G1, chr6:143978751..143979868, Cluster 6
aacgacattttcttttcttttctctctctcccaatgacgatggctatggctctttaatttataagaccacagacgcatagtaaatctacatacaagcaaatcgtgtccaatcccaaggacagaaaaagacaccatgttcaggtgtcattagtcaaaggtacgacttgcaggaatggaatggagagcagctggaaaacagtttcaatatcctcatgaacaaataatacaagtaataattacagggaaccatgtgctgtgctacattgctggtcacgtaacgtttttcaggaatcaggatatttatttgtcccccccccccccccccccccaagaacctcttcatcgtctcgatcgattattgccggcgttttcgccacgtactgtacaacggcacatgtataagtataatgatgaagaccattggcatttgaaaagcaggcaataacaatcgtttctttctttgggggggggggggggggggagaaataatagtaaatgtcatcaagaagtggattattgccagtagtttattagtgtaagaatctgtatgacacaagccacatttgtgcgctccagaacagcagctcggaaggcgcatggtattctcgtccaaaggatctcatgtagaaaaacccgtgaccaccggccagcttaatttgcacaccgcggagaagtcaccaccgccggtgagcagtcacgctcaaggatatgcgcatgcatgcatgcacgataacgataacgacgacgatggcaacgcaagaacggagggggcggcgatgcgtcaactacctccgagattttgatattcgccacgtacgtgttccagccaaaggactaccgtctgtccaaaaagagtgtgacaggttgtagattgaagccaaactattttttatttaactagcatatatatatctcatgtcaatgttatgatcgcaaagtgtggaagagagagatcgacggtggtggcggcagcgcaagtgaagagagggggatgttggagtcgcgagggagcgagagagggggataagcgatgaaaagagaaatgatccaaataatattgtccattgaatttgagtaagtgtgaaggtacggtattatccaacgatctgaactgtagg

SEQ ID NO: 957 - DNA, 1260 bp, Zea mays
  misc_feature (1)..(100): optimal_loci_232874_G1, chr6:147872987..147874246, Cluster 6
gcacgcccgatttatggatagtggcgcgggaagagagggtgggtcggacgaagtgaaaagaaaaacgtctgaagctgtccgctttgaattaaaaccaactattcagctgtaatatatatatagagacaaaaactatagaattagtacaagctgatacgcaagaaatccaatacggaactgcggttgttacgagtgatttctatgaaagtgtatacaaattatgatatattttttgcattgtaagcgcaaaattgttgtccgcactcgggtcgtgcctccaggcctccaagttcttctaaccctcacgttcacggagtcgtggtcccctgagcgtatcgtcgcggataaagcaccgccgtttgggctcaggtcgatatcgagatcgctcgccgcctccgcaacaaggccgcgatgcccgccggcaagaaccctctggaccgtacctgcgactgcgagagtcaacatgagccacagttttatattgcgtgcgtgctcgttcgccgcgtaacttacgtggcggatgctcctacatgacggatcagaggttgcctgaacctgcaaactcttcaactccttcaagcaaattccacacatcaaacttttcccaacaatttgtgcctcctcgccgtttgtacatatccactcctctctctctctctctctccatcacaagcgcattccacggccaatcctccgtacgtggcagcaccatgtgctgggtgcgtaggggcacgaccgcacgatcggcacgcaaccgtgcaggagcggtcgtgtgcaggcaccgaaccacatcttcaaagctcggtcaatttggcacgtgggcatcaatacgcacgagacgcggtgttgcggtcgacatctgcacgtctacacgagtcgttgtcgcgacgccttgccgtacgcccccgctgcttctctctttggtcggcggggcgtgcgtgcgtgcgccgctgaccgccgtacccgcctgcgcggtggcgatcagagctcgagctttgcccgcgaggggtgtgtttgactgtacgtagggtagggtccaaatgttttttcatacaaggggtgtttggttttctaggattttaccgtatctaaggcactaaaataaaatatataactaaaaattagtccctataaaccaaatactccaggtttgagcctttaattaattttagttcaaaaattaatataaatagagtctgatcctaatctaattcaattcttaaattttatggtgtacaatttagaacccattaccactca

SEQ ID NO: 958 - DNA, 1341 bp, Zea mays
  misc_feature (1)..(100): optimal_loci_233460_G1, chr6:149939661..149941001, Cluster 6
cttagcagggcatatggatcaaaatgaacatctttttaagtgcatgagcttgctgtttggaacaaatgaaatcattggccttcaagcgtatcgtatatgagggacagcatgtccgttccttccatctcaggtttgtaaagaaaacaaccagatctccaaccacgatcaagaagagctgtaaaatttgcaattatgatcacaagtcagagtcatgccatccattctaaagtgtttttcattccgttaggggaaaatatgaaacagcagatattatgggttggaacctgtacttactatacttcagcaccaacaagttatcttgttccatttcagttaaactcactctttctgttaaccacctagttaaatgtatatccccgaagtgcacacatacttgttctcaataaacttatttttcaggatgcagatttttcactgttccgaattgctagatgtggcagttttcctcgaatgtgctgcaatgtggcaatttatttgtttgtcatacctttgtttttaatcaatccaatttatcccaaactattgtcttgcatgttaagttgagtttaatttaggggtgcaaatggttacccaatgagtggacctgatgacccagcgcaagtggaccttgcatctctagttacatttgtcttctcagtatgtgaaccaaaatagtcgaaagcgaacgaccaggtacatcaatttgattagtttgcctagttaatcggtcagttaactactcatgattagtcagctctttctagttgaactagttgctgctgacaggctgacggtaacttgggcttcagcccagtagtattcaaggcccatcccataccaccacatcctatcctatatactaaaacacaggctcctctggctttgacctagctgccagctgaaaggagcatgagcaggaaacaggaaaatcattcgaccgtgatatgaagcctactgggatagccaataggctaggcaattgggcaatacgcttccctgagtcgactagtcgatgcctagtcacaatataccattaactgcaattgccttccactgggtgaacattatattgcagtatgttccaccttgaaacctgcaccatgcaacaagaaaatagcagacttgatctatgcacatcctggatctagcaagaaaccaagaccccaattgaagttgaatttttttgctatcttgttggaaagccatatttcaatcaacaagttagcatgaaactcgtaagcttatactaggccccaaatcccaccacaggaactggaaaatccctgtggctaacagaacatgttggaaattggggccggttgactgcagaaaataactaat

SEQ ID NO: 959 - DNA, 1290 bp, Zea mays
  misc_feature (1)..(100): optimal_loci_234051_G1, chr6:153207623..153208912, Cluster 6
gtcttgtgattcacagacagaaaaggctgacgacagacattgccaggctatagcctataggacctagtatgttagaatcagcgctaattatgcttggctatataggattttcacaacttattagtttaaccatttcttagaatgaactaaaagcaggtaataagcagaagccgtttttcacgagcttctcagataaactactttttcaataaattgcagtagttgtgtcaaacagagtcgtagagaaaaatgagaaatctgtcggccgtaattaagagctaagaccagggttatggctctggtgtgccagccaggcccgtcactgaaattaaagcaagggtgacctttctttttatttctctaaaaaaatacattaccaagttttaacttagtgctggaattaaagcaccctgggggccggtacggtacggccgcagctatatagccaatcctataacaacagcgctagctccattctggtcgtcaatcgcacagttgcgagacagctagcaccacattcaacactgacgagatacaaacagatagtacgcgcgtacaacttaaccatctgttgcagatttgcagtcgcatgcatgctgtcttgtgtgtgaatgaaaagcttcactcgatgatcgatcgatcgatcgagatattattattcgtctagtggtccctaccctaccgtttattttccttcagaaaaggacatacttgcatatgcataattgcatatatatttactaaggatctgtttagaatcaatctaattttttaagaaaccagtttttattttttaaccataagagatcagcttcttggttttttttaagaatgtgagaatctaatttctataaatcgagtcataaattggtatgtttagaaccaactcaatttctataaatcggttttttaaaaaactgggtgattctaaaaaaacagggcctaacttctcttacaaatagaaatacatcacctcaaaaaggattgatgaggaggttaacgaaaaaaataaagatacgggagagggaggctttttaggcgaataggaacttcgagccaagctcatcggcatgcatgctggcggtggcattgggatggatgatgatgcatggatggctttgggcactggcctcatcaaaacatcgtctcgtcccaacgcaacgaagaatctagctaggtacgacacaaactgccactgctctatcggtctcggcttcaattcttcagcggcggaagccaagctactctagctagctagctaggcgcttaggctgtctccaacaagaacta

SEQ ID NO: 960 - DNA, 1126 bp, Zea mays
  misc_feature (1)..(100): optimal_loci_234055_G1, chr6:153216320..153217445, Cluster 6
acttatatgttgccagtgtcgatttattgcctgttgctacattttacaactcatatgcctcccgttctacctgttgtgcttcagtgctcagcacgagcacttgttttctttgcagtgcttctgttcttgtgctagatatttattttatagagtagctctggttgacaagtgccagtcaatgccttcctgttttctgattggtgcacattaactttctaatcagtcataatctctattcacatggttgctttaatttgttctgctgaataacttcaaattgtgtgaggctgattttggtccaggccatgctgtgtttaaagaggaaggaataataactgttgttcgctttaatgtcggcatgtcagatcgtagtgagatgcagaaatgtacgacctgatcactgtcttatcacttttacataaggtttatgcaaacgatagcttaagcattttccattaactcattgtgaaacttgtgccgcacaaggaatttgtatggcgcccgatagggcgctgctggttctagtataatatataaccacccactgtcccgctcgctcgtaggctcgtagctagcgtaacgaaccagttactctaaaactagcgactagcttcattctgcaatgactagaccggagcagacagcaaaagagctagccacacctgagatcataaagagcactagctagctatagtaagtactacagcaacaattgcatgcatttgacggttatactccgtcctgttattaatgatgtgcgtgcaattgagcacagcacactcttggagtttcatgatgatggagctcccgtgcgtgcacggatccagccgtgccaaaaccatgcatccattccatgtatgcatgcagattatgattcgcggcaacagccagtattactccccctcctactagggataattaaaaacaaatggaaacgggtcaaaaaaaaaccctctttcgcacgttcaatttttgttttacattttcttgcgaacacggaattaagttcgaaaaatccagattcaaattaaaacagaaccggcggggtaggcaggtgatatatacagggaaaaaaattgttgtacacaagtctgtaaaagacaggaataaaatacccatacaggtg

SEQ ID NO: 961 - DNA, 1067 bp, Zea mays
  misc_feature (1)..(100): optimal_loci_234269_G1, chr6:153846338..153847404, Cluster 6
tagaacgtccggagagcatgcactttagatgtacagggatggctcttgccctatggctatcggaaggctagggatctttgcataaactgaactaaggtaatgctaaatgatataattcatcatgtctatgaaaagcaagaacctacaaaataagaaattttgttctatatggctctcgttagtccagtgttgtgttagaataatctttttaatgagaaatttatctaccctatctctataaacataaagattaatttgaattgatggaaccgaattaattaaagtataaaaatcaactgctcgtgtgtattggtgcctgctatcctgtattgtgttgtgtgctgctctgcttgtgtgttgcgtgttgcactcctgaggttcagtcctttcctcctcaatgtggacgtgtggtggtgcactgctactctctggcgttagttgctgccttgctggcctacagcacgatagctgctgctggtagcaagggctagtggctagcacctctagattgtggcacaccacacacgagatggtgacgcttggaggggctgtaagcacaaccgtggctgcagatcaggcagccacaggtgcagatccgtccctgggtctttatgacatctgaggcctacccatggtcattgatcctctaatgggactctcgggcacgatcgatgtggggtgcaccatggtattatctgtggccatgctatgtggataagctagttttgctacttgtataggttaatggaagagttaatggctagattaataaaggtgtaagtaataggtgtaacattggttactatatattctaatctccatgtaacccctattattatatttagctctcatagcacgagtaaatgggtacaacaacaatagcgcaaagctacctctcacttctcagttgagttgtgtgtgaatctctcagtctcgatcctctatgtgcacgaagagttgggagtggcctctagaaccatcgaccgctaaagacacatactcaggtgtgcggacgatcttgttttagttttagggagcattttgcgactactcgctgaagatctcaa

SEQ ID NO: 962 - DNA, 1086 bp, Zea mays
  misc_feature (1)..(100): optimal_loci_236070_G1, chr6:162739641..162740726, Cluster 6
tggatagaagagttatagccttcatccgtcacggtactcccatcaagtccgccagcagcacttccacttgctaacgacggacgtgtagatagatcagtcctgagcccttgcattttgcaagatgtggtccaagaaacggtgagctgatgatgatggccgcatatatgagcaccagctctgaagctgcagcacgacatggaagtaactgtatttcaaatggctaggcttctcctccactccacgcgtgcgtccttgctccagcagcttccctgctctgctccccgtcagtcagtcaaagctgcgtgcgccgcccactgggcctggccgccctaggttgagctggtctacagtacagcaggacaggagtacgtcctacggctacgaccatgcctactgtagtagtgtgactattccgttgctgaaatataggggagctggggtggctgcaagcgcagccggtgccggaatgctcgtgcacttggcactgctactctggcactggcagtgctccagtgtatagtatactcactatactctactagatgactcgatgaatatgtacattagtgctgcctggtttagggtacacaattatcacggttttgcgccgacggtcgtctaaaaagccagccacggaacagagcccccctccgcagcgcagggttgcacaaaaaacaggggtcgtgtcgtgtcgtgtcaggcttccgatctcgttctcgggtatacctggtggaggagcaacttctctttttttaaatccgtaactgttccttagtgaaacatttgataaaatacttcctgcttcccatcccgattctaacatgtctcagcgtccaaatccatcccgttcttatgattagcacggacagcgcacgatgaaatgatgaaccgtacaccccgttataattaatgctccagtatgtatattttgctagtaagaacaggtccatgtctttcgaatcggggcgtgctacgtctttctttgtatatgcatgccggtgccaatgcccgcgcgtgaactgtgcgacggtagtggtacgcgcacccacgggaacagtcttctactactttaaaaagacttagggg

SEQ ID NO: 963 - DNA, 1048 bp, Zea mays
  misc_feature (1)..(100): optimal_loci_236682_G1, chr6:166080711..166081758, Cluster 6
ttgaccatccttttatttcgctcgcggtatctactgccaatcgccatcttcgcggtttgtgtcaagaactagtagctgttttttttataaaaaaaaaatcaaagagttgtagcgtgataagactgctagatcgaagcgtcgacatgactacatgcacacaaaatatagaaaagcgcgttgtttgctagcagcagaggtattgaaaagagcccaactaacgaagcgctacaagtgcccagtccaaagcgcggatcggtcggtccagttcccgacttcccgtcgcctcgctctcgccttttcatgtatggccgccgaatcgccgccgatcgacctccagcttccctacccctctactggccgacgagcaactacgactgttcccttgtgccgatctcttcgagtcaatcaaacaagagagaaagaaaaaggagtactccgtataatcgatccatagcaacgctgcatgcttcgttcgccttggagctaggtatatacactgtctgattgaattcgtttccttttattttgaaaaagatcgtgttgattttaatatacatacagtttgggcattgtgcattattaattaaacaactaggctactagtacctactagcagtttgtttaattagtgatcatctcacagattgacagacacaaaagggattgcacgtgtgacggccaaaacattccgcggatcaatggatctgtcagttcgggtcggtagaatattatattatttatataagacaacccacgcattgtttgctggcctggtgtagatggttcgcccaaaggagatgctccgagatatggagattattgcatgagtgctactagcgtctcctagagctagctagtaaaaagagtgtacgtgtgcgaaggctagtcacagtgagaatttcatgtctctattttaaaaaatgccacatcagctttatgaatgaatgaaacaccctctcttaatagagagtttcatctcactattttatatgtcaacatactccttaaatgctgcatataaataaccaatatgatttactcgattata

SEQ ID NO: 964 - DNA, 1364 bp, Zea mays
  misc_feature (1)..(100): optimal_loci_236774_G1, chr6:166628724..166630087, Cluster 6
agaataatatatagtagtaccccctatgcagcacccgctgtaatacatggatcacactatttcatcagttataaataccatgagatgaatccagaagaaaaaaaagttgtatgtttgagatttgtattgcagaagcccattcttcagcctaccgaactgacgtaaccctggtgcgttgctgaggctgagtcggagcaaagcagaatggtgactatctgcctgcctgacgatcctttttttttttacagcgaaagcatgccggagcgtctgagtcgtagtcattgttttccgcaaagggaggctggccaccaaccagcatatggaaaaggaaattcactcttggcgaccacagcattagcacattccatctctttacatctgtgcgcttgtagtaaattgtttgttggctgacctgatgattacttgagttagaaagaaacaaagcaaaatcaccggtgataggtagatagatggatggatacacctgctagcggagtggtagcaatgatgctgcatagatggttactcgtctctccatccacacagcccagccagaaatcataagggcacacaggttagcagtagtatcatgacgctgtcactagtctaataattatacctgcaaatgcaaatgcaaatgatggatgatcaacctcccctccaaaccgcactactggtagcagcagcagtaaagtaaagtaaagtaaagggaggaggagaaaaaagggagaacgaacagatcactcactactcaatgatcaccaaggccaagggggggctgaaaggcaaagctaagcaagctgccggtttagcgcctactcgtactagtacgtgcttaggagcagcgattagtactagtgtagtggtaataattactactaccactatagagtcagtagtgagtgctacagatcacaggaggccaggctacgggggagtaacagaggtggcgctttggaaatggtcgcaaagtggcgacgcaagtaggcggcgagagcagaatggaaatgggcatcgggttcggatgcgatgctcgtttcgttcgttcgcggaaaggtatatatccgttgcttagcgggggtgtgtgtcgttgaatttggctcgttttttggtgtgccacggcagcttgccgttgccggtgttctcaaagcgggggggaaaaaaaacggaatcgtatccatgcttatcgcgtatcggagtcctgtattattgtcctcctcttttggaaacagaaaaataaaaagagtaagaatagcttcgggaatgcttgagccacggcagctgaggtgtacagctcttcacccaaggtgagtaacaggaagagaaatcaatttattcaaacgaaatgaattgatagcatcacc

SEQ ID NO: 965 - DNA, 1148 bp, Zea mays
  misc_feature (1)..(100): optimal_loci_237912_G1, chr7:3870234..3871381, Cluster 6
cacatatcatttagtagatattaacattttaagctttataattaaaaacatcaaagaatacagaaccaaatgggtagttgacatctcatctccatgattaggcatgcggttggccagattggagggggcccagtttcgctttctagttgggcttggtggatttttgtctcgtgcagctaggcggcctagcgtatggttgctacctcttcgtccccgcgatcggcggcaggagttcatgcaacttcctctaccccgtcttctactcttcttcctgtggtggtttgaagccggccatgcaaggagcccggggtgcagttggtgacggcggccggggatgcggctcctggcgcgattctcccaagtggccaagtcccaaataagtccacctgatggaacactcgaggtctatagacgtacggggccgtgtgatccaacatggcccacccggaggcgcaggcaggggtcgtttccccagcatggtgcggcggccggtgctggcgctgcccggggccatggcgtgtggtgttcgtcctcaacgtgtcgatgatgaagctgcagatcagttctgggcgagttccagggtgccaatcaaagctttgaccccgggctacggcgggtatggtgccggggatgacctcggttcccggcacaatacggcggaagggctggccggcttgggatgtggtactggcaggtcgcggtaaatgcagcggcagcaatgaagccaatgtatatatactagtgaattggcacgcgccagcgcgcacgtttgaatttagcgaaattttgtaacatggtaacagttaatattaatagagcatacgacatagcatttaaattgcttattataaaagttcattaacgatttgatgtgactgatgcattaaattttcataacagatacaaacgctaaaatatttacaaacaaaagcttgaaaattcatgacaaaattttgatgttatataccatgataacagtaaatatttgccatagcaattttacgaacagtcatccataatgattctatggaacaaaagacaacacgttaaaggtaaacattaccttgattcagaggtaataattgggtcatcaacaacgtgcacggttcttatcatgtagtcaatgcataaaatacatgcaagtcatt

SEQ ID NO: 966 - DNA, 1105 bp, Zea mays
  misc_feature (1)..(100): optimal_loci_242675_G1, chr7:30168390..30169494, Cluster 6
tgtgcgttcttgatttgtgatcaatcatagggcagcaatagtattttctaaacttataagagtgagcagacaagccataaaatgtgaagaaaacagtggaggggcataaatatccattctatttttcggtatccattaaaaataatccaaaatatgtaataaaccgtagtgcgatactggggtattttaaagcgcaatgaattttagaatatattagcgagtggcaacgagagcaaaaaaaaaaaatcccaaagcgcgcagcagcagcagctctgctatcctctgcttagcctaagcccaaaatactagccgggccaacttctaagcctaattgtgatataaatgagctctcgttttggggtcccaaatgcaaattccattgcaacttctaagcccaattgtggtacaaacttcaccaattccctccgtccctccctctttgctaacctacggttttttcctcctcagaccaggtgcaacgcctatgtctgccgccgcccggagcatagctccgatgatcgatgggggcatctgctctaattgcaatggactcgcgagcacgcgggatcgaaccacaacaaagctcacgcacgtctcaagcaaccaacagctcgccaaacgcaggttgaaggacaaaggggataacccgccatcaatccccatgtggcgatgccaccgcagtgcccaaaatctcggagaaatgcgcgattaaacaacgaaaatgcaaccgatagatcaaagtccgaccagaaattaaaaacgaagggagaaatcgcttcaggagaaaaactacagaataccatcagaatcggtcgcgtttgggttgctccccatggccacgcggagcggctcgttgcgcttgctcttggcgtcttcgagggccgctaccgccaccgccgcgtccggtcctgtcctcctcctttcatccgcgtactctgcatgcgcatacaccaagtatctagtaaatgaactcgatcgatcacatccccagtgtacccccaggacgccccgggccgggccttcaacgcgctgccgctctccggcgcgcgcgcgtgtccctcgcggagcgaggccgcgcgctctactcgctctgcgtgccgctcca

SEQ ID NO: 967 - DNA, 1176 bp, Zea mays
  misc_feature (1)..(100): optimal_loci_243330_G1, chr7:34630402..34631577, Cluster 6
taggagccttatgccttgaggcaatgaccatcgctcttggcatttttagcccattatgtcctagggatctcatgagattaagttctcaagcccctcatcctcattccttagggcactcatatgtctaagtccctagagccctcatgccctagggcaatataaatataggtgtccgagataggtcgtgtcctaaagcattcaacaacacttagacattgagggtactctattgtccttaaggtacctaaggtcctattgggtcccgaagccttgagggaacaagggactcagagcacccaagtgtagtcatgtcttatgctagaaggatgtgtataggcccaccatggatagtatgaccctaggagatggactccacatataaaggcctaaggacaggttcgtatcactagcttaattgataaatcttaggtacaacacattaaatgtgtgatgggcaacattataggcctaataagcatgttgttaccatgacttagaatgtagggtgttcgatattactatgatgtatgtgcattgatcctgttataacatattactatgctcgaggtcactatgttgtatgcatgcacccatggagtgtaccatgaattattatctagcacaaaaggctacactgagtaccaacttcatcatattgaacaacatgacccttgtgacattgtgcctcgagtaggggaagggccctggtacaaccccatgaacctaataaaatcaaggtagttggatcttagccagtgaaatctaaggttcatttaacctttgtcttcccttgcactatataaaggagggatggagcagcgtttttgggggctcagatagggttcatcacacgaagagttctctcagtatgtaggcttaaaggtggattaggacaattaggctagaaatgccaccacaaccatgaggtgaggggatctataagatcttcatgctaactagtgtttgaggttgtaatcctttccttgtctttgttcatcaattgatgagtagcaagagggtgtagggtaatgtgcacactacaaccaaaccattataaccgctcacatactagctcccactcatgcccaagttcaacaaggccaccaacttgcgccatgctccctcctaactctctttctggtacttttatgtatcctggtattattgcctatacac

SEQ ID NO: 968 - DNA, 1262 bp, Zea mays
  misc_feature (1)..(100): optimal_loci_244203_G1, chr7:39643623..39644884, Cluster 6
aataaatgttaaatataaaattttggatatgtgtttcaattattttcttgaataattattatggtaaaacatcttacatgatttttttcatgctaggttacatgtgttgtttgaactatttatataaataaaatgagataataaataactaacataaaaaaattgcatgatggagtctttttgcatgtgcttttaatatagaaatttggactcatttgaaattggaattgaaaaataaaaacagaaaatagagaaataataaaaagaaaaaagaaacaagaaattaaaaaaaggcttaaagcctcacctcgacatgcatcatcccatgaccactcttgctcatccaatctgactatccgaagccaagcccacatctctttcccatgtttgtttttccccttttttatatatatgctgtaacgatgacaccatccacgttgctccatgtcttgctgctagatgtgctcaaaatgccaatctgttctgcattccgtttcaaaatctcacgtgaagcccctcatcttacaccggtttcttctctccacagctcgcgcatgctcctcatatctggtaggtgggcccgggcaaaacagactcgtcgagaagctcaggatcaccttgatctgaataggcccgccaagttcggcggaggttcgatcttttcataaccaccttccacacggcctcaatgacggagtttggccatatatatgcatgccgtaattatcttggacctccaaccatagggcaatgccatggtagaatcgtagctagggcaccaatgtcgagagcggagagagagactggggcgtcgagatggttcctacgcctcaccgacgtccggagtccggtgagcgcatgtggagatttacagctcgtagagtactcgtgatgcctagaagagcgagaacatagactccagcaaccgggatttctcgccggtctgtgttcaccgccatggaatcgtgctgatcgccaaaagagagatgatcgtcagcctatgtcgttgctcgtcgtggcatcgtcgggcggagagggtccctcgagtccggcctaaaccctaaaccattgaagaagagctgaggaaaggaggaagggaggtagaagatgatcacacctaaattctatatattatgtctatttactttgtaattcttcgtgtgacctcgatctaaccaatcagatcgcttcatgtcacctatttctgtgtagtcctactaatttataaaaaaatatgatatcgtctaggtcaaataatttgt

SEQ ID NO: 969 - DNA, 1017 bp, Zea mays
  misc_feature (1)..(100): optimal_loci_252745_G1, chr7:100526625..100527641, Cluster 6
cgatgtctctggaatcacctggtttcacattgctctactagtggtaaagtttttagcgtaatagtagtagtagtacattctaggccaaagttttacggttaccagccatgagagcgacgccaattgttgtgcaactaggagaatgggtggactggaggaggagtaatctgtagccctcgagatgattaggcgctgcatggggttagatcagcggcagtgattgttgttgcctgaccgccaggtgtaaagcgcgcgcgcgcatctgatcgatgcgaaacaagcgacggcggcatgattagctcgcccgtcgatctgcctcgttccacccgtcgtcctggtggttcggcggctgctgctgctgcgtcggcgtcggcgtcgtccgcccgcagactagtacgtagtggtaacatgtgaaccccgcccgcccgctggaatgaatcatggtcgcccgcccatttgcaggggaataactctgttgtgctgcaatgatgcctattctcctctctgctacaatgcattgcgggttgtttgctgctctgtgtcctgtcttcttccctctttgctgctgctgctgctgctgcgctctggcgaggcgatgatgatgacgaagatgatctcccgcacaggaccctgatcctggacgagtgcccgcgtgaaatttcgagccaggccccaaaagttaaggcgcttttcagacgccgaacggaaagtctggccggcgacaccagtccactccacagcgcaccacaggccacgccactgctcctgctcttcagctcttgaccagagagggtcgagctgctggttcgccggacggacggcctgtcatagtttacatgcccaaattaatagtgtttggtttgaaaaatcaaaccatccaaattgaggtggtgcatcataaattcattcctcaaatttggtggaatgacttcattcttcatattagtactaactatagagggtgtttggtttaaggaatcactacatttaaattgaggtggtgcatcatggattcat

SEQ ID NO: 970 - DNA, 1111 bp, Zea mays
  misc_feature (1)..(100): optimal_loci_253669_G1, chr7:105647402..105648512, Cluster 6
atcagacacaccgtaccactcgcagcctgcgctgtgtctacgtatgcgccagcaagtagtcgttgctctagcccttggtgtgacgcatcccgtgcgatcgttttcatccccgcctgactattatttttggccggacctcgacgtccaacaagtcatcaccagataactgataactcgcatggcaagaaccgggcggacgtgtggatgcccaagagacgaccgagtcaaggcaggcagcaggcagctctccgtccttcccggtctcgccatggatcatgctgaccggggccgctggcgtggcgggtgagtcgcatcgcattggagtgcttgtacactgttcatgggcaggctgcctactaccaaagctcgctttcgcggagaggaaaacccaaggcagtgtgctgctgctgattggtgctgcgacaacctcgggacccaacttgtggcctgccaaggatcttcctccccctcccccaatcgggcgattagtgcaaggatcttccaaccaatgaaaccttcaaatttacaagttgaacggtgcctccaaatttacaagctgtgcaagcatctgcgaatggctcacggaatcatactacagcaccgttcatcgcccgtcgcgtggtcctccggtctgggtgggcgcgtcgtccatgcttgaaaggacgcttcgtcctccaccgtgtggtgcgggtgtggccccagcggagctccatccgtttcctcctcggtctcgccttctcgtctccagtgtgctgtgacctggccggcttggcatcctagctctcggtgggtactggatagtagtaaaacgcagtattcggtagtagtacatgtatcgtcgtctgatcgccagactccttccttcactgttctcgcatctagtcctggccacttggaaagggcccaaggctggaacgaaaccttgtcagcgtccgccgcaccggacaaaacatttcggcatccccgcgctgctgccggattcctcctcgcttgcaattgcaactccagtgcgacgtttttttttttgctttttagccatttttgtgacaaaaatttatacttagatctctgaaaaacttatttcccgttttagacccgatactcggtgtca

SEQ ID NO: 971 - DNA, 1203 bp, Zea mays
  misc_feature (1)..(100): optimal_loci_253932_G1, chr7:107230896..107232098, Cluster 6
tgagtttaaatcctagtaaataaaaatatcttataagaccgtgtctaacagttcacatatatggtcacccaaatcacttttttacagtatagactgcactattcgaaaagtagaatttgaatatgaggatgagtaagctgatggagatagcataatcccctccaacctttatagaattggaacaaccaaataaggtctaatgtgtgtattactttttctctaaaatctcctctcctgtcttctctctcgtccagcttagtacaaaaagtgatgtacaagcttttgtagtgtgcttagactgtctccagcggctaccctaaaataagagacatgaaactatagatgacaccgttcgagactatttacagagtggagtttaaaatagctaagggatgtgatagaggtagccttacaattacaacatattatagtatttttctcataaatggtgctttggtaataactatttcacgtttgcaaaccgtaataggtgaattaaagccacatcatcccataaccaactataaaaaaatctgaacccatccaatctagtacttttgctgttgataggcatctgaatctcaataacacagaaaaaaagtgatgtgaacaagaagcgacataacattgggaaaaaaagattctacacaaaatctgtattatatgagcggcgtacgtgatggttcttttcggtagcctcatcatgacgaatggctgcaacgacgaggacgagcacgggacatggatagtaggaagggaggtcccagatcccacggtgcctgcctcgctccatcgatcgtagtggaggcatgcatctcccgccgcgccgtgctcagctcggaggtgccatagtcggcgtgacgtggtagcttgagggtctagaagggagagcttccaagatcagacgaatcggagatgtgtggccgttggtagttaggactaggtccctcaggtgaagggatgtcgccgttggtagctaggccgccctttcacgggagcaggtgtgtgtgctgatgggcggtcaatcagaatgaatgccggccggccggccagccagccagcgagccagcgcgcggcttgctgctgctgctactactactaggcatttttcgttggttcgttttcgtttcagagacacacatcgatccatcctcatcaatcagaggcgcccggtccggctgggactgctaggtgctcccgtcg

SEQ ID NO: 972 - DNA, 1217 bp, Zea mays
  misc_feature (1)..(100): optimal_loci_254416_G1, chr7:109530194..109531410, Cluster 6
tttccacaacaaaaggggggaaatgaggtctaagtaagggggcgcgttggcagacccagaataaaatgtgagtgaaggcatacttgtaaggatgaacataaaaatgatagagtggaagcatctaagttgggctgaacatgagatattatggtaaaaatctagtctctactacttgcaacaaagaaatgagaagggcatgaggcctcactcatgtatgtgtaggtccacccctggttcgagtatcactattagccatgacaatatctagagtgaataaccttttcggatcgcggagggggtactaagggtgtgtttggttgagctttctaagctagatttgatgccaaagttctggaatcccaaccaaacgagcacaacagtagaattgattcctaaaaatctatatattcctctagttcaatttagaatcacctattacctaggtttttcagattcataccaccatgttataagttgtcatgatcttatagaatttatagttgatggatgtttcaaccaaataaatttcagtttatcaaaatcgtcagcttaccacagctttctcataagtcacaactcacacctaaagtcggatttttttttcaaaaaattacaattgaacccaactggccctaaataaatcaaactatagaatacgggatcatcattatgctagttacaatacaaagatggaccactttgtacgcacactattataacgaaactgttatgaatccaatatacatagtgcagcggtccacatggtaggataggatgtaaagaagaatagacgggttgggccgggtgttactttaatttaactaacccgtggttagcagctggtaagataaggttctctcccgatctactgagctaagtgcttggcctttggttgatatatatgtacaaacgcatatatattacgccatagcattccctgccgatatgttaattaaatggcgcgcgcacactagctggtaatgcatcgatgccttgtttaaatttcttaatgctgcttgcttggtcccctgcccatcacgatctgtcagacagatgtgtggccaactggccgtacgggcacgcgtgcaggtgctcctctagctacaaataggtcggcgcggcacacctgcggggacgaccgttatcagccgattgccattttaggactacgtttagcccggcccttgaccttatgcccgtccaaaagatttttttaa

SEQ ID NO: 973 - DNA, 1280 bp, Zea mays
  misc_feature (1)..(100): optimal_loci_255770_G1, chr7:117257219..117258498, Cluster 6
ggacgaccgttgaaggtgatgttttaaatataatagagaaaatattaaaattatgtataaataaatatttaaataatgattgttagttttaaacctacattcgtaaccatttaactaacaaaacgtatgtctttatattttatattctatacttaaacataattagaaacaagtaatctcgagaccgggagcaatcggccacacggcctcgcctgcgcggggtgttcgtatcccagaaaaaaaagaacggaacgaaattgaaccaggatagatcatttcacgcgatctcgccctgacgcgcacgatcgacggtctcgtcatcggtccaccgtccatcgcctgccgcatcgccagatgcgagttgctcttgcccgcccatcgcacgccgctatcgcccgcccatcgcacgcttccgtcgcccagtcgtctcgcgcaggactccatcgcctgccgccgtcgtcaaaggggaccgtcatctccagtcgtgatccacgccaccgcccaggatcgctgcacacggaagcccaggatagtcaggattcaggtataactgttgctgctgcctgcgtttcattgttgtgccaaaagtcaacttgaacaatttcttttgtgtgacattgatgaggtctctgcgaacatacataacctcatcccttgaacaattatacctcaactgagctttttgttaagtgaccatgtttctgaattttttctttctgtttctcaaaagtgaaaattactgcagacatgtgaatccaaaaccatgatttttatgtggatgaacttggaaaaatattatcctatgcacgtaccggttaattatcactattgaaaaataactagacttaatgcattggtttattgtggatgaactaggacaaattaatgcgaaaaagtttctttttgctatgaagtataatttgatacttgctaacacggaatagagactctcacgtgagaacttttaggagtggttataatgttagtcaggttgactttttctaaggcgatgagcagatcaaaagtatttcaaggttagtaagggtgatacctagagagagcgtagcaacccaacatatattgagtactctatcttagtattaagagttggaagagaaggagtaaaggaacctaggatttggtagtgggattggaaaggggataagcaagttatgtttaaagagaaaatatataataagatggagtggaagttaggtgaggataactcaatgtagaaacagatggcacattgtatcaccgtcaatggcaaaagaagttta

SEQ ID NO: 974 - DNA, 1162 bp, Zea mays
  misc_feature (1)..(100): optimal_loci_257181_G1, chr7:124221633..124222794, Cluster 6
tgtcccaacccggaaccagcaagacgccaacaagacccggtgtgccccctgtctctatctctctctctctctctcatcactgactgttcattactagaagagaaaaggctgcagtgcaggcctgtcgacccaatcaggtgttcttccttatccactcgtgaacctctcttatcgtcattgatctgagcttgcatacaggcggccgggccaaacgcacgaatgattgccgaatcccgtcagtgcatgcatatggactggaccaggaccatcgtctggacgccgtgactgatcgacgactgcacctgcacggcacggatgcgctccagcgcaggcccaggctggctggctggcgcacgagccggactcgactcgaccagcgtcgccgtgcggcagcagatcagaattcggatacgtacgccacgccgacgtgtgggcgcctagctagcggtgtacggctttttgccatgcctttgccggctccacgacttgtccaaggcgtgggccggccggccggcggaccgagtaggtaggtagccattgggctggggaccgggttctggcttggctttggctagcaaaaagccgcggccgtactccggccgtcggcatctctgcgatgtgacgccccaaccgtaccaaaataaaaaaaaaggaacacaagttcgtggtgactggagaggagagcggagcaggacgccaggacagacagtttgaggataaacatggtgagggggcgtacgagttgccccggccccttccccgtcgctactggccaaaccaacgtatctactactattcaatattgatggtacgcgagcttcattggttgattataagcagcaaacagcatgccattttcacagctattgcattggtactgtacacatggtcgtgttctgcacgggtacagccttttgggttgtatgctactgagtgcagtgcagctcagtggcggacctaggatttttacatacgatgtgccgcaacaaaatttttatgtagacttctatctaatgtatatataatttcatagtaaatttggtaaacaatttgatatatagatataaagtttgacactcaacaaataagcattaaaactacatacattaaacataaagattgcaataatactacttatctagctgcgcttcctcaacgccat

SEQ ID NO: 975 - DNA, 1082 bp, Zea mays
  misc_feature (1)..(100): optimal_loci_260495_G1, chr7:142898730..142899811, Cluster 6
atccctccgtgcaacgaggtgcagtatagaaagaaagaaaagcagacacccgtagttgttaccactgctgctgctactgtgggagcggtgcgtggccacgggaggcggtactgtgtttgctttagaatctgtcacgtctcatgttttcccctgttgccgcggtacacaaacaatgagtgtaatcatttgcgagaactccgcaccctttctttgaggcgaggccaggcgaccaaatgaaaagcgctcgctcgcatccccttcttttgtcctagagctagcccccactttcagtcccccaagccaagccgttgcccgccaacgtacgtcataattcttgctttctagttctactacctgccggctaaaacgcccaccacctggtctgaaaaaaaattatagggcgtcgaataaatgtttttttcaaaagagcatgacgattcaggtttcatagattgctgtgcatgccatcctcatcgatctccttcctagagtagagagaaccaggcggccaacgatcgagctatgcatctagagcttcgtcaacaactaatgcatctctctcacagctgctaggcatgcagcagcgccggacagtggctcggccaagcaacgagctgagagggcacgcgcgttttggtgccatctcctcgcaagttttatgcatggccatatgcagcgaccgggcggccagacttgcagccatccatcatcagcagcagcagtggtccatgagatcacgatcgccaatactgggattattggggggctttgtgcttctgtatttttcgagctgtaacggctgggatggtcttgttttggtctatatattccagaatccagagcatcgtgagcctgtttcttccagaaagggcccagtagaagaccgcgagagacgagaccaaggcaatgcgggacgatgcgaagttattttgtacacggatttgttgctcagagcaaaatatatataggaggcttgcagtatgagatgcccgataccatctaggcatctaccccctacccctaggtttccacgcgtttcacgagcaccagtatcggctattagcaggtagagtgttcaactc

SEQ ID NO: 976 - DNA, 1296 bp, Zea mays
  misc_feature (1)..(100): optimal_loci_263486_G1, chr7:158978907..158980202, Cluster 6
ctaatagtcccataacgttgacattttggataagcctcccatacaacacattaaatgtgttatgtgcaacatcacatctgacaggcacactatccccacaacttaagtattagggtactcgataccacaatttggtatgtgcattgaccctactgtagccatgtgtgtgcatacctatgtaccataaagtattatcaagtacatgttgctacactagttaccaactacgtcgtacccaacgtcaatgactctagagtccatagaagtgacataacatacatgcccttgcaacatgtattatgccactaaaaaggacatctataacaatatgcctgactaaaggcatggccctatcttagttgatcagacccatagtcttgttaacatgtaaactccactccctttatctataaaaggggaatagagtaataaaggaagtggccattttgaaacataggaacaggattctcatacacaacatctaaggacagacataagggtgaattataaaccaacagggctaaaactctcaccagagccaagtggaaagggggagctaggaggtcatggtacttagttgattcttttgattcttgagcttgtaatcttctatgacttttgttcatcaatgagtagaaatagaatataaggtattatacacacaatggcacaaacctctccaactgcatgtatgttggttcctgatcatgccaagattcaatattccgctcgcctatgcccacactctctctaataaatctcttctttttgtaccatacataccttggtgtctatccatgatgccttctagcactttttctcttgagattgttctggtttgctatgcagcatggctatgaagacaccaacttacttgtcgttaagagcagtcatgactaacacctgctctagcaactcagatcatgagccacgccatagaaggcatcagaacctcactcagttttccacactaccgtctttgatgagaggacatgctttagtgaggttgtatggagtagttcccacaggcctaccttcgatgcttatgtcgactagggtgtgcaacgccataggggcatcacaccatatgtctccatgagccctagagaagcaccaccactcaatgtgtgtcactctcatagcctcatatcgggaccaaggcgatgcgacctccaatcatgaatgtttttcctatcactagtcatcatgatgggcttgttgatgtcttgactttggaatttatgatgttgtttgttctcttgataaaggctcttctctataatccaccaacaccag

SEQ ID NO: 977 - DNA, 1226 bp, Zea mays
  misc_feature (1)..(100): optimal_loci_264208_G1, chr7:162400452..162401677, Cluster 6
gtttggaatgcaaactagacctaataagagacgacaaaagatttatttctaattaaggttcacttgcttgtcatcaaccctcactgtggcaagtccaaactagtggtccacatgctaattggcatcacaagccaagcccacaatcatggtgtcgtaagaaccaaactagagaagcactctagctcgtacgatattactagagttgctcttcgtgaatcttccatgtgaaatgagcacaaccctttacgatgatgatcagacccaattaaaatatataatactacttccttgcatcttcttaagtgtgctaaatctcaaatactttgccaaacatgtacatatgattcgaacacctagtggtactagatggccgagacatctaattaaactcccctcttaataatacatccatctattctaaatctatcatgcatcctattgtgtcttgattgatgaaacaaaatactttaacttatatatttaccttgagtacttgcattttgtttttctccttcctctaccatgttgaacactttatcatactttgttgcccatcaccattgttttcatggtttccaatcttccttaacctcttatgtggactcagacctatcttattcacaacacttaagagtataggttagtccactagttgtcttaattaccaaaaccaggcatgaagctttcactaccctagtcataatagttagtcgtgccccgcctgccctgaccggacctctctctcgctcactctccatcacctgcccgaccctggccagctaccgatctctctcttacttagtctccctcaccatagtcaggtcatggtcacctagcctgggggcatggacaccctggtcgattgctcgactaggaacacaaccatgctgagttgcccatgtgcctattttttgtctaaggaagaagaatggatcacagagaatagagattcacacgtggggtatatccaatggcaaaatagcccattctgaccaaaacgtccttgtgtggatttggatatattgtgtagacaaatacttctctctctggatgtcaactccactaatgaagctcctccatggtgaatcccatatcttgattcacattggagttgtcctaaattggccctttgaatcatacaatggatacctttgattgttagatcgatacattcatctgatctatgttaattttagggggtgtggttagacccatatgaatggatc

SEQ ID NO: 978 - DNA, 1152 bp, Zea mays
  misc_feature (1)..(100): optimal_loci_264943_G1, chr7:166851504..166852655, Cluster 6
ggggtggtcgactttcgctccaacactagtccaaaaaggttggcccatattatcaacactaagactatcttctatcagatctcatatttcaaacattactctgcataatattgtcacattgtgtcatctacaatttggcgtgtcctattttacataacctagtggagtacctagaatggtgacgaactagtgatgatggaggcggccgggggcgctgggccaacgtggcatgggaccgtgggataccggtgccgatgtgacaagtgggttactgtgtatgtgttgcatggtgcctactgtgtaggcgtagccttgtacgtgggctgggcctcatttcagagtacgggcctctaggaggtccgaagtccgatacaccacaggctatacgaaacagaaccgaagacgcactcgattttatttacagttttgccgtctgcttaaattaaaatagtacgcgcaactatgaaacaaaacagctaccccagctaataactgagggggggggggggggggagacaacttctgtatgcagaattttaactgtgtcatgatgtgacagtgatactgctgcatgcttcagctgccgcgcgcgctggtcgtcactagctagccattgttctgccagaagccaagaacagcaaacgtgtgggggcaagaggccatatggtcgatcgcatgctttgttcatcggtaggacctctgatctcctccggccgtctgcgtgcgtagcatcatgggggagggagcagcgagacacgcacgcatgccggccgaagcgcccgcgcgcgcctgcagcaacagttggacgacgacgcgatgcccaccgacgagggcgcatgctagccggccagccactgttgttccactccatacgtgtcagtagtctctctctctctctctctctctccatgaatgaagaagatgcatatgcatggtgtgcctcagcagcctcacctttccttcgatctttcgtcgtagctagagactgtggcactgcagggtggtgcacagtagtactgtatcaatccttgcttattggctttgaatcacgtagaacatgcatggcttcgttccatcaaaagttttcgaagaaggtgcttgttgcttgaatggacaaagtaaattgctgcatttatgaatcattatctactt

SEQ ID NO: 979 - DNA, 1256 bp, Zea mays
  misc_feature (1)..(100): optimal_loci_265429_G1, chr7:169409903..169411158, Cluster 6
gctatcttccccgcaagtccgtctctaggtctttacttaatataatattgagggacctacaggtcaagtttttattaggctgctgttgaacgaacacctattagagaaagtataataagctaatataggcagacggtaagagatgccacatcaaatttatggtgatatagaagagagagaaggggagaaaaataaaaggcggactagggactactcactagtagtgagctgagattaagagtggctgcatacggactccaaggccctacgtgagagagacatgagttgacaaaatattaaatatactacttgtacaatgagaaagttattatataggtaggtgtttaattggttatatatgatatgacaacattataaagctcaacattgctcttatcagactgaagttcgcttatattatattctaacacgccctatgcttacctacacatcaatccactgaaaaaaatctgactgctctttaagaaaggaagtaccatgtgatgagtattttggatagagtagcttaggttcaaaaatgatcttgttgaatttgaataggatggataatcccatgaagatattttgaatgaacaccaattctagtattgtatgttccgttttaaatgttgtgttttctttattagtctgattttgcaaaagaccctcttagtgagttggttatgtggttcgagtaacactcctcaattcctaagagcataggtcgcacaagtctaagatccggctccggcaggtcttcttcttaacgtaatatttagggggctatcttcccccacaagtccgcggccaagtttttattaggctggttttgaatgaacacctattagagaaagtataataagctaatataggcagacggtaaaagatgccacatcagatttatagtgatgtagaagaaagagaaggggagaaagagcaaaggcggactggggactactcactagtagccagctgagattgagagtgggctccatacagactccaaggctctgtgagagagacaggagttgaccaaatattaaatgtacaacttgtataatgagagagttattatataggtaggtgtttaattagttatatgtgatatgacaacatcataaagctcaactttgctcttataagttcatggtttccaacatgatggatctctgcgccttcaagcaacgactgaaaggtacataccagatcggctattatgctaattatctttagtgtgctattctaaccaatttata

SEQ ID NO: 980 - DNA, 1210 bp, Zea mays
  misc_feature (1)..(100): optimal_loci_267634_G1, chr8:4476359..4477568, Cluster 6
cacaagtccgatcgagctcaaattttgtggagatcttagaaacgtatttgtttaggtgtgtgtaaaatttcatttcaacgggtgttcatttggatcagtttcacatccgagaacagaatttcatgatattgcaatcaacacttgtttgtgacacagttttggaccaattcggacttttcggtgtccaatttgcgattcttttgttttgctagtcttgtgtgtgtattaggaacatttcgaaatcatgagatcactaatttgctgatatgattttggcttgagcaatttatttatattgattaaagtgaagtgctcaaatttagtttttagcaagaaaaattgattggctctcatttttcctgtcgagtcgtcctaccacttcttcgataagaaaacaaataaagaagggatgccgttaatgtatgtgcattcttctagataagaaaacaaataaagaagggatgccgttaatatacatgcattctgctagcaaatgaacatagagagggagagcaaaatttggtattttcatttaggatctatgtgtaggggcttctcacctgcggcttcagcattggctcgcccgagcacccgccaccaccaccaaaaaaatagctccttcgtctcctccacttttgtagtcatgctttttcggagttagagcaattatcaatagctataagtaacgagtgtttgagatggcttcaggtttcagctacagagatatcaatttaaatagttttaaaattaactttaatctaaataataaataaaatgacttatctaaatgtattttaaaggcttacagctccagctccatgattttctggagcacctaatgacctgtttcatcaactccaccaaattttttgcgcaacgatcgggaaagggagcgggccactgtgtcatgctcgtctgagttgaagaaggtcaccgcaccgtggaccagattgatcgcagccttacccaccagtaaaacatcgtcatgtagttctttataatctccacgttgttttcctagggttggcgagggaggttgggcgccaggacgaccttggggccgtgcgtggcaatggcaccgccgcggatgaccatggctccaattagccgctgtcgttggaagaaagaagatgaagctgtagccatagatctcatgataaacgactatgattagatcatgcatatcccttcgcctaatttacgtatgagt

SEQ ID NO: 981 - DNA, 1156 bp, Zea mays
  misc_feature (1)..(100): optimal_loci_268082_G1, chr8:7032165..7033320, Cluster 6
acttgcaactttttatgttgaacttatggaagattctatcacattatttatttgacccggattggcatcctcagcatagtgtccggccgtagggggccacacaattgacttttttagcacacacgtgtatagtccgtactgtgtcctaaattgtggttcaactgtcctcgatgtcaacctttatatatcttgtgtaggaagactggccatgcgtgattgcatgtgtgccgtgtgcgtgatgcatcggtgtgtgtgagtgtgcatgatcaggcaattgggattttggacggccatggtcggtgagaatttctgggacacatgaatagacaacatgatgcatgcagatgcaggcaacaagttgattgcaacgtgctctcgactactcactccgtcgtaatctatataacgttttttattctaagacatacgtagtattatttaactagctagtaaagtgctatacattggtacgatttctatttatacatagcttatatataatataaaatacaaagatatgtgtcttccccgttggctacgtaaatatgaatattagtttgaagctgacaacaatgatatcatttttataactattatttattttgttatagcttttttattatagatactctaattgtaacttatttgttttattttgttatagcttttttatttcgaaaatctcttaccttggccttttattcacttggtgccagagtaaaacaagagtttggaataaaattatatctttaaaatcctatatagaatatattaatgatcaattattagttcgtgatattgaaaaatacaaacatataacatataatataggaactagtacactatacactacatctacaatcatctaacaaacacgtactcagcacgtcgccacgtcgcgttaggagtctgcgacgatttgttttctctgtgattgcagtaggctcattgattcgtttctcaaattctcaacaagctacagctaacgaaaggactaccgaatagtgtctcaaccgagaccaattattaaatatccatagcacatatcatatacttatacttagtacatatttagaggccccataccttcggggggggggggggggggggggggctaggcggccgcccaccctacccaccccagaactggccttga

SEQ ID NO: 982 - DNA, 1028 bp, Zea mays
  misc_feature (1)..(100): optimal_loci_269428_G1, chr8:13444438..13445465, Cluster 6
ccttatcgtggaaaggattgtttggatagaaaataccgttccgcatattcagtggcggttggattggatggaacttggcggggccagccagccggcgagattaggaaagcctgccgccgtgttcgtcgtattccgaagcaaagtaatacagtagtactgatttcttcgatcagttatcggtgtccatatgcttattccttgagtcgttttcttcttctaaaaaaagctactcctataccgaggcatgtactcgcacagataattcgtttcagtactgcagcaaagatccattattagggatacggaaatcagtgaaagcgtagccaagaggctctttaattcgtcgtaggaatttggcaggaatcgagtatgattatgtgtccgcgttagcctctagtttgcgttgtacgtcacgcacagcacgacacatttggtaatagaatcatgtttggttattatggattcgtcgtatattttagtgcatgactcgtatttctagtacgggtttaggggtttcaattttttttggttactaattgcttgtgtgaacctatattatttattccgaacaagtctaagccttagtactgaatgcgctagacttgctccgagaacaaatctggcgtactagtgtacttacaatagtacgtcttggtttagggcgcgttagtatctgccggattgccatgtttcgagcctcctttcaggttgaacaaattcatctgattttgacccggatctagttgttcgttttgatccggattgagaacaaatccatctgattttgactccacattctcacttctccacctagaacaaatccaagtgtcctctcacgtagatcgattcctggccaagaatgagtgttccactcgatcctaggctggctggctggcttcctggcctagctttgatctaggtttgccgaacggacccttaagaagatatcgtggaaggatcttttgggtagaggactcctttctgcggattcagcgcgagttgaatttgttggaacttggcaattgcaa

SEQ ID NO: 983 - DNA, 1116 bp, Zea mays
  misc_feature (1)..(100): optimal_loci_285452_G1, chr8:117450497..117451612, Cluster 6
gtgccctctgttgctcaccccaatgagtgtattgttggtcactgaatatgtccaacggttcaccctctcgctcctctcctcggttgtcacgggatttccccctctgaagggagggagcaataatctccccccattcactaatcaaagctatcaacggtgtaattaatcttttaggtttaattaatatataataatatgtattgctagtacaaatagtgtataatttttttgaactccaaaaaataacatataaaggttaaatagcccaattgaagtgtaaaggggagctgaataggggtaatggttggagggggtgaaagaaatggaagagggagaggtatttaaaaatgaatagaatgtacagatagggggagatgagagggacattattggaatcagccttagggcctgtttggaagccctcaattttaagaaaccaatttataaaaactgagatggttccaaacataccagtttatgctccagtttagtttatataaactggatttacagattcttaaaaaccaagaagctagtctcccttagcttaaactagtttatgaaaattgaggtgttttcaaatatcattagtcgcttttttataaaccagtttctagaaactggagatagaacaagatagaacagggccttactcgtgttagattaaaaaaaaatcttatatgtatccgcacttgcaaaaggtccatacatgtataaacatgttcagtaagatgtacttttataccttcatctcttatgcggaaatgtcactggaagtatggaatcgacttctttgtgtttatactaatgcatattttggttggagcatattcatgtctacaagtctgacacctgttcatttgttcctttttcgtgtgtgtgaaaggatgcatgttcattcttgaaatgttttagattcagcatagactttaatctttcatcaaaggcgatatatgtgaacttcttttgcctttttttctatggcttcgctagatgaaaagagggacaacttatttatggtttcgctagatgaaaactctacatatgaagatttctacaagataatctgactgtcaaatagacggatagagtttacatatggtaaacgagatatgt

SEQ ID NO: 984 - DNA, 1241 bp, Zea mays
  misc_feature (1)..(100): optimal_loci_285965_G1, chr8:120145198..120146438, Cluster 6
aaaacttgaaggccagaacaatattcaccttcagcgggagactccggtatatactttgcaacttgcaaggcgatatttctacacaagcaccgaggaaatgaagatgttagttgcagtgagacattttgaaatatgtttacttcaaagaaaattcttcacctgcaaatgactcttcacatgataaatcgtgatcaatggtacacccatcgcagtgagaacccctttaggctttgtttggttgttccattcacggccagagtgtagtggcaaacctcgaccgggaacggaacaaccgaacaaagccttaggtgtagctcctgaagaaatatgataagaaccttagatacaaagtacatgtagctgaacttcccaacacatcaagtacccccatgataacccgctagcttaacacaagctatgctatagagtcagacatgtgccacatgcaacactcagagctgtttcccatggacaaggatcagagatctcatggcacaaacattttccaatgtgattgaatttaataacatatatgtggcatgaagaatgtactcaattattatacacctcatgtagatgattatttcagcaatgcatcaagttcagccacactgacaaatactcaactgagaacagaatactcactatatcaggtccaccaagttgtgcgatggcatctacaaagcgattatgaagatcagatgtccatcgtaggcgttgtctcccacccccctacaggattatcagggttgcttacgttgggtccaccaatagctccaatatcacttgcatgttcattactctgagcccctctgtggtgcaaagggcacagagaaattcttagcgtcatacatcgtcatgtgaatgctgcaagaattaagaggacctgtcattcacccaaagtaaggttaaacaaagtgggaaaactaggataatgaatagtctcctgacgtttatatctcatcaaatatatcgaattgatgataaaatgtaagaaaaaaaacaaattaaaaaaagaacagacccagtgcaggtggctgccacatgagtgggatctagccttacccctgcattttgcagtcctcataatttcactgtcctaattataggctaaaatactttgctttaaaagggaataaaaagagcagcatcagcgcattctggcattacaattcgaaataaaatcaacctgcttcgaaactatttaaaataacatcagcacgcttcaaatctaaggccag

SEQ ID NO: 985 - DNA, 1087 bp, Zea mays
  misc_feature (1)..(100): optimal_loci_286582_G1, chr8:123813493..123814579, Cluster 6
gggaagacggaatcgtcgtcgtcgttacagttacgatccgatcgtgacatgcgtgcacactgcggaggagcttggacaccgccggccgaggcagcagtggtcttgaagttgaaggctgccttgttgctttggtgccatctatcacgtattgaactactgaactggtgtatgtagtccagcctgataacgcagctagccgggattattatttctcaaactcgatcagaccagaccagacgtacagtgctgtgctccgcctccgcgcgcggtattgaatagattggtggtcacagagtccactgagcacggcaaagaccatctcaaactctggttttgagagtatataactatatatgcagttgctcttcttgtttcgacgacgacagctagcggcattatattatagtatttggttttttgtcatgccaaatttatgtgctatgccaactgtccaataatggcatctctaaccgtagagtaattgttttattttaaataaaaatctctagggtaactgattgatgtctcgaaaactgctgggtcaggtctacaacctactatcggagcagagcagctattatattgacggagaaatatgaaaccgtaaacctgagtccggcagctagcgtgcatcgcgagaccacttggcgcggcttattttagaccgaaatgttagtcaaaatacgtacgttcgcatcgattctcgtcgtatcaaagtggcaagcagcacgcgcacgtctcgatcagaagaacacagcttgcactctcaagcgatggcggctgaacacccagggaaaaaaatatataaattggtggtggtggctaatctctcagcttcccctcctatcatatggaaaaaataactcctgctgctgtaatttctttgcttgcaaactacgtgcctgctcgcagacagcaggcacgttcctcatcggttgttgattagattagagcaactccagcagtaaccaaaaagtctattttgaaacctactattttgctagaggaaaaaaaagaaggaaaaaaagtatccaacagctctccataacatcaccgtaaacaccccgcacgtacgcgcaaaatagag

SEQ ID NO: 986 - DNA, 1007 bp, Zea mays
  misc_feature (1)..(100): optimal_loci_287965_G1, chr8:131171626..131172632, Cluster 6
gaagaaatatagcaggtaatattgaatacttgtatgttatgaatactaatgctagcagctaccgctaccagtatgtctggagtggactcacaaataacatagctagcagttcaagctcgcgacctagaacagaaggaaccagatctacggaggtttgcatgtgatgtactgtggccgcgcgacatgtaacgttaacagattttgacatgagctgttggagcattgtttttttctggatttattatttttaagaagatctagatgtacatgttttgggagttatatttttgggaattgttgggcctttagccatatttacgtgataggtataatgatgcgtagcgtgcccgttctttctacagctggttggttatgtgccatgatggcatgatcagatagatcattgtaataagcatccgcgcgcatcaccatcacagcagcggcaggagggtagtagccgaaaggaaaaccaccaacagcgacggcgacggcgagaggtcaaaggaattcaggcgacaggatgaagggctggtttcaccaaccgcccgcctagctccttccggtgcgcatatgcaccacaccaatgtggacaaacgatgcatcgctcaggcgtcgtcgtctctcgcccgtcggccgtcgccaagtcgccatgctagcagagcgatcgagcgaggagaggcacgctaacgatggatcgtcgtccacagatgtgaagcggaggtgggaccgtgggagacgatcgacggcgacctcgctctcgtctccttcgtcggctgggcctacagggcaatctcggccacctgctacacacgcaatttttcttagaaaagggaatatataattacatccgctgcatgtaaaatgtatgaagctgtccaacaaacaacgattaaaaaagatactcccgacaacagcaacaaaacaaggataatactaacagcacaaacataatatgcgagtccaaagcagagacaaaacgacaaaacgcaagctactataatgtaatc

SEQ ID NO: 987 - DNA, 1020 bp, Zea mays
  misc_feature (1)..(100): optimal_loci_287972_G1, chr8:131211622..131212641, Cluster 6
tcttcctctctctctactttcccttccttgtgggacccatagaccatggtgaaaaatgaacaacacaaattgatttaagtacacataaataacatttttacatgtaattgtgaattcatttttgccgaacgaagaaagattattcgttagagctaaccaacatgagttaatatatacacaataatcctggataattgatttcctaattaatataggttcacaaaattgtccatgtgtcatttttccattagttaattaggtcatgttcaaattatatgcaaaagagtgaataaatatggtactttatggattatgttaacacttgtaaatataaagagtgtaattcagaggacgttactgtgtcggacaagatgtgacgcaagcaataaaaagagataaatataaagagttaaagatactcataccgtattccctttttattgcattatttaatactgtacaagttttcacgggtcatacgctgtagtacctaccaacgtgtgacttgtcccagtctccttttcctttgacctcagtgtggtccggtcttcggacgtcaggacggcaaaccggcgtgtcgtgaggtcgccaccgtacccgcgcctcccggtttttttttctacggtactgcgtcgcgtctcgcccggagcctctgcacggctgcccgcacggtatgcctgccgaccaaaatggtccgtgctccggccggcctccgggcccggcggtgcacagccaattcttgttttgttaaaagtaacgagccaactttaatcgaaagcaaatttatttcccaaggtcttctaacgaagtttttacacactttttttcttctctctctctcgtttatacgggaatgacacgttcctttgaaggagggtgatgtcaggttcatagatgacaagatcgagaaaatgaagatctggctgctggagtattgaaagcgaacggctaacctggaggcttgaagaaattctgtggttgttgctggatttttagggaatctatgttttcaagcttagt

SEQ ID NO: 988 - DNA, 1299 bp, Zea mays
  misc_feature (1)..(100): optimal_loci_291274_G1, chr8:149143595..149144893, Cluster 6
aaaaatccaaggaggtctagatccaactcaggagaatcatgaccaaccttcaactccagaaaccagcccagatgacaaacacgttgaacctagctttactgatgatgtagaaatgtctcacctagatgttaggggatcctgctggagattattctgatgatgaggatccgtagaaacctttaaatctacatgaaccttgcaacttaaatattcggccttacatgagaggtacatgaagctgctgtttcgggatatatctctttttgtttagtgcattgtaaagttattttgatgacctattcattgaactgtctttattaatctgttttggggtagtgaaagtttctctacgtgggaggtgggttattggcacttcgagaaacaaaactctcatatctctattttctatggcaaagatggttggcattgtcagccgtgaacatactaaatcttttgaagcacaacagtcttagcaggagaaacattatggcttccaatcatcctctcgttttgaaaaggtacttaacattgttacaataaccatataaattaggcatgtctgatcttttgagttatttaatttgtattttttggtgaaatagaaattattaaatttgttaaccatccaacatgcagttttgacatcatttgaatttggagaaaaaattccaatgtgtttggagatttgaaaaatgacaatggatccgatactggcattaattaacttggctctctcaaacattgtctctgcagaggactacaatgatgattataaattatgtgttgttcatcttctgcaatcgttgtgcactaacatcttaacgaatagtttgtttccgttgcaacgtatgggcatatacctagcaattactcgagtggggttcatgttgtagcaggcatgttagtggcaggtatattttcaacagtgacctgttatacaatgtataagttctagcaactaacgctcaaaaccaaggtcacaaaagaaaatgaaggtagacaatgtttttcttaaataaaagagggcaaaatagctgttgttcaagaagtctgaaaagttgaaaagatgagtttgggtcagaagtcaagtgtcaaatgtttaagcattatagtggagagaaaaaactatgttgcttgcattgtaaaaaatagcattgtaattttttcgtgggtacaaacctttttgtcttggtgcatttttattgccatcttacaatgcagtgcattttcatttagaccacatgtagcatagtgttcacagttagtcatttgatgcctgatacctccaatcttctcccc

SEQ ID NO: 989 - DNA, 1173 bp, Zea mays
  misc_feature (1)..(100): optimal_loci_292062_G1, chr8:152967366..152968538, Cluster 6
tcattttcgctgtgatgcttgctctctctgttcgattcccctggtcacgaggacactctctgctctgcttatatgcctttgaacggtacgcggtcggcggctccacacgcaacgcccgcacgcacgtgcatgggtcgaaaaatacgcgccctcgacgtcgtcgtcttcctcgtagcactccaacgtcgatctgcttgctacctacctacttccatttcgaatgtcctcatcgtctgttcgttggatcgctaggtctctgtgcgtttgttccagtccacggcttctggaccgcgaaaccagcggtggaattctccgatccccgaatcggcacgacgcggatttgcccgccagcgtcagccactcagcctacacgtacgtactcgtccctccactaaactacatatacggacggagtaaagttgaaccaccgggctcgggaaaccgtcgaccactggcagcgtcgcgcgcgaagccgcgaagaatgaaaaagaaacagcatgcactcgcgcagcaaagctagatgcccaggcagcatccgtccctttcgagggcggacggacgaactggatacgccgcagggcctcgccccgtgctgggaaaaaaaaaatcctgcagccggcaacagagaagagaagagaagagatactatctgaccggcggtcggcggatacagaacaaaatacgagtaggatacacttgcaagaacagcaaaggacatttaatttgaactgatcagtagatcatatagtacataattcataaaaacaaataaaatataaaacctttttgaaagaaatgagaattacataaattattaaaaatcaggacacttctaattctcttcgtcaccacctcttatgtctcgtttttcacatagttttagttgctgtgtgggttcttttcgtgacttcatccatgtagacggtagtggcacggtggagtgattcaacaattccttaaatttcttaaacagtttagattaaatcatcctctgtttagtctcatacaatttgttgaacatcttattctccataactgaggactcgttgttacttgatgctggcccatttcccgttccgttgagctctttgccacatcacggccaataggatgtggtgcgtccgtattgtctaacgaggtggagctataatcgttatccaagttgagatgata

SEQ ID NO: 990 - DNA, 1290 bp, Zea mays
  misc_feature (1)..(100): optimal_loci_292158_G1, chr8:153378612..153379901, Cluster 6
caaatgctatttcttcctgctacttgctctgttttctgataaacctttgcatcaactataggcgtgccttttatgaccgaaggatctcccggaggtcagtggtgatggtacggtctgggtgaggtaaattttccgattacttatttcttgatccatgaccttgttgctgatttcatacttaattattggtgagctatgtttctttgtttcgcaggagtccaagggttttgtcttcaagataatgggtggatgtgacaagcaatgcttcacaatgaagcaaggagttctgacttctagtatgcaagtatgtgaactcccaagagggcctccaagatcaggaagttgttcaacctttctaaggatgatgatgtacgcaagtacgtgaacacatactgcaggacattcactaccaagaacagtgagctttcctacatctaactgcattgctactgtatttatttcattgatttcagggtgcttctagttctagttcaatctctcgatgtcttgaaagtagacataaatgtctttgttatttaccgttctattagtattctgtgcttgttatgtgttggataggatttatgacaatgagccactgatttctgaagttttccaaactaacttgtttgcttagtaggtaagaaggtgaaaaagaagtttgaggatgtcgaataccaaaagcttcttccctgtcacaacgagagcttggccaagaggaggtccaagctttctactgctaccaccttcgcttaagaatgttctatcttcttacaacctaagtacattatgctgccctagctatgttgcatcagtgaaccctttctacttagacttatgagttatcgttgcaattttgtatgaacatggtactggcttgtagcaattttgtcagtacaagatgtttactattgtttttatttagcattgttcttggtctgctgtctgcaccatacgttaaatatctgggatttttctgcttggttctatgggcattatccttgtctttttcttgatcatgtaaccagctgtttctactgaagtgggttcggaaatcgaaacttaggtgaagaatgatgaggctaccaggggttagaagtttcgtgtgatcacatttgatcctaccaggggcagggtttgcaatttcggaatggaaattccaaaaattccttcgtttcggctgggggcgaaaaaatcacttcagccaaaaaaattgtgtgaatttgggttccgcgccaaaacggactacaaaacagcccataaatcccacaaaccctaaatcgtgattca

SEQ ID NO: 991 - DNA, 1154 bp, Zea mays
  misc_feature (1)..(100): optimal_loci_292665_G1, chr8:156261822..156262975, Cluster 6
tatgcatgcgcgcgtctggtggacccatgcaaagcaccaaaagctaatttgaccccgtcgccgtcgcccgtcgaggtgtcacagcacgatgacgagctaggctagctagctgggcgatagcaacgtttgtgatctcccttctctcaacaccacctacgtacgacggccagcagtcacgttagagagacggcacaggtccagtcggtcggtcggtcgctcatcactggctggatcgatctgcggcctggtccatgcatgtgacgatcgatgtcactgcgaattaagaaccgtgcatgcactcgcttcatgcaagcaagcatgtacgtacgcgtccaaggggaagcgacggagatccattgcaagcgtccgtcgatctggactagctataggcgtaatggacacgggtgccatcagccgagcctgttgcagtggcttaactggccggcgaatctttgacgtcgtcgtcgtcgcatgcgtacaggggacccatgcatcatcatcatgcatgatcgaggcctcttagtttggcctgacctgcacacacgtatatgtagctcccgctcttgccagtggacgcacgcatgttcgcgtaatcatgtcctgcgccggcggagatgattaccggccgggacagagacgtacgtagtgctcctctccttgtaacgctagctgtcgctctcctcctcgggctcctcgtctcggccgccggctcccgcgcggtgccgccggcgcgtcgtacgtcgacacgcgcgcacatgcatgcagttcccagtcgcgtgcatcagctactatccgatcgacacacctgctttgccactcgcagggttaaccttctcgatttgttatcgtgtcccggcagcgaccgagaacggaaaaacagcgaaaaccgctcgaatttcgttgttttcgaatggttattgtttcaaatttgaatcggcggtttttctttttttttctcgacggatttaattttgtttgttctcggtggaattcgctaaatttcgctcgggaaattgttcaaatcaagcgttggcgagaaacgcgttgcctctgggctggccctctggccggctgagcgcgtgctttcccgctgcttatcgctaagagatctgttgagcagcgattgaattctcagtgtagggttgacacttgac

SEQ ID NO: 992 - DNA, 1233 bp, Zea mays
  misc_feature (1)..(100): optimal_loci_293477_G1, chr8:160232929..160234161, Cluster 6
ccaagcctggccgaaagtgcaggagggagaaatccatagcagaaaagcaagaagacgaagcaggagaacctgagctagctcctcatggttgttgccgcaatagaacgaagcagttcacggttcttccagatcgagctgcagcatgcctgccaaccctcctcaaaccacttcaaaccaaacaagttctcaggtggggcgacaggtgataaagcgaaagcgagagaagtggtggtctatgcgtgcgtgtgtgttcaccataaattaaagcaaactagttcttcaggtgcttgtgattagcacttgccgagtggagtgattcgatcgaacagtggcacattcgtcggtctgtcctgacaggaggaatgcagcctttggtacaacagttgcaagtacttccttaactaagaggatggatcattattgctttttttctttgtgacgacggtgagttgcagtcacctgacgacactcatgttgacaagtggcgtaagtgtctgaaaatgatgtttattgcatgtgtcacgatcacaggaagatttggatgcctgctttgtcgatccatcacctgccatggaaacgtttttcacatacgcagtgacaaccgatatagactgctttcaaaatgatcgcatggaaacggttttcagatgcatttaaagagtggaagagcgcacttgttacacatacgcagagacacaatcgatgatgttttctcacagattgactcctgaggctgaggctggaactacgtccgagcttgaacattgtgcagcagctgcaacaataacaaagcattgtattcccaagtaagttgatatagactaaagttgaaactcaacataaggcttgggcatgtggaagcttctagtcaacactaaatctttaggtatattccaaagtctgcttttactgtccctttttatgtcaacttcagtctttctctgcctctcttcccaacttcgagcctgaacattctgtggtttcagaaaacataatgtgcacaaagaaaatacatcggcctgtatttctcgtttgtccgaggtttacatgatgacacaaatggcttccctgaagctgctgttacacaattctcaaatccttcgtcaacaagcaaaaatggaagcaggttctgaaatccctgaagatgctgtttacacaattcagtttttatattgaagttggaacctcatcctatgcttaatgaagagatacagtgggttgaagatggtctac

SEQ ID NO: 993 - DNA, 1130 bp, Zea mays
  misc_feature (1)..(100): optimal_loci_293843_G1, chr8:161907788..161908917, Cluster 6
atagcaaacgcttacttaataacacgcgctagctggaaacaaggcagggagatgaatcgataaatgcggtagcatgcatccatgcaaaggtatttcagtctaattttgcatacaaaaggtacaacgtcatgaattaacagcccacggtgtactgcatccacagctacatgataggcaaaaaaaacacctggttgcatgggcgggtacgaagaggcataccgtttcggacggaccaagctccctaaacctccccatcgaaccaatcagatggtataaaatgacgcacttgatgtccatttggtgatctgcttaggctatgtttggaaatgcagttttaaaatactgtagttttaagatactatagtttacaattatacatgactcaaatactacggtattactttaccataatattgctcaaaaccgagatctgtttggttacattgtaaaaacaaaatatatttatagagaagagaagaaaactgagttcttgagtagagtttcgaaaactcaaaaaataacacagttttaggtaaaccatgatatttaaaactgtaatttgtctgaacaaaccaaatacttttttatttctaatactatagtatcactaaataccataatattgtttcaaaactgtaaaaatactacacatccaaacataaacagagcctgactggtgtgcaaggattggacagatctttgctgattacaaggaagccaatcaagcaccacaccagcgagagcactaaccactagtagcaatcatgtacgacgagtcgacgaggcagagggaggcatcacggaaggcgacggatgggtggccgcgtaggtggcgtcaacgtcggcgtcgtttgggccaccgcttccgataccccccaccgagacggaacgtgcttatgcctgcaaagaaaccatacttccatagattaaaaaaatgacggaaagaacgaagaagggaaaaaagaaggaatttgaagcggacatgtacgaacataaaaaggaatatccagttaaccagttttgcttgtttaagtattatagacaaacatacagatagatagatttaagcaaagtgcgtattcggtgtctaaccttgtcggaatttaataacctaaacaaaggattgttgg

SEQ ID NO: 994 - DNA, 1031 bp, Zea mays
  misc_feature (1)..(100): optimal_loci_29396_G1, chr1:179830391..179831421, Cluster 6
attcatccatccagtggtgtagacagtggatggtccgggtgggccacggtatatcctaagccggtccaccggatcacccgtccaccaagatctatatagaaaatactgacatatattatatttacattctaatatatacatttataaacttaaatgttaaatctatagtgttatatgctatttttatctttatattttgaactatataataaattattatatattatattaaattatttataaaaaaattttaatggcatacatcataaaaaaaatctatctacgtcactgcatccatcttccggtggctgagcatgcagatatttttctactgctgtgcagcatgacgatgcaggcagtccggccggcccgccctgcgtctttgaataacatgtaacacctacctataccggtagctttcagtggcctaataataatgatcatatgaattatgaggtcgctcgcttcggattagagccgactgtttagaccactggtatgctatagttacaatccaccgtatagacaaaaacactgagttgctttgtcttgcttttgggctgaaatatctatgaaataaagaaaggtgaccaccaatgcaatacgtatagtagctagctcgatgacccatcaatcggtgacaatcactttcctgctgttgtctgcaaagtatagtggtggtaacatgcatggtctgcgtgactaataaggttggttaattaggtaagaagaaagatactactacacgtcaccaagctagcccaggtagtagctactagctctcgccggccgttcaccttttccttagtgactaaggttgccgcctgtcacctagccggccttaatctgcatgcatacatcctctgtggaattgctcggcatatgttcttcctctcttcattatcattaattagacctatgaagaagaaaaaaaattaaagctccctttgaattagcacgttagttttgaccgtttcatgacctacgtagctagcttagctaggcgatctctacgaacaaacagtttattc

SEQ ID NO: 995 - DNA, 1330 bp, Zea mays
  misc_feature (1)..(100): optimal_loci_294149_G1, chr8:163676305..163677634, Cluster 6
cccgtacatcaaaacagcggatgtcgtggcggcgaaggagttgttcacgacgatatatatactagtgtatgtcgcgcgccctgcgcacgaaattaaattcgtttctcagaccttaaattgcacatacatattatatttaaattgaatataaaatatgactacatatatgcttaaataattttcgatttgttaatctgtctggaagcatgtatttgataattattaatctattgagcacacatccccttttatgagagaatcaaccaagagcgatggtagaatcttaaaagtatcatcaacaatcaaacggagcacataattttacgcttaacccaaaggacaaaatgtgatggagaactaaaattcatatttagaatttgacatgccattccccccaagggaataagttcaagagaccatacacatgaagatagaagtaatcagccagaactgcttctaaaaggcattcaatatactggtcatatgtggggtggacaatccacacattcgtagtcaccaaatgcctccaaaaagttaccgatgacttctagataagtatgaatcgaagtcagaacaatgagggaaaaatctgcaggaacaccaggaacaattcgctcaccagtggttctcgcggcggagatggacctaacgcggaggcaaagcggggttcctcacctgtttctcatacgctgcagcaagcgcgcgctactgagattgagaagaacgtcggacgggaggagaagaaaagtgcagtcggacgggaggagaagagaagtgcggttgcacgaacacctaactcggtcagccaaatttttatgggcgctctctaatagtagctgctgaagagatgtgcgattgcgttgcgagacgaagaaaataaataaataatgttatccgcctagcactatcatgtatgcgtcacatgttttatggagttttctttcatagccgacaggggcgttgtaacttgacgttttaaaaaaaaagtaaagaaaaaagttgtccgttcaaatgaaatccaatgaacaacatgaaaaaggtgatgtggccaccttggttgagctccttggtaaagtatggttctactaatgccaaaaggggcaagagatatgccccttttagtttgagagcaacactaagcaaaaacagctggtgacagaaataatatccttaaatccccttcaatttgcctggtttgattagattagttactctttttcataactaaggtggtgtactatagttaatagttagctggtttgattggatcgagtatcctacgctgcggtggctgcttctgtcgacagctagtatgttggtttgggatata

SEQ ID NO: 996 - DNA, 1164 bp, Zea mays
  misc_feature (1)..(100): optimal_loci_294519_G1, chr8:165718709..165719872, Cluster 6
aaactattgaatatccgtatccgttaacactttatgtatgtacctacgtatgtatgtattcgagatagaacgagtaaaaaacagagcgagcacaggccagataggataatttgattcaagtagaaatcgagatattgcattattgtcacatgattcaaatggctgatcacgggtggggatttatccaaacgatcgcttttcttggctgcgtgcctgcgtgcatccagaaaaaaggcggaaagggaccacgtggcgtgtacatgcacgcatgactttgatcagtgtgcgctttgattaaactaatcgtctgaccttagatcggcaaagtccccaggttaaaatgcgtgtgtcctggagggtacaacgtacaaatccgcacgcatcgcagtttgcgccttcctgatcgaaaggctgccgtcgcctcgctgatatttttttctttctacttggctcgtgtcgtcgtcactcaccgctggcggtaataatgattttggggccagcttttctgcgaccaacgctagatgcagcgtgtgggccggccggtgcagcagtactgcaatacaatactacagatatatacaggtgggcaacaccccagacgtgagggtgagacggtgaaagcaaaaatacggtcggcttcccagttcccaccgacggcgcgcacccgatgcccgcgctcgcgcgtccgtgcgccgcacagtagtagtaccaggctaccagcggaagccccgttcgatttgacgtccccgtgctgagctcgcctgctccggggaccatcgctcgctgcatgcacgagaccatatcagaatcggacggaacgggcgtagtataggagtaggacaggaggagccgagacaaggaggggagcgtgcggccggcggtgcccagcggagcggagcctgcgacggcgccagggcctgacagcggacttgaatgcaccccgggtatttcgcttactccagccctggtcccggaccgcagcctggtcccggcgcatgccatggccatccaccccgcccgcccgcccgtccagcccatcgacggctcgtcgtgtgtgcgggccctgtcacgggcaatggtactcgagttcgcgactgtttcgacccagcaggtgcaggtgcagctttgcccaatactgcaggctgcgtgcgtccactgttggcg

SEQ ID NO: 997 - DNA, 1332 bp, Zea mays
  misc_feature (1)..(100): optimal_loci_294521_G1, chr8:165720133..165721464, Cluster 6
cagagacgacgaccgggtcggcccatgcgtcctcgccgtccgtccgtcaaacgggccgctggtgccatggaggaaaggaaggaatacacggatggatggatcacctcctgggcctactcacgttggcccataaacgttatgattttttttggatgtggcctgctgtctgctgcacttgctcgtcctctattttatcggggttgttcactgaaccacatcatcatcggaatcttgcaaccgctgcactgcgcatgttgattgagagatgcgaacggtcaaacctgaccgagtacccaacccaaggcaccaacacaacggtgctttgcatcagggtctttgcacactgcacagtgcacacaggagttgagggctggcaattcacaaagcatgcgctgcggcgtgccactttctcagcagccacgcacaaaaaaaaagccggacaaaacgaacgatgccaattgccaccgcgcgggtacggtggagccaaaaccgccagtgcaaccgcacacggcagccggcggcggacatggcatatcacggccgcgtatgcccgctccgatccatggcgcagcgagaacatggcaccgccctccatccggtcccgacccgacccttcatcccgctccagcccgtcgtcgtcggacggacgctgccgcaacgtcaatgcatgcgtcctgggctcctggcttgtgtcgtgtccgtccccgtcccgctcctgccgtgccccccccccccccccccccccccacaccccggtagatttcgctcgccccaatactgaaccgcatcatcatggcccggccggcaagctgcggccgttccatccatgatccacctgacacgcaggaacctcacgtctcctactactcgtctactcgtgctccgcgatctttacatcctacacgcaggagtagccatgcagctgccctgccctgcccgtgactgcgactgcgaccaaaggcggagtactagttcgctgccggcggctcctcgcgaccggcgcagataattagtactactgattctgagatcgtgttgcccagcccaccggccgggccatgggggcggctcagttaagccggggtattagccatcatggcatgtccaaaaaggatcagagcaaataataaggcggcagccttccggggggcagctagctgtctaggcctggccgggcgccctacgaacgcagcaccatcatgaacccccctcgtaccgccactcctccgctcgcgctctctgattacccacagacctggatgagcacactgcacagtcttactaagcatcttcaacaaaatattctgctcctaaaattttcttactaaacag

SEQ ID NO: 998 - DNA, 1364 bp, Zea mays
  misc_feature (1)..(100): optimal_loci_294697_G1, chr8:166620821..166622184, Cluster 6
cacctggaaggaacctggaaacaggccaatccggtccatacgaacgggccctaagggtccgttcgtttctgctggaacagaacaagattactttcaaatctctaaaatttatagtaattattaaagaaatccaagccagatttattccactcattcattccatgcgaaacgaacaggttgaattaaatctcaagcaagttaaaatccttgccaattatttctaaactcatccaatgagccggaaacaaccgttcagtgaatccttatttgtgatctaccgttgaattgactcgcccttggattgggcctgcatattcctattccaaaagcacttgaacataggagctcacacaaaagcattggtaatgcatggtagcttgaatgcaatcacattctagcgcgtggccgagatttggactgagaggcgatggtagctcataatacagaccggctgtcacttcaaaactactgagactcatagctgcatttcagtatttcagcctgaaaaatattaatcactcggagcgctacactacacccatgctgctaggattaactaatgcatgaataatcaaatcaaccacagctaggattggtttttaaaaccgtggccggcagcagggagtaattcaactctctgcgctggcctgcggacagcgcattgggatcggattaattattagaccggtattaaaacctgaggacttgaggacggattcgcatggatgcacgcatgggcggaacccggcatgctcccccggactcgatgaagaagagcaacgagccaacgacgacgacgcagtgcatcgagctccgcaaccgacaccgccttaaaacgaccacttgctcgagatcggtccatcggtgtttgtcgccgtacgatgcactcactactggcaaatggaggcttctattctatgtatgttccctccgatcccttcccaagcatgggcattgccctctctgacggtctgactagagctagagccttgggaagatcctctttgacttctctgaattggcgcaactgctggccagctgggttatgttcatggctgatgctaatataatccacgctaggtaggtagctctgtagtagctgttgtcacggctttggttattatactgcctgtgcctagtaccagtaccagcagcgttgctttgggtttctttaaaataaccgggggccttgtatatatttattaactgacaaattcttctggatctgggaatgattagcgattcttcaacagaagccgcggccgcgaccgaatctcagcgcatgtgaccacgattattagtactactagcttattggtacgcgcgtgtgtgtgtaccacatttttttgctgtgaccaaactag

SEQ ID NO: 999 - DNA, 1015 bp, Zea mays
  misc_feature (1)..(100): optimal_loci_295103_G1, chr8:168012428..168013442, Cluster 6
ccagtcaacgttgctatatttacgggtttaagtaggataaactaaaccatcggtcatgcatactctacttcccggcactatcgccaatttcgcatgcatagtgcccaccgctaatcatcggtgggcatgcgcgcggctcccctcccctctgcgttgtcgctggcgaacagaaatagcatgcggcgcctgtattttgggggtgcaaagaaacgtggaagcgaggcgccgacaacgtcggaggtcggacacgcccccgcgtccgcgtgctttggtcgcgatcgtgctccgagttaacgggaagccaaaaacgtgcgccccaaccctttcgctcgaaaaaaaaccggaaactatggtcagggtgcaaaagaatctgcaggctagcgaaagggtggctgctatacaggacaacagaggctgctatacagtaattttctcatccaccgcaaaaaaatgcacacatttatttaagcacggcgaggtacagcaagaagcggctttttcctgcggtgacgacagtgctttgacccgggcacctttttcagcgaggctgtgccgctgtgcccagcccagtgacgccatttggcattcgtagtggacgagccagcaccagctgactcccacccgctgaccctcatgtacaccaaaatttgaaggacgccggcgccaacgactcgtgccgcccacccctcttttgccagttcagttcgccaggccaggcacgaggcacccaggcggccacgaatccggtttccgtctggtctgccacctgggacagtgaccaagccgtgtctcctgccacgcgtcaggtccgcgaagaagaaagccggctcatgacgccgactcggcaactgtactgtaccccgctccggcctccggaagccacttgtgccgacggttgtccaagtactcgttcgtatccagccaggctacgggctacctaccgtcgacaaccgtttaggagccgccagttgtccaagtacacgaaccataaccaccacgcgcgcgcgaaatgaaa

SEQ ID NO: 1000 - DNA, 1119 bp, Zea mays
  misc_feature (1)..(100): optimal_loci_29513_G1, chr1:180523021..180524139, Cluster 6
agcaggcacttgcttgcggacaggctttctattttacttatgtttcgatgatgattgagcttgcgttttgatgatgtcccatggcacccctcgtggctccaaagagcagcaggacatggcagccccgccggacggtgtccatccggggaatttgcatggcaaggatttgcctcccctgtgctggctgccccatggttcccctggccgggctgccaaaggaggccttagggtgtgtaggattcagttcaaagtccaaaaatagaagcccaaatttttatttttttgcctcaatgtcattcagcttttttatgtagaaaaaggtgatgctaacagaagcagcacacaggcaaaaacagctctacaacatatgcaatggaagaagtgtccgtgatgcaaaagaagctcctttaatagcagacaaaggttacaagagaaaactaaagaagtttttttggttggttggttgttgttgttgttgttgttgcataagaggtatgcattcttatagttgaatttgcgcaggcaggccttcactatgatgacaaaatggccaacacaaacaagccgatggaaacatatacgaagttgagaagggtcacaacattcggtatttactatgcaaatacagttgacacgctctcgcatacgtttgttttgctcatgacccgaacaaattaagatgtgtgcataacttaggactggagatccgaacaaattaaggtgtcgggtagccaaacaggaatttggaagaacggctagaatccggaatgcaacattgtaggatggctgtcagatgcatactgtatgtgcaacatttggttacaacgtggagccgcacgtggttgagatgaagcaacgtcacgtacccccacaccacatatatcgcagaagtaggtaatcaaacataaattcgcagtacagcacgcaatactgacccggatggcacgcaatccggggcaaactgaacggggtggggtcatgtagagagagaaaataagagggaggggggaagaattcgttttgagcagaggccagaaggaaagatatatttttttttttggtcgagcgctgacctcgcagagcaagatcgggaggggaggggagggagggattccttac

SEQ ID NO: 1001 - DNA, 1177 bp, Zea mays
  misc_feature (1)..(100): optimal_loci_295919_G1, chr8:171995210..171996386, Cluster 6
aatcactcgtaaaatctatgaaatgtattaaaaaagttcactttcagcaaatacatgagttatcaattcttgctatagaatgaaaaatgttctccattttaggcatgtaataataatatttttgagggaatccaattataatttgacttaatgtaaaggatcagattttgctttttttaagaagcatattttgctttcgagaagggaactaaatgagtttagtcctggtgttgtacaaatgtacagtatttgtggtccaatagaccagtatatacttgcatcccccaaaatatctcatcattgttactgatcaaaacaactatatagaggaaactaagaggataggaccacatttacttgaattccatgtagcatgaaacacaactgcagttgtactcattaagatttcgatcccctagcttatagctactttgtagcttttgaagcatctcttttctgtttcttgtttactgcaatgcaatgtatttcggctaatgttcactcactctcatatttgactcctgagcgccctgacacgtccatgtagtttatgacgtcgcaatagcatacaagcaccgactgccagatttcctggacaacgtgtacggcgtcgatccttctgaggtccacatccacatcagaacggttcagctccaccacatccccgcatcggaagagaagataactgaatgggtgatagagaggtcaggcagaaggaccagctcctggcaaattttctcgtgagggggggggggggggcgtttccctgacgaaggaacagaaggaaatctgtccacgcccaagtgcctggcaaactttttgacagcagtaggcttgacggccgtctgcctgtacggctgtacctaactctcttctcgtctgtgtgattcttcaaggtctactcgactactggctactgccatcggatggctcgactgaattaccatggttcaaggaatcggtggacctctggttctctgaagtttggtatagatagtacttattatttaccatagacatcaagtcgttgtagtatagtggtgagtattcccgcctgtcacgcgggtgacccgggttcgatccccggcaacggcgtttttttccattcatgtaaatttttgcagtcgacatactccaatagtttttatgctatgttttgttttcccacgtgcacata

SEQ ID NO: 1002 - DNA, 1071 bp, Zea mays
  misc_feature (1)..(100): optimal_loci_296004_G1, chr8:172371402..172372472, Cluster 6
actcatgcctgcgagctatgctggattggtcaatcggtatgtctaggaattgtgcgaaaagcgttagttacagtattgacaactcagggaatctggttgttagcatagaatggaatgggatggaaacatcaaatcagaagggcgaaatgactagccaaacagaccatatggttaggggtgtagcttcatggtaacagaggaacatgcctgttgcctgtaccatgtcttctttgcggctagtgctagtggtactattgtttgtcatagacgcccttaatcacgctgctgcgacgctattactgctccccactccacgtcactgcaaaacatgccttgattcgtcgttgagcgtccaccgatcggggtcactccggttcttggcagattgcggaccgtattttcagcagcgcatcacatgccccttgttagtgtttgttcgtttacaccaatacagttttagattagcatggattagaattaaatacatgtcccaaaatattcaaagaccatttaatttttttattcggttaaatccatcatgaaatataacccaagggtttggtaatttttaaactatggaagacatagattgtatccataactcattagatatggaacaaattcataaaactattgcacaagtttacattagaattcatagatcaaaagaataaatagctttgagacacatttattagttgatagatttaattccaccataaaattagatgtgaggtatggattcatccaattcatacacggatcaaatctatggtgagattttatcctatgtaaccgaacaagaccttaaaagtaagtgggaacaggtggacagaaaaagggcgagagacgcttggcagcgccgcgcaggcacgaacgggcaggttcatggctcctgcgcggtacgcacgccgcttgtcgtcgggcgccgtccgccattgacctatgcgcacgcacgtatcaagcctgcacaaacacattccactggaatagtactcactccgtcaaaactacaacttcagatttcgaacgagtcgaactttattgattttaattaaatatatataaaaa

SEQ ID NO: 1003 - DNA, 1371 bp, Zea mays
  misc_feature (1)..(100): optimal_loci_297529_G1, chr9:3313839..3315209, Cluster 6
tgcctctgtgtgtgtcagtgtgtgtgtatggccggctagccgctagctgaaaggtcgtcgatcgatcggccaccagtgacggcactctcacttcacttcccggcttcctgcctgcctgccatcaacggatcgcgcggcgctgtcgacggccctgctgggcagggccggcgctgaaagagactgtagacttgggagagagagagagtggggccgcgcgcgcttggcatgcagtgcgtagcgtacggcgtcagcgtaggaggagcttcaggttcagtggttcggtcaatggcaatgatccagcggtctctggtccccccccgcccactgcacaggaaagcttttcgggcccatgctcatcatcatcatcattcatggcccattctgaattctgatcggtcggcttggcttgccttggattggatcgccctctcgcgcactcgccaaaatgggtctacgtctaccgcgcgcatcttcctgatcctgccgaacacgaagcatgcatgcatgcatgagtgcgcgcgcgcgcgcgcgtgagggactagggagagcgtacgtgctacgccacgccttgagccagttgcgctctgccaccgtgacgtgcgtactgcggggcgggcgcgtgtgtgggttgacttccatctcttcctctcgagggctgtcctccgagcacaaagagcgtgagtgcacggtcaacggagggctcggattctccgtgcctgtacgttcgacgatactgatcacctattgcgtacgctacgtgtcttccaaccgcgcggcactatcgattgacatggccggccggcgcagcaactttgtgaccatggtcgcgcacggccgcacgtacggtaccggaccattgcagaaaaaagaaacaataagcactggttgagtactactagctagctattgtatctgaactgtaacgggatctaaacaattaggattagatgcgacaatcttccgtcctggtttcaatgatccggtttagtacaagatgtgtcgtttactactttacgctatctccagcaggcagcagcttactaaatagtttgcgagatgtgcaagctccatacatacttaaaagtttagcctaagcttaagaattttctttagactgagctattttttgcatacccacgtccatgccttacataacaaaaataactagttcttggtgcataatcgaatcatttagaggtttttatggggttaagtttgaatggtagaattactcattaagaaggtccatgacttttttataactttgtggttggctttctcatagagtcaaagatatatacaatgcattgtttcattgagataaatagaagtatccagtgttagctgtagaaatgttataaacagtaagaa

SEQ ID NO: 1004 - DNA, 1271 bp, Zea mays
  misc_feature (1)..(100): optimal_loci_298931_G1, chr9:9001394..9002664, Cluster 6
atcaacaatccatgtatatataaatcgcttgctgttgtgattaaacgcgatatatatacgctagtgcatgtgtacgtacgtgtttcagtttcactagtcactaacagttccagcgccgcacgtaggccgacgtacggaggcggaggacggccacgcagactacgggcagcaagccgagagcagggggcctggggcgcaggatcggagcaggcggcgagtttgaagcgcgcgccccgccgctccccacctccctttactgcgccattgatgcacggtagctgcgctgctgccgcaatgtttccccgcggacgcgcttgatggcgcgccagcaccaggtcgcagctagcgcctccgccaccccccctggccgcgggaccaaaataatagtcccggtcacctactccagatcgcgccgctttactaaacagccgcgccaccctgccgccgccgccgtcctccgtcctcccgcactctcatcgcctacctggcttcaccgtagcactagctacatatagcgctgtggcacaaactcgcacaggcagctcgatccgtgtagcctcgtatggtatacgtaggccaagtcaagctgcgtctcgatcagctagcagctgaaaaattggcgtcagcgtgtcacacaccatgggcgccggccggcattgtttgtgctggagaatatgtgtacgacagtattgaatggtgccttaaatttgccatactgttgcggcagcgtagagctcgtagttgtcattatccctcccccggcccgtctcctccggtgctctcggctcctgcccaaatgaagtaaaggcatgttcaacgactactctgagatggttcgattttctaagtacaagagatacagttatagcatgtacaactctgatacatcagttcagttttctaagtataatagacaccgaagagattccgtgatacaaactctgagtctttaggccataaatacagttaacggacaatatatatggagggtcttgtagagacgagctctttacaaagggtcgtctcttgtattttttcatctaaccccctaaagacccatcaaaagaccatatattaaatgatgttgtacatacctttaaaagactacatgatacaaccataaaactctataccataaatgcagctaagatacaattaatatacatggagagtcgtatagagacgtgctcttagcggagagtccgtctcttgtattttattaccccgtaaaaacctctcaacagacctcatttaaggttgtacatgtcgta

SEQ ID NO: 1005 - DNA, 1121 bp, Zea mays
  misc_feature (1)..(100): optimal_loci_300036_G1, chr9:13759121..13760241, Cluster 6
cgttccctctattttttggggccgccaccacaaaaaattgacccagtgttcacctcggaaccgcgtgactctcatctaaacaatataaaaaatatagtcactcctttcatccatactttcttgtacgtccaaccaaacacaccgttagtttatgcaagtaagatcacaaactcacgccccaccggcctccgattggggactcagtatggctgtgaagacgatgacgctgaaaaatcacctccatccattgagcacacctacatcgtacagctccgttgtcatcacccatgggaaaagcaagcctgcgctgcgccttaggaagagcagacgatggatgatatgatatggaacaatggaaggcaaggcaaggcaaagaccacgccacactattcaagtgcatgcctgcctgccgctgacgaggcaagcataccaccaccaccacctctgccgctgcaaatcccgcatgcatgtgtggctggcatgccatcataggccggccttcgtgcatgcaccgtatccaccacacgatctcggttcgtcccgtctctagcttggacgctagcgttagtgagtgtacgtactactgccaggcaatcgggattctacaagtggtgggttgcatcagctatgtatgcaaaaatggtccactgggttcaggctttcagatccatgctgacatgtatctgttgtcacacactagtgttatgctctttttttttcatgtgtactacaagctgctggtccactggtctgatccagatacaggatgtttcaggaagcgtccggactggtgtacatgtcatgttctgaagaagcattgcattggggccttgggagatcattgcagcaggcaggggttgtcgtgtgcttccttcctttggactggagaaggtcatgggctcatatagcagataaactgttgaggccatatggatagtagggttcctgtagactgtagtagtagtgctttcaggtaggcaagcaatgttggtggtaataagcatgaatatttagtccaatcgtagaaaaggatcttgccagtttttttttactttttttttagtaaagagttgttgccaatatattccgtaggctgataggcctgtttgtgctcacgctga

SEQ ID NO: 1006 - DNA, 1302 bp, Zea mays
  misc_feature (1)..(100): optimal_loci_301132_G1, chr9:20236852..20238153, Cluster 6
ctggctgtttttgatcttcagttccagttatactgaaacgtctaatgaagtttcaaagtggagttgcgccttcagctgatcatttgttgatttgcatgttagggaggtgcatttgagaacatgtttgcaaattcacaacatgaaaattgaaatcaaaatgagtgttgtctaattgccttcttgcctcctaaagtgtggcaaatatattgagtcaactggattgttggtctgctgctacggaaacatgcctttcagccttattaaaaaaagaaaatcctttatttgtccggggttaaaacgctgggtggatttagtagggacatgagtgtgtggaatggcttatcgggtgtgcttagtttagtttaaatcatgggtttaaggtgtagagattacttgctaagtttacaatgggacctgaaggagcatgcctagtcttttttctcgtgttatatgcttacgagaagaccagttaaggatgtgtgcgctcatgacatctctttgcatgcaaaaatatttcatttttctcttgttgtgaaagcaatgaaatttgaactttccatcaacttcatgagctaattatcccgtggaccacccaatgacaaggtcatagaagaagctgtgcttgaggaagctttgaaggattttagttccatactatcttgtttcaactttcaccccttggcgtaatatatgtcatgatttgtatttaaaatcattccaatctgttaatcctttttagaagttataaaatttcctttttattgtctagaattgttctttatagcacattacctgcatttgcaacttgagttcgtttgtatctatgcacaaaaccatggctcaaagaaaagaataccgcagaaggcattaatttaaactttttatgaacacagaatgcccgtaccaacacatgatgagggtgctggtcatggtaacacgatggccaattataatactagaaaaggtagcgccctatcgggcgctatacttgccgtctatttgaaacgaggggaacggcacacagtctgttacatacacacacggcaaaaaaacacacacacgtgtcccacccgttcatccttgtgatgggacaaaaacacgcatgttataagttccatagtacaaaacaaaaaatacggcattggtagcatataagtgagtcatggaataaaatgcatttctgggttgccaaaaggtttaacaacaggcagttgatatatacaaaagagtaggtttttcttctgccactacacagtacaagtcactgaggatgaacatcaggggaggaaaggtaacatgcac

SEQ ID NO: 1007 - DNA, 1071 bp, Zea mays
  misc_feature (1)..(100): optimal_loci_301715_G1, chr9:23262237..23263307, Cluster 6
tttgaatgttttgatgcccccctactacaccgtctctcccagccctttgacatgttttccgatacataggacggcatcaaattaattgctgtcttaacctctccatatgcagagcatctgatgaattagaaaaaaagaccgttctaccttttttttcacatgcccttttaaaaaagccaaccttaagtatcacgccatctagcttttttgttgtgtagttcgtgaagatggttttgagcaatatcaagacccttccataatattagctctcgtcttcttgtcgttctagtttaaagtttcattgtttttctatatatgcgtgtgtgtgtgtgtttccactgcttagccacacaaaccaaacttaaatattttgtgttatcatcatcttcttcatccataactacaaggcttttgttttagctatcctgtgccgtcgtctcgattctttctccttgtgcgattgaaagctcagcgtgggtgggttggtagactagctagtcgggacgtacaagaggttacgatgattattaattagccaatgtttttaagctgcggcatcttcgtctagcttgccctagctagctagggcatatataggcgcgtagtgtttttccctctggtcttctctcccttttcttcttcccactcgcaatggagtcgcagtgccaagtcccaagcagcagctggttcgagaggcagagacgacacgacgggatcgccagtgcaagaggaagctagcacgcagatcgtggtctggggttctgatcatgagcaggcacgtagctagacgggagaaaaggacgcggcagccgccgctgatcgtcgacaaaagtcccgtcgctgtttgtttggttttccgttgtcttttccgggcctcgcgcgcgtcgttttcctctcgctgccaccatgacgcctgccgggcggaccgagctgaagcggacctcccagctccgtccgtcccatcatcgtcgacgacggtccggggttctctcatcccgcctttcgcgcatgccaattctaacgtgattgtggggacgctggaggatcctgtttcgattcacgtcagttagc

SEQ ID NO: 1008 - DNA, 1116 bp, Zea mays
  misc_feature (1)..(100): optimal_loci_301769_G1, chr9:23450911..23452026, Cluster 6
tactgctggctggctggattggatacatgtattggtcatgatgattctctcgtcattactctttagcacagatgcgctgcagtgatgatccccagatccactgctgttgcctgtgttgccatctgctctgatgaccctgttcacccctgccttttcttctcgtgttcaccttgtctcctctctctctctctctctgtgtgtgtgtgtgtgtgttctgcaccgcaggaagggcatacctagtggatgctcattgccggaaaagtgcctgacaaacctggcgaagggtccaacaaagacctgggcaccacgttggacatggaaaggggtcctattctgtgaatggagtgctgaacggctgatgagtgatgaggggcgatgatgctcaaccttttctggattgcatggcactgaacaatgaaggcagctacgagtgtctaattagagctaaccctctctcctcttgaagcttattttaatcacccctttttgtttgtggttctgcctaggatagtcattcagagatgtgacaaccagcacagttccacttacattgagatgactaagttgcgctgcaagagaaatgtgaagtcgttttgcatgattgaataagggtgatgctgagcccttcttttataggttatgttatcatgctttatgttttatccttttgttttatactaactcttgagtgactatgatggttcaaatttccattagagagctgtgcactaaaggagatgtcctccatcttgatttgagatcttctgagctggtactgcagatacagtccaaacaaaaagctattctgtctccatttgttgtgtaactaggatggcttgtacctcactagtcactacctccatctcgaaaggaatgcaattttgtctatgcaccctgacaagcattcgttttgggggcagtggtaagtacaagtaaccagttatgcggccatgggagagacagaaagagagagagagagagaggttacattgtgcttccactataaattgcacttgctatgatgataatggttgaatctgagccactcaagtgacctttttcctcctagtaccactgtctgaatactcctgcccccttacccccaattcccatggt

SEQ ID NO: 1009 - DNA, 1246 bp, Zea mays
  misc_feature (1)..(100): optimal_loci_301770_G1, chr9:23452083..23453328, Cluster 6
tgaattggttaaagcttttattctgttttgtactcgtgtgctcatatctgcttgttcttttgtgctactttgcaagtcctgttgatgatatgccctgattttgggctgttcttcatttgccttgctgctggatttgaacctgcgcccttggttaatgtttgtaggactgatatgctaagttagttccatgtcataagttcctacctaagtgccgctcaataacgatgaaataaaattccaatgtgaggcaatgatctgtatcatggttgacacaagcacctttgagcaatcaaggctgctatgttgttaaccttgctcttagaggacatggaaatggactcgaatatgtgaaatggactgctgacgaagggcgatgatgctcaaccttttcggagtcgcacgccattgagcaaccaaggcagctgcgtgtctggtagcctatttaataatccctttttgtttgtggttctgcctaggatggtcacctggatggatatatgacaaccaggacagttccactcacaataggatgagtagattgggcagaaagagaagggagggcctgatttctatgattgagcaaaggagatgctgagctgagcccctttcgtatggtttatgcagcggtgctttatggctctgttttttgtttcataccgcgcttgagtggctaagattgttctgctttccattacagagcttctgcactctaccatcttctgagctgatgatacctgggatattctttgacgtttgctgctttactacgatggcccatgccttactagaaggtgattctatatctgtttgctgctttaactaggatgccttgcaccttagagcatctctagcagtcaccaaaagaaaagacaggttgtgcatccttgacaacaaattcacctccccatgatagggagtagcggtcatccgtgtatctctgcgtgttttttccaagcgttgatagattcgggagttgtagcaagttctttttttttcttgttcatgtcagattgagtggtttgtttttttttcttacacaattgccattgtgctgataatggttagatttgagtcactcaagttacctccttttcttctagtacgactgcacccctcgctccggcggtttgtattgccgctgatccagttaatgtgctctttgagtcggttcatactttctattccgttttgtatcttgtactgtgtcgtcttgttcttttgtgctcttttccatgtcctgttggcg

SEQ ID NO: 1010 - DNA, 1096 bp, Zea mays
  misc_feature (1)..(100): optimal_loci_302132_G1, chr9:26708297..26709392, Cluster 6
tcaagtctaaacagagaaccagcaagctttataccgtggctttattatggcccggccggccggttgtctgcacatacatgctccgtcctctctgccatcctgctaacagtacagtataatgtgaatctgtgatgtgaagaggccatgtgtgtcactgctgcatgcatgagagaaatttttttgcacctgcagtgccgtcggtggtcagtttgtgttttggtatgcatgcaatgcatggccgcacggcagagaaaagagagtgtggtacgtcggtggtcagtttgctgctgataggccgggctagctagcagagctgtgtgttggccttgttgcatcggggggaccgatcgagtcagggccaccgagccggccagccgatcgtcgttgatgcccgtcacatcgacgacgacgacgacagatggtgctgcgatgcattccattatatttgggcagctagggatcggatcagatcaaggggggacagggtaggggccaagccatgccttcaaagctaacctctcgatcgcacccattctcatttccaatgtcgttaaaaagatgcctctttctgactcagttatcatgcatacagtcaccgtcgcgtcgcatctttattatatatgcatggactaacgagtgttgtttctgcttgttaacgttaggtaaactttctttttttttagccaggttcatcgttcgatcggcactttttaacatatatatattgcccagtgtgagatgcatgcatgcatggaggcaaagctatagctagctaggtttctcttcccttgttagcagcacaagagtgacgaaattgttcacacgtagtacgtgacagagagcctgcaggttggtaagaaactaaaaagacacggcaagagagatcgagtatacgttcttcttataataataagaggtaacatacaaacacacagctagatacttaagtagctactgtatgtaggaaaattaagcagccagcagctggacgccaaaacccttttaattagtttaatatgtagtcgtctatccatatatatcgatctaaagttgtaaaaagatatatagatgcttgacgacgttactagttagatcc

SEQ ID NO: 1011 - DNA, 1339 bp, Zea mays
  misc_feature (1)..(100): optimal_loci_308690_G1, chr9:69410248..69411586, Cluster 6
aggtgaagtaggctacgcatgattagctggcaatgcataggtggggattagcacggaaagcaactcatataatagcaggtttttggatacattctttatgaggttttaaggctatactgagctgggctggtttggcccagtgttacataatgtatacaacgaatgtcaaatgttttctttcgcaacactatgtatatgatacatgttctgatattctttctgtacatgttacagtttgtttctttggacagtctatacgagtatacatgtgaattctatagtctcattaagtgaaggagcttggcctaaacccataagaggctaatcattaaagaacaaggctatctcattttttcaagccaaatggctgcaactgtacaagttggtagcgcaacagttcatggcttatgaagaagccccaccactttgaccggtagtgcaaccaaaatcgttaaattgttgtctgcgtgtgatcaggttgtcaacacttttgctcacggtccaatctaaaaaaacccttataaattcttactaatgtgattccttcactccacctattgaatgcctaagctatttttgaagtaataggtcaatcaaatctgtatggtgcttgttttgctattacttctatctcttaacatctttctcgaaattctatgtaggctaatgcgcggcaatatggacctgaggagctcatgagcatgaatcgaatgagggttattatgccagatttaccttatattgtttccttgtgaatggtagcatagaattttttgcataattactagaaatttaatgcaaatgttttatagaatatttcaaatgcttgaagcatttgaacatctacattagttgtcattctattttattcaatcactaaattatggccattcgtgctcttcaactatttatacagcttaacatttgcttcaaacaatggcttgtaatgttctcttttgaagtatgagatgcaagagctcattaaccacttccacttatgaagagatcagtctgaaatcaacatagtatctttagctacattgtgaaatgggttgcatcttcggtcgggcggctgcgtcgtccctgctagcgcccaagaagtgggggcaaggagaggtcttctctgcagcccaatttttactgttttctactgtttttgtctggaaacttcagccaaattgcgtcatcttgactacctccccagctaaccaagatataacaacgacagatgctatcaagcttgttattagggatgttcatcattcaggcgctatccaatctctgatgctatgtgctatgtaataatggcataatcccatcggccgcttagtaagctagc

SEQ ID NO: 1012 - DNA, 1038 bp, Zea mays
  misc_feature (1)..(100): optimal_loci_313485_G1, chr9:98500765..98501802, Cluster 6
agaccccaatatagccgtttcgccgaacataaaaaagtaagaataaagccgttccattcctcaccgatcctcgatcaaacacaccattaaagctagcgatgatcgatgccatgtagtatgcgcctggatgtcgatgtagtagatggcccatcgaaagcaaccccccgggacgacatacctaaaaccggtcgcgtttatcacgcactgagagcatgcggaaaaaggtggaggagggatctcgaccgacctccgctgatcacaccccgtggcccgtgtgcgtcggcgtcggcgccggctgaatctgcttctccaccgagataagcaaagcatatacttatatatattgcgcaggaccgatcatcaacctcactcagccggccggtccggtccggtcggctttagtttttggatcgggcaggtcgacgaggttatcctcctccacaaagcaggcacgcgcgcgcgaccatcaccgaactctctcgccgtctcgccacgacgacgccacgggggcggatagcaggtgtgtgaccggccggacgcaaagtggaaaggcgtgcgcggcatctttgcctcagctctttttctttattgctagtacttctctctgtcgttctgctttggtcattgggtaattatcatgtcatgtcatggcaaaccgacctacccaagacacgtcaacgaccaagtggtggctgaataatgtatcataaaatattcatactatactcagctgccgctcttctcagggatctgctgtatatacaacagcaaactcttcatgggcgcgtggattttagtcttcttccggacgatcgacccaccgctattatgtgtgtggagtgttaacaaagctgttacctctgtaacctacctggaagataggaatggttagctgaaagataggaatggttagccggatagatacgtacagttagcttcaacaccggataactattcacagttttatgtaaatccttttgtgtattctaatctatataatgagtgctggccgccctgattagtgcgagccattctgta

SEQ ID NO: 1013 - DNA, 1094 bp, Zea mays
  misc_feature (1)..(100): optimal_loci_315238_G1, chr9:107405094..107406187, Cluster 6
gttcagttcacattttatgtgtactcgtcagtatataagaacaacctagctagctatagacagaaaacatgtcttcaccgtgtagagccgagctgaggaggctgctgccggtggtccgatagacttgacgtgacctaattaccacggtccacggttacacaacagagcctacacaggaccgctcccaactctgcggctccgatcgagtacgaggtgaaggaccatgctcaggccacgtaccgggtgtcgaaacaaggtcccgcgctctcgccgtcgtcgctagctcctcgcgcacaaccacggcgaccacctgctgctgctgccggcgccaggccaccacacgcactcagatttcagcccacggaaacgaacgcacaaaggtgtcgtgcgcgtgcgcaggctctcagcccgtggccgtgggtgattgggacgttcacctcaggtcggaggaggtcgctgaaggaacggtgcgggggagatccggcgccgtacgctggtgggatccggcgccgtacgcattgatggagccttccatttactgcagcctcgccgccgcagcggatggcccagcatgtcctgcggcccagtggccccgcccggcccggcagcggctggagctggatgcactttgatgatcccacgtggctgagattcggggggacggtcggatttttactttttgttactcccgtcccgtcaccgcgcgctccgtccgcagggcctggccggctgacctagggaaccgcctcgcgcgggccagagctcagaacggcctgatctcgatcagacggctccaaccaggacgagtcctgtcgtgtctctgtggtggtgtgttgcttctatcttagttgtgcaaagatttcagtgttacaaattacaatgcgcgaagcaacagggtccgttttgctactttagtgcagagacttaagtttagttagtggattaaaatttagtctctactctatttggttttagagactaaaagtattcataacgtattaaatgaatcataagagaactaaaataccacttaacactattccgtcattaatacaactgaaataaaggagagataaaaagtaaaattaatataa

SEQ ID NO: 1014 - DNA, 1016 bp, Zea mays
  misc_feature (1)..(100): optimal_loci_315578_G1, chr9:109602047..109603062, Cluster 6
tggcggctgaggaccgcctgtgagagggccaaaagaacgctctccaccgcctagaccaccggcgcacgcgcagacgcgtctttggagccgccaccaagaatcagatcgccatgaatcccatcaacattgtcttcggtaagtacaacaacatcaatctttcgcgaggcataatacaaacgccacctccttgatcccgcccgcctattcctccctagatctcctatccatcgctgctaccctgcccagatttatacttcctgggatggatctgtgtcattgagcaaacatgtctacgcttatcagtggaagaatacgtttatgctattgttcattattttaatattggatggattaaaatatattatgttgcattcggggctgatgatgatgaaggcaatttctgtttatttggtatgaataacaatagtgttttcaggctaatcatcctgattttcttcactctacatggtgattcaatgcactagctattctatggtttgacgttcaaaatactggaatatgcattgtaatatgttggactgaattttattttgcctttgattatgcgttctgcaattgtcaattatgtcaacacaaggtgttatgtttttctgacactctatgtacctcaaggtgatagctgaacaactttctgaaatgcatattgatttacttggtccaggccatttttaggactaattagatcgtgcctttgaaggtgtagttctccatccattagcataactgttgccttgaattgtaatcaatcacaggtggtgcctcacagacaagccattttcacatttatctccacctatacatggatgtttcttttcgattcacatttgcatatttcattacggagatggtggccactctctgaaaatgcacatcagcatgaagaagggtctgtcatatgaagacattgcagatgaggatgagaaaacaatgtgttttttaaacaattagtaacaacatgttgtaacttaacttgagcatgtgctcatgtaatgctc

SEQ ID NO: 1015 - DNA, 1345 bp, Zea mays
  misc_feature (1)..(100): optimal_loci_320180_G1, chr9:134287176..134288520, Cluster 6
tatcttagcttgacctaacaacttatattacatatttgggcttgtaaaccatctcatatttaaaagttatcaactataaatctgaaatctctttaaactctatagttttaaaatatagtttatcttaatccgacgttctatgaaaaattatgatttttttttggccaaaacatactagcactgccacagttcatatatagctttatcctgttggaagcacgaaccggcgcagtcggatgtgataccattaccagttgaatgaagcaacggacagtggtatacctaccacgtactgccggctttattctaaccagcagtaaaggtctaagagtgattatgtattttggcgtagtgcattcttgctttctagctacatgtcattttattttgaaatatctacgctagctatcggcggaccgagttgtgcaatgtgtcctcgcagacagattattcatcctgattgtctattaagacacccactcttgctgtcaatcaatcaaccaatgtaaaaatcatcatccccttccagttccagaggaagtatatattatgcgcttgagcttttcatccacatcttaaaatttctgaagcgatatccatccatttagaatggagcgcgcgccgctgagcggagcccccggcttttttttttggcttgtcgcgtttgctgtgtggcatggggaacgccggccggccttcctatatatctcctttttgttccgctcgatctccattcttttttcaccagattttttgcctgaattctcgtgtggacagcgcttggtggcttccacaaaggaaagcgaggcctaaggcaatgatatccccgtatagcctttgagctagctcatatccacaatccactgtcctatgcgatctcagctagcccatgtggagagcaccaacaacaaaaccagctagtacgtactagcagtagcagcagacagcagtccacacgcatgcaggccataaagcctggttagcgttagcgcgttctgctgctctgcctcgtcccaaaatcctgcgcctacagatccgttcatgcatgcatgcatgcttacatttcgtggtgcttgtgttgtgtgtgtgtgtgcgagaagggtgtagtaggttgcttcatttgatgtctttcaatggctcatttactgtacacagtggattgtgtgcaagtgcctgccaaatcgacgacgacgacgacgtacgtacgtacctacattacatgcatggcatggcctgccactatggacctgtacttactgtacacatatactgctgttacaagttggtatggtatgatttacttccatgaatttggatgaattcaagaatattttttttaggtcca

SEQ ID NO: 1016 - DNA, 1057 bp, Zea mays
  misc_feature (1)..(100): optimal_loci_320548_G1, chr9:135887542..135888598, Cluster 6
ccttatattaggggtagttggaattgaagaagacttttaaatgactcatcttaaacatgagtgagttagttttaaaatgccatgggggcaggtatgagctggctggaattaaagaggctcataggtggtaagacatgagatctttttgacaacatggcagagctagctagctagcaaaagccacaagttccaaagatgaaaggcagcgagagtagtgtgtgtgtgtgtgagagagaaagcatggtgctggtcctgcactcctgctcctgcaaggagccaaggactcctgttcgcagctgtgtccagatctggattgatgcaatggtatgacaatactgaaaggcactcactcactcactcattcacagatagatagattcctgcttaccaggacagagcaaaaacacatgaaagaatggaacgcatgctcgtactcctatatagtagcatgtactatatgtttgtagaccagtagcagatggtcgctgtggtcaggtagacaaactgtacatgtgaaaaagcaggcaaatgtacgtagatagtgggggctgctagctagcttgtagtatatatatatatattgcattgtgtccacgacagcagctaaaaagcttgcgaaatgcatgcaaacggaacactgcagtgacctagcgacggcttttgtctctgtgccccgctggctgcagctcagggtccagatcaaaaggtcttgcagctgcaggttgcatcatgttcacgggagttgttccttagtggcgtgctctttgcctactgtgcttgtgtgtagtagagccatgctagacctcgacaaccagatcagcacgcgtgcggttgtgaccggctgagacatcggtaagaggatcacggcgatccgagagctagcgattaaactaaagacatatacctaggaatacataggtagaggaaaaaaaccctattatgtctggttcggtacaagagaatggaaagtgtccataggggagaaaatctattgctattcaattttgtataacaagatatttccttcctcatgtattcccttcaattactgtatcat

SEQ ID NO: 1017 - DNA, 1214 bp, Zea mays
  misc_feature (1)..(100): optimal_loci_320809_G1, chr9:137261996..137263209, Cluster 6
actagatgtggcaccgcctaaaagttattgcctaagaggcccttgtggctacgactaccgatactctttgaacgaggaagatgaaggaggtcacccaaaaggctgaggaggaagattgcccgcctacattgctgccacccaagcttaggtggaggttgaggaggtctaggacatgcggtggcactggagcaagaggcagtgttaggacatagatggtagagatgggtgtgaatatcctaataaaaattagcctacaagttcataattatcattatagcaaaattgattagaaataaagttggtacgaaagtgtacacttgctctagttctactttatgcaaaccccctaaataattctgcttgcttgatctttagaatatattgaacaaagtaaactactaactaacaagagatattaagaaatgatgaaaatattaagtataatctgcgcaatgtagttaagcaagtattatgcaagaagtagatgtgtgtaattgcaagagtaagaagtgcaaatcacctagagcaagaaatgacataagatgtatccctgctagatggttcatatgctaattgatatcacacgccaaacccataatgatggcaccataagaaccactctagaaaggcactccagtaactcacgattttactatagtcgctattcgcgaatctcccatggagaatgagcataaaagcccctaaaaacaatgatcgaagctgatgacaaacttcaatagacgctcaatgatcccaaaaactttgaacatttagatgataataattaccaagagtaaaaagagtagtatcaacccaagttgttcaactaacaccataagattcaacatttacatgtgatgcactaggagctctctagtctcactcaaatgttgaagtacaagatgcaagttagagtgtgtttctctagccctaagaggtgttctaaagtgtgagtgaagtgatgctagacaaggctggccaagggatctattataggcccaactcaaaattcgactattcctcttggtggactaaaattagggatatcatacatgtctagtgcaccaatgtttccaacactaggtacgtggatatggtatcgatggctataaactagccattaagcttgtcagatattcggtgcactcaccagaaatagcatcagatacattcgacgctcattaggccgaagtgtacattttacatgatttttg

SEQ ID NO: 1018 - DNA, 1345 bp, Zea mays
  misc_feature (1)..(100): optimal_loci_320947_G1, chr9:137793579..137794923, Cluster 6
agtgaccgccgagaggggtctcgggcgaatcgtggtttataccttattgtcctcggggaatgtgtgtgacggcaaactcggggttaatcgtgtttaggaacgtaatccagatacctctaattacgataaccgacacaaacaattgaaaaatagcaataatatattttcattatattaattaccttttttttcaaaatccctaatttgtttagtgatacttttcccatacaagtcatcgatgccaaaaagaagcccgatattgatagtgggtattgaagaaatatatatgaagttgtcccgtcgtatcatcattggttgtttatacaaacctatacaccgatcgtcagcaatgaattaaactatacagtataccgtccaatttacctcatccaatttgacattaaccaacccatccgctgacgttcttgcaagtccaatcattgcagttgcagcaggggggcaatgcgaagcttaggacttcgacaaccatccagcatccaaaaacgcccgtacgcggcgataacatacagccgggccaacgccaatggtaacgtctgctcccgcgtagcctggtcctcaccaaaattttaaaacatgtagctactgtaccgcattattttaggcccggccatcgccgtcgccgattgcttgcaccgcatgaacagctaactctttggccgccccacacgcatgcctgcgatcgatagacgatgaactctcgtcgggaggaggagatggtccaaacgatgaaacgatcgacgatctcgatggcattaggcgtgaactgctggtgtctgtacttgttcagtttcacggtggtgcggtcgatgccggccggtcatgtgcactctcggtcagcatcgacggcgacttctcgctcgtgccgcgcgccagccatgcatatacgttgtcctgatctggccagggacaagggcgtgcatgggcggttgcgctggaggggagggaggggctggccaagcaaagtccggggaactgaatgtgaatgacatcggctaccaaatttagagaccgctattgattttgctctgctatatatcgagtatgcaatgcatccatctttttttttagcctcccgtcgttgttcgtactttcgtacgttgcgaaccaattgcattgcattatcattccttcccggcgcgcggagtagatagatgtgtccaattgtgaactaaggggttacgcgtttgtatagggattatgcaaatctttcaacaagccgtagtatcagaagaagtaagaatctaacaagataaaaacggaaacttttcgttcgatctcccacttgtaaaaaaaggaaaggttagccagaaaagcgttagattat

SEQ ID NO: 1019 - DNA, 1278 bp, Zea mays
  misc_feature (1)..(100): optimal_loci_321024_G1, chr9:138247695..138248972, Cluster 6
tccttggatcgcaatacacgtgcggaggatgagctggattctcgcgtttttcatatttgcccatatatgatatgagatgaggcttcgcgtgcaccgacgcaggcttagctagcgcgccccgttcgttggtgttgtgggctgcaagtttattaacgattttaaatatatgcaaatgcggttgttacgttacgattttaaatatatgcgtgcttccgtctactaagccggtcagtagtgaaccggccatgtaccttgtcactacgctatctgtacgcgcacggccaccaccagatccaacttacccgagccccccgaacagtctccgatccgtcgcgctcgcacggcacgtacatcatgtcaccgcaaccggcggagttcggctggcgttttctgtccggccgggtagaaggaagaaaaaaaaacgcggtgcacctcattcaattgctgcatggatccagctcgccggccttgacttcgctgatgtggctacgcgacggcggcggcgaaattttgccccccacccctctgtccggcggcgttgggccgtcgattcgtgggcgggtttgctgtgtatgtgtgacgacgtgccggcggccgtcgtactagtcaaattggagctctttgcattgtgtgtgttgttaggtgctacgttccacctaccaaggccaattctgcttacgggcttggttcatagcgttttatcagtttcatagctcacagagctttcagaaagaaagaaaaaaaaaggtgcatcttgtttatatcactacaaaacatacatatgatgtagtgatgtaccataccaacaaatggtggaacccagtgataaaaaatggcaaaaaagaggagagggtgtcctttcagggtaacctttcccccctttttctcccaccagaagtttgattacacagtacggttcattggtctcatgcaacaattgactaccttatttttttcaaagtatttccattttttcaaaaaaaaaaaactattttttcttgaaaaaacaaaaatcatttaaaaaataggttaccaaactagcctttaatgtttttttttcctgacgtgtacgtgaggactgggggaaatattctgctcgacctgcaagctccagagacaaagaaaacttagtgcttgcttggaaacttaacggggtgtttggtttgaggattcacttcatccaaaataaagtggtgcatcatatgtccatttcttaaatttggtagaatgattcatattagtattaactaactaattatgagaaatgagatggtgata

SEQ ID NO: 1020 - DNA, 1048 bp, Zea mays
  misc_feature (1)..(100): optimal_loci_321516_G1, chr9:140778117..140779164, Cluster 6
cggtccggcggaaattgtcgcctaccaagtaccaaccacacgctcatgcgcgctgtggtgccacgggcgcttgtggcccgctgccgtgtagtttctcgtgacaggacacgaccaacgcacaccagtcatcaggtcgacggtgactcgcacgaatgccccagcctaatgagccctcgtctctaaccacacactgacaatctggtcttgcgtccacgcgcactggtgctccacgcgcaacgcctcggagccgctccccaaccacgttcccaaagcctatgtgccgctaccccgctccccccgcctcagcgccgagaatccgcgcctcccaagccccacggtcctgttctcggatggtgctcccgtcctatacaccgctacccacgctcccccggtcccccctcccttggcaccgagtcgtctggccgtgccgagaatccgcacgcgcccacggctctgttctcccatttggaaacaccgactttctcgttttacgctgttacccgtgaatttgcaattagagatcgacgccatttggcaatttgagatcgatgccgatttgacaatgtcgagcgcaccttccaaatcacgttgacatctgcgcatgccaaatgtgccagtcatcccccacccccaatatataccaccactgtctcatgcctctttgcgttttcagtccaaggatttgaacttctagcacttgctcttgcgacgaaagtcaaggttagagatttcggaacattgcattctcatatctatagcagttttatttgtgtatgcctactgtttggtttatatctctaatagtgcctactgtttggtttatatctagaacagattcttagcttcttatattttgtaccagcgctctgttgggttgtgtattgcttacattgtatatgcttacctgttggttagtgttatacatgtattagcattctatttgcctactcaatttaaagcatttgaattaaaaaactaaagaaattcaagaaaaaaaactagattcaccatataattagatggggatatttccattctttcacccaca

SEQ ID NO: 1021 - DNA, 1108 bp, Zea mays
  misc_feature (1)..(100): optimal_loci_321826_G1, chr9:142638511..142639618, Cluster 6
actgtaacagagtttaatcctggtagatgcacgaaaagacgctccaaaggaagaaatttaccatgaatctcaatctcgaaaatcctccatgtagcgtcacagcaagaaagatttaatacattcagcaatttcatcgatagcatcagagctagtcttttcttgatctactgtacagccacccttttgtaggttctggagcaaacatgactgacgattcttgaacctcagtcaaatcacaaacttgcatagatacttgatcagtcaggtgtggttacagatctcgactcagtcccaaactcctaattataatttgtttgtggtattgtttagcatataatatacgttaaacatagctttagatttttatttttttcgatttttttaataagataagcatgtcaaactagggacaacaaccctgctttatttatggatttaacatatgcacaaattactttaatgatctttttttttcaaaacaggcatctaacaggtggacaatattacatctaacagccgaacctatttagcaataacaatcctcagaatgattcttgtgctagttagaactaatcacagacaacattgttgtctcgctgagcaggtgaactcacgaaaaaggtgcatgtcagcccggcagccaagcatatcacgaaaacatataacctcatttaaccgacaaactttttaaactgaaccaactaattactaatccatctttcccacatagatatggattagtatcatgtgataaccattacaaaacgataggaagttttcaacgcctcgaattgtctcacaaatagtaacgaagtgtcactggaggtggctttttcgaaccgtacccacaagcttggcaagctgtagatcccgacggtgctttctgagagacgacccgacaacacaattcggagaagaagacctcctgaagacgggcgacgacagcgtctgaaccagatcctgcttgcagcggcccgagctgggagttcgagcgaggacggtggcggtggcagatccaggacgccgctgcaaccctccgtcatcgtctcatcgacggggtatggacgttgccgaagctcccgcctgcagttgctcgaataatctagca

SEQ ID NO: 1022 - DNA, 1188 bp, Zea mays
  misc_feature (1)..(100): optimal_loci_321933_G1, chr9:142999111..143000298, Cluster 6
gcaaagcaatgtgcttcgtttctcgattccgacatctgagcagtagagaggtgcactagaagggaaggcaaatgctgtcgcgtgaaatactctagcgtcagaaaaacggttccgagggcggaggaaacggaatacgacaaaaatgaaagaaaaatggaggataacccatggtgggtgtctggatcaaagaccaccatttagcgcgtgtttgttagctgattacccgagaaaaggttcgctccatccagccagaccctccgtgtcatggctgtttgttctatggttcgctcacgacgaatacgcacccgcctacggagcacgccaattcggggtttactaaaccaaacagaaaaaagaagcctgattgtgatttcgcgttgtacacggcagagaacacagcaaacgcctgctgttttctcacctgccagaatatctctgcaaagtcggggagaagagaagctacagcagcatgcatccaaaccccaaaccgctgtacagtttcgctttggctttgagtcgttgctgctgctgtgaggttcagaatctgctcaattcgatgcgatgttcgcaggtccagtcagacttcggcgaggtggggaaaaaaaaggcaaaggatgctaaaagagctcattcagtttcatctaccgtcttttttcagtatggtcttaggaaggtgatggagtcatcctaagctgccgcagtaacagaagccacggcaccagaaaagttgaacaaccaatcgccttcacccatatatgaattatgatgtcactgcatcagatctgtcatttgcgttctcaaatttgtttattcggttaaactcatcatggattataacccaagggtttaggaatttttaaactatgaaagacattgatacaatccataactcattatgtatgaaacaaatccataaaaatattgcacaagtttatattagaatacatggatcaaaataacaactagattaaaagatacatggattagatgatggatttaatcccaacatagaattgggtgtgaggtatagaatcactcaatccatatccacattaaattcatggtgatattccatctattgtaatcgagcaaggcctaacattagcgacgcagaaaggaatggattgtcataccataacacaaccacgggaataagcacatctacgacgtccgattaagccccagatc

SEQ ID NO: 1023 - DNA, 1352 bp, Zea mays
  misc_feature (1)..(100): optimal_loci_322069_G1, chr9:143900482..143901833, Cluster 6
gtctattcgcagtgcaggttactctatatccttactctatatctctatttatagtctagtcattaagattcattaatttatattccaatcctccacactccatgcttgatgctacatcaaactctgaatccctcgtatttccattagtcgggcaagaagaagaagaaagcagcagcagctttcgatgtagccggattagggactcagctcgttgtctctccatcgttggcaacttggtccgcaatctcattggcaccacgagatcgactagcaattccattggctggcacgttctggcagttgtgttattagtctatactaactctatacacatcgcagccaatccggacatagaccataacaaaaatgattaagagattcatatacgtcgttagcataccggcccataaataaaaccgacaaaggcgtaggcttaaactagagcgcatgattagctcggggcatgcgcactcactggcaaaaccttagagggttgtatgcaaccagacaagcagaatgatccatggacccgatgccctcccacgcccgcagtaaagtaaccctggttctaaactatcttcgattcggtttgtctcgacgacgaccgcctcaccctatgagcggtgaccggcggcaccgatcgacgaaaggagaagccggccgggcgactctctgtaaagtaagtgtggtcgctttacaatgttggatcatgcgatggctaccaggggataaatttagggttcgttgcagtgcaggagtaagctaaggaccaatttagcaacctgcagtgcgctttatatctaactcgtgcccacagtcaggcacgagcacgacgcaagcaagttgccccggccaaaaactattccccggccgagagatgctaagctagctagtgagtagtgatgcaacttagcttgactagtgacgacgctgactgcttgtgcttgagcagtagcaatgctcatcccaggcccacatatgatgaacatacatacagagaagctatgaatatgatggaccagtatggcaaaacccgaccgagggatcaagtagaaggttcaagaaacattatgtttcaggaggaaaaaatatattataccttgaaaccgtccaagatatggaaacccgaaacacggccagcaaaaagtagctgattagccaagctaggcacttgaacattatgttacaccagctagactgcgaccgatttcaagattacaaatccctgatgtggtaacgactgtagcaagttgcaccgctgattgcgatcgaattcgttttcttggaacggccaacccaaatcgtgttgttgctcaggcagcaattgacctccaccagtgcaacaactggtt

SEQ ID NO: 1024 - DNA, 1169 bp, Zea mays
  misc_feature (1)..(100): optimal_loci_322558_G1, chr9:146341053..146342221, Cluster 6
gcatgcatgctaaccatgaatgcaagcagcaaacacgccggtcggtcgggccccgtcgcccgccggccagacgccaccgccgtccccgtcgtggggccgacgtacgtacgggccgggggcaacatgtgtccgcgcgcccgccttttttacagtttccgttccgacgtgtcgaggaagaagggaaaattcaccggcgtgcgtgtgcagtgcatgcaaggacggatgcatgtaaatatcaaaatgcctgcctgcgtgcgtgagccggccggcggttgaccgatggatggagatggagccgagggcgcgaggcgaggagacggtggtgttggccgcaagcgccgcgtcgccttgcgcatggcggaatcccggggccggggccgaggacgatgatgagacgacggagactgggagcggtggccgggcgcgcgctggcgctgaggcgcggtgcgtcgcccattgcggttggttttgtctccgttctgcctcctttgtttggggaagtcttggcaagatccactgggttcgtcgcgtctatcgtcgacccatcatgtcgcggcagcgcggttggccctggctagtgggcgggcagtggctgctggctgcccgtgcgctgcggtgacgcgccggcagagcgccaccatgcgtggtggcgtggcctggtgtgagtggaggtggaggtggagccccatgtgatttgctcgaccggtccagggactggagacggatcgattgcttgattgacgggtttggtgggttcagttcagtgggggccggctttccaacatgtctgccgcgcgcaatttcatgcgcgggtgctttcactgattattccacttcattttgatttgtagatagatcttcttgtggaacaaaagactgagatatatacttttatatattgtccagcacgcagtccatccgcctagaaagaatacaattctagacgagtgtgatgttttagtattttataagtttaaccaactatagttttacaaaatattaatattcatgatgttaaataaataccatcagattaattaaaagaaaaatataataattcattaggagctacacgtatagataccactcagtagaaacttagctaaatatacatcattttcgctagtacgaaacctgtaaataatttttttaatggagacagtgtatga

SEQ ID NO: 1025 - DNA, 1040 bp, Zea mays
  misc_feature (1)..(100): optimal_loci_323030_G1, chr9:148621405..148622444, Cluster 6
aatacgtaccgtgataaatggggcaagaaccgaccttgatccgattcaaacccatacaaggcgatcaggatccgcaaagcacacagatttgtactagctatgaaccacggcgagcgagcatccagcggcgatcacatcacatgaggccgtcgcaggcagccatggtccctgtccatcgcatcggcaacaaccaacaagacaacacaaggctgggcagcttcttccagttccagttccatttccagccgcacatttatgcgggaactatgttgttgcacacactcatcaccgtctttcctgccatgacaacttccgtcacattagtcgtagcagtagcgactctgttgagtgcaggttaatccaagacacttgaaccgacaagtatatatatttatttctttcctcttcccagctcgtcagcaataaagacaattagaccgagttggcaattcagttccgtcaggtattattctgtgacaggcaccctaggccaacggacgacggaccgacgagttgtcacattagttcatatctagtcgtagcagtagcgtgtgtgtgggtgtgggcgtcggggacgacggaccgagcgtcggagccggagaaccgcaggagagaaccctaggccgcaccgcaacggccaacggagcagagcggggacccgagtccccgaccccgggtgtgtgtggcgcagagccggcccggtgtctccgcatccatccaggcagcagcggtggactcgccatgccgggcgaccgcgacaggacgcggagagagaagctctccttgcgaccttgccgcgcgcggttccgttccgttccgttccgttccgcctccctccgtccctcttgtcgcaattactgacgcttggagcttactccaccgcctttactcccgggctttttttcacacggtgatccgtctctcgccggggatatcgcgctccgacggctgcaccggtgaggtgtgagatagctgcgctgggggtacgtactggctcctccacagcgccggagcagggattccgaatcttgcaccgtacc

SEQ ID NO: 1026 - DNA, 1030 bp, Zea mays
  misc_feature (1)..(100): optimal_loci_323051_G1, chr9:148675320..148676349, Cluster 6
gacaaggtcatcctcacgactgagcagccagcaacccaaatatctgttgcaacgtccagcctaatagatgttgttctttctcctcacatgtgatgctccttccaaatcttcgtcacaacttctgatggatccttagtggcctctatggctctaccaccatgatttcttgggcattcgaagcctaccttagttcattgatcacaagtgtaccggcaatgttgcaggcgctctctattcttgccaacttttgctttgcgtgacaacttgatcccatttcttccttttcttcttcacagattgaaccgaatgatttgttctagttggaatgaactactagatgggtctgtgtaactagtgtgcctgtttgccctatttgttatgaggtcacagattaaagcactagccaagggaaaggccatattcatcagaaggttcatgatgctctctacattcttgctttccagtgaaaataaatcatcccctccagtcatagttgaataaacctagcttgttttttcttatccataggtgaacaatgtcattacttccagttggtaatatcaattgtgtttagcaaaaaaattaagaggtggctactcgacagatcaatttgatggtgcattcagtttgcagatacctgtgcacttagtctaagtgaagtgacaagttgatttgttattttcatttcacaacatgactgatagatggtaatagcatgtttttaaatgaaaggctagtgattgagaaagagaccatctcaattgaacgatttcaattggacgattttcaattggtgattttgtagcctaagccatggagagggtttcattagctccagaagtggatgagggtatctcaactaaccggtgtagatcaacaaaaaaggtgctaaagtgtgggatcacattgattcagagctactagataggaaagagaaggcggtctacaaattctgtaagctccacttatcttctgctaaaggtaaaggtacaactcatctgaataggcacatttctatgtatttccatgc

SEQ ID NO: 1027 - DNA, 1252 bp, Zea mays
  misc_feature (1)..(100): optimal_loci_323576_G1, chr9:151123979..151125230, Cluster 6
tgcctgcgccgccttccggccggcctacaggaagctgggatccactttcgagcctgccggtagttgcagcccggatcgtagtggtgccctgatccagcggcagcgtcctgcggcacggacagcgacgggcctctctccctctcgtgggctcgtggcactgtcagaccaccgccggcgttcccccggccgggcccctactggctactgtgtccggcaacgactactactgatgagtcgatcggcgatctatcgagcctcttgctgctggtaaccaccgatgagccgagcgtctccgggtatagtggctggactggctgcttggactgggagtgtgtagttgtttgagctcgtcgtttgaccgacaagacaagtgaagcagatttctagggcgcgccaggacagagctcctcattatgtgggcacgtacaaggggtctgcctgcctagggctacgtacgtcgcagacaaaaagtttgctccctcctcaaattgctccgaaaatcatcgcccagtctcgtcgtcgagacgacaccttgcattgggttgggtggactcactcagagctcggctttccatcagtcagtcatatacaaacactttcaataataacttccttccaagtccatcagtgctgctgctgtgcacgcactcctctcttgaaaccgcgagtgcgtgcatgtggttcagtaaagtacactttcaataagtgtagtagtatctggctatggcttgccaatgtcttggaatgaacgggaggtcgactagtaaacggccggctaaacgctagctacgataatccgtgtttctggatagaatgtaggtttcggacgcacctgcactgcacagtccctgatatttcagcaggtggtgttgcatcgcggtccaaatccccgcttcaattgaatttaatttgtgcacataccattaccaatttagatattaatatgtttgatgtaatccagaaataatatatcaaaaactgcaacaatatacctctacttttataaagcatcagttttctagttttcacgtagtcccttttgcaaacaaaacattaaacttctttctatgctaacttgtggtcctaacgtgacgtgaaacgttaactcctacgtggaccgtgagaaagcaccaaggggtcgaattatcgtacttctttttatgcaatgctcctagatagtactacctctctagctaaaggtgtatgagtgtgtgagctagctataaaaaatggacatgtctccttttcaact

SEQ ID NO: 1028 - DNA, 1160 bp, Zea mays
  misc_feature (1)..(100): optimal_loci_325501_G1, chr10:5443772..5444931, Cluster 6
ctgctgtttagatcattattaaatgtgatagcaagagttgtcttttgacagtttggtttagtgagaaccatttagattatatagattatgtaaaactttttttctcggacacgtaggagatctatcgtatcctaaaggaactaacatccagaggagttgttaggaaagttatccctttcgctactgctgcctcccatagatgtctttcttcaccagctagaatctgagcagtcgtgatattatgtgaggtaacatcaaacacacatttgtttctatgaattcagatggtctattccgaaaccgaaatttagtacagtgttcagtttctactttctaggaagaaagagcatgattggtacaggaatgatctaaacttttaggaagaaagagcatgattggtacatgaatgatctaaactttttccacccccaatcatgctccattcaatgctttgtattcaagaagttattgttcttagtattaatacctttcccagtggttcatttttctgcaattaatatatagtcaagaggtgctggagcactggtcatcaagttcgcgaagaggataagagcaaattggttggcaacgtgttcagcagcgtggcttccagctacgacctcatgaacgatctctcatgagtgtcggtctacataggctgtggaaggacaggttgctgctgcttgccctttccgtttcttttatggatatcttcctttgtcactcgaactccgattcttttctttcaggcttatttccaagctgaacccctttccggggatgaagcatctcgatgtgtctggtggaacaggtaatatttatctccttccctcattgccagtagtttttttagtggcggacatttgtagtaggaaaaaaattcgtcgactgttcatgtcattgttttgacttcaggtgatgttgctttaagtgtactggaaagagttaagagtgtgggtcacagagctgtgcagggtactcttactgaaacgaagaaggcacccatatttatgtctgtgacattaatccaaatatgctaaatgttgggaaaaagcgtgatgcagaaagaggtcccgagcatgaacttttctaatagattttgttgcctctgtctcaagtgtgggttatgttgttcaacagtttgtttttataaattctag

SEQ ID NO: 1029 - DNA, 1387 bp, Zea mays
  misc_feature (1)..(100): optimal_loci_325954_G1, chr10:7436112..7437498, Cluster 6
caaaataattcggaaggtgtttctcttacaatgtttggaattgtgattttattatacttctttatactgctgaggttgtgcatgttgcccgaatttcagttaaaacttcttatagataactgttctaatcttgtgaggttgctaatatttatatttaacattgttattattatttttaatttgatgaaagtgccttctatttttatgtttacaaggtaagtaaacatctgcttttagtgatattaataaaaatatagaataataattagtgtttttacatatcaatgcatttttatcatattgatttcgtagcaacgcatgggcatatacctagtctgaaatatgatggccattgacgaaacggacttttcaagtcaaacatattgatcctcttcaaggtaagataaatttaccaaagtgaatgagactcttgttgagtacgaaacatctctggttacgaggataaaaaaataatcttgacattgatatttggttgacattgatatttggggtaatacgttaatttatcaaaaaactatacttaatttgatgggactcggtcttcttctaattttcggttgcctggtttttattaaaattaatggaaaatatactagaacaaactaatagaaaaaacgaattagggaaagtaaattcggttgatgttttaaaagttctcatgtttctattttctttttccatcgccatctccagtattatagtacaacactttcgcacgacacaaaccatcccggtctcaccctccacgcccaccaccacgacacaaaagttctcaaaaaaaatagaaaaaaaaggaaaagactcccctaaatccccttttccttccctagcatggcccagcttgccacccccgcggcccatcccgcgccgtcgtgccaccctctccccattcttgagcctgctacgccgcggcccaccccctggcccgcgtcgcttcgacctgcgcccaccaacaccacgtcctcgccccctcgcatcggcccaacctcgcgcgcaaccacgcctgcagttgcgcctcacgcacatcggcacatgtgggcagaatgtatcccccgtcgtcgggctcgcctgtcaaccgaacatcgtcgcctcctattcaacttcaactgccagctcccaagccacacgtgcccacatcactaaggcattgctaaaatcgcccgcgcctagtcgcaccggttcaaaactccgcccccaattctgcttaggcgcagccgtccgtgatcgcatcatgcctcatcgccgagcgcctccgcccgagagctcttcgtcgacgtcagctacagtcgtgcccttgtagttgcacctgctcgctctgcatcgcgtgcccacgtcgtcacgccggagcagcctcgccttcgtcgtg

SEQ ID NO: 1030 - DNA, 1170 bp, Zea mays
  misc_feature (1)..(100): optimal_loci_326465_G1, chr10:10390789..10391958, Cluster 6
gacggagaaaccgcctgctagtcagggctcgcagtgtgatgcagtctgctgcagcgtcaaggctgctgctgggcactgggaatgcatgggagcaaggcacttagctttggcggtggcaatggcttgagcggggctgttggtggaagcagccgtataggagtaggagtaggcctgcttggtgcatggatcacaagaggccacaaattatgatggcaagggtacatatatattgtaggattcaatgctgctgatacactattattcgtcagtgatctcagtccttctcaggagaaggtattcatctatctcatcagtacgtctttgtactggatggaaactacgcacagtttccactaaagtccatccatttcagcaactcaaacccactgtgccatgcattcgacccaggaggccgaagaggggcgccatgacccgtcgtctgttcttgtcacatgacgggtcaacggatggttcttgcgggtacctcttaccgtagcggtgcgtggacgttgacgggtcaacgggatggttcttccccagaatctacccccatgatgtagcagctggtgccaagtgccaactgccaaaagatactacttattttgttttcacaaatttttaatagtttatttcatatattcgggtaacattcacaaacaagaacgatcggtgagatgcaaaacgcccgcccgcacgcaagcatgcctcctctgccgttttattttggctcttgtgccgagaagccgagcatcagcaacggtcggcacctggcccaagactagaggaagaagatgacacggggggcacggacgcacggtgatcaaggccgtatcgtatggtatcgtacaaatggcgccaggtacagttcctccgtttccatgaaacgagagacaatgcatgcccatggaggatagcgcaaaaggaggatagcgcgacgacctcctagtgccggctccactcctgccactactatccccatcgccatggggaggcaaacgttgaaacttggaggttgcggcacccgagtccaaaaacaaaagtgtttctagggagctccgtcaacctcatggatttctctacatgtgtgtgcttgtgctatcgtgtcttgtcgtatctcgtatggcacgcaccagcggactcaagatttgaacctagagtgatcgagaataa

SEQ ID NO: 1031 - DNA, 1314 bp, Zea mays
  misc_feature (1)..(100): optimal_loci_33407_G1, chr1:204255126..204256439, Cluster 6
ccaacgaccttttccctttgagcgtgagtgacacagatgtatctgaatcagtgcggttagcatcagtggaaaatgtctgcactgcatcagcatgtacatatatacgccgaccatgtcgatgcaccacctctacacgcgttcgtgttcctttgtgaggatgacaggagagggggggatgcatgtttcattagaattctaataatgtccaagcattttgctcatcttcttcccaagacggcaaaacctgcagatagttccatcacaacaagtttctctaccgacagaactccggatcgaggagtcagtccagaaacatgctgtacggtacacagcctactaccggtccctctcgctcaaaagccggcactgcctctgtcaggtgctgcggcagcacggcaagcgtgatgtggccgtcatgcttttcgtctacgtgagatgaacggacgcatgcatatgccgggccggctctcttcttcttcttcttccaggttcagtgttgccaatggccgatggatgaacagaacagaacaggccggtggcctattcgtccgtcgtcatcaccgcacccagattggaagattaccgcgggcggcaggcaacggtcccggggcatcctgtcttgtcgcagccggttccagatggcacaagcaacggctcgtgcctgcctgctgctcgctttactccagatagccaacaacagagggcacactgttcgttccaatcagcagcgtgctcctacgtcaggttcagacgggctcacgcctgcgagtaccctcctccacttatggcattgcttggagctgggcaagattctattttggaaccccccaacccaacaacagacgtactgtacctgcctgactgctccacagcaaggctggcatctggaatcttgttgcgttgcgcacctccgacactccatcgtctccaaccaggacggacagacaaacttcagtcatttttgttagcataccccattcagcagagcactctcactgtccagcagaaatggtttttatgtacgcacgatctctgttttacaagtcatcatcgcgattagtcgagctagtcgtcagactttccggttttctagatcgtccaattaagcatctagatcgttgattaggcatctgattagagagtttctagtcgtccggtgatggctagggtttagtggcgactagggtttactattgggctttattgttttttttgcccatctacagtcacataaacagcttgcctcccctcaccaaaccctgcctacgcccctctccaacccgtggcggctagggtccagtgcagtaactggcg

SEQ ID NO: 1032 - DNA, 1004 bp, Zea mays
  misc_feature (1)..(100): optimal_loci_337389_G1, chr10:79131128..79132131, Cluster 6
agatctcgcactactggtgctagtagctagcgcaaccagacggtttttgcctggctcgtcgtcatcgaagcagcggcctctctacatcgcatccagttccagaccggcgaacatgtcgtcctccctgttcttggcccagatcaccacgtacatgcagtccagcgaacatgagcacgatccccacaaagctgcagcaaaattgcaaaagcaaacagtattatgagcattagcagcagcattgcactggatgccagcgtgcgtgcagtgcaatgcaatgcattacgtaccatcccagtccgatccactcaccgaagaagacgaaggagacgaacgccgagaagaccgtctggaacgggttgaacacggacacgagcacaggccccttgcgcccgatgctccacacctggaacgccgtgcacaggccgatcaccacgcctccctacacggtaggcatatagtatagcagcaccagccgttttcactttcagttcttgggtctttcattgcagttcctcaagctttaggagaccatcatctactactcgaggtctttggatgaggatgccactgccaggatctctgcgcccagctgggaaatgctgccggccgggtcccatttccacgggcggcggagtcggcaacctcagctgctccgacacatgtgcatcttctgcccatgcgagaagcgccgacgtggcgccgcgagggtggcctcacggaccacggtccgttctgaccacttcttgtcctgggcagagatgggcagtcgcttctggagaacgaacggatcaccgctgctgcgtcgtccattccaaaacggcatcggctagcactggtgttcaatactgaaaaccagtgaaaatcaacaccacggcctcctcattcagacttcacagtttcactagaatttctgtggtcacgcgaggtggcagtctggcatacacatcagcattagtacgagatctagacaatctttagttccagttatataatctgatacttcc

SEQ ID NO: 1033 - DNA, 1015 bp, Zea mays
  misc_feature (1)..(100): optimal_loci_34158_G1, chr1:208202116..208203130, Cluster 6
gtaagcggccgactactgcctttgtggatcgtccatgcaccctaccatatagtctttatgactatacgtgttagtaagcggccgactacagcattgtattcagtcagctttttctatagtttccccttaaatctctcagaacattctcttaatctctcaaatagagaggatcaaacagatcttttttcggactatatcttcagcagccatatcctcgtaccgaaatagacgaacgagctcacgagccgggcacgccgggtgggtgagtcatggctcgtgagcacaggccgggcgtgcaaactcgcgagccgaccgcgcctctcgccacgtgctgggggcccgaaaagcgagctcacacgcctgtcttgtaatgtttgagagaagacagagagagccaaacattagcatttcacacatttatagggtactttatagaatgtttcacacatttgattcatcacatgttgcttcaagctagccttccatgatcttattggtccacattagcatttcctagcaattgcataaacaaaataagggcaaataataatttctcttttctttgagcaaagaaaactatgcctgtatccttaataacatgttagctagcttgtatatttttttcgctgaagtctgtctattcttaacatgttagcctgtaaatccaggaagtaagtcgatgtttatattttctatccgtttgaagcatgtgcatcttgttctgcaaggtaagggtaaaaacataccttggataaaaagttaactaaaaggtaggcaagacatataccagaaacgtttggtagcaggaataggctccagctagataccatcaagcacaaaggcacattgtaggtttggtgatatatataaggctacaagtagtttggattcggttaaactttatatgctggatgactcgatcgttaaagtacgtactagttcatgtaatttgggattttagtatcctgatgagtgatgaaggatgctgaggtgtgaaatggttttttattttgag

SEQ ID NO: 1034 - DNA, 1155 bp, Zea mays
  misc_feature (1)..(100): optimal_loci_345504_G1, chr10:124179966..124181120, Cluster 6
aggtaaccttcctcttgctactttgagatgcactctgctgcttcccgcaggcagttggctcaggagtcagtcatggcgtattggcgtgcgtctctttgttggttggtaaagctgatatagactggacacaacaccggtgcgcagtgtctacagagtctgaaacgagcgtaaaaggtgcgtacttttttgtttcttttgatgaaggggaaaagggaaaaaaaaaacgaacgacatgccacttgctattagtttttgtccaccgtgggccgtggccgacccttcttttctggctcttcgtcttgcgatcaccaaagtccaaaccctcacgtgtcagcaccttcagcagatgctgacgggttctctgaggacgaacggtgagggtggggtggtgaggctggtggcaaaggaaggccgctcctagacggctttagctagctaaccggtcatgtttctttagctagctagctagctaagcggtccagtcatcggatcttaatgatctaccttcggaatacagacaagttccttagctaaacctgccagaatgccgttgaaaatccggggaggagttggtgactgtctgcgaatacacagttattggctgcttctgaaaaaccagtactgatgagcagggcaaaacacaacagttcccgtctgcgaaatggctggtacaagacagtgaggcagttggtttttgggtgacctctctctgccgtctggtttggtaccgttgccaatcagggtggtacggtgcgaatgtgaacacgaggagtcaacgagcagtctttccccggtcaaaatatatatatctcgtacacgcacgagttgatatctagtggatccaaacttgcgaggacccatctttctccgtctcttcaatcccatcgttgccgtctctccaatcgaagtatgtgtcagggagtgattggttctgcacaactaaaatgtaccggttcctatcacatcaaaatatttaaataataattatagatattaaatatagcttaattataaactatttacgctcaagaattgaacgagatattaaatctaattaaacatatatttaatactcataactaatatataaaaatttgacgtgtcacgaactaaattttagtcaaataaatcaagcacatttttcagcatgtcggc

SEQ ID NO: 1035 - DNA, 1204 bp, Zea mays
  misc_feature (1)..(100): optimal_loci_34613_G1, chr1:210646760..210647963, Cluster 6
cttctttctgactactctcaacccgaaataagtgaggataggatgcttgattacagattcataattatttttctattacagtttgttgttaccgttgacattcttttatgttcccttttccaatcattagatgcttggcaaatatattcttcttactgaagtaagaattaatgaagttagtatccatttcagatttcaccggtggttctaataaacctttaagggcttattagaaccaccagtgaaaatactgggccgggaggctcccaaacccctttctggttcagtatatgaagtatttttactcctataagttcagctgtgaagtattactaagaaaatcattcacactttatggtgatctgttagactgttactctataccatgacatggtaatatggtagatactttttgtttcttatatgtcacttctgagtatatgttgttgaaaccttacttttcatgctcttgttagtttccttactttaaccctcctttttttatacgtatgtttggctattgcactgttcaggtgaatttcaatggatagctttttttttcttctagaatatgcacgacagcgtattcagtatctttgtcagctacatatatgtgttacatgctcgtacctttgccttcttacagggcaaagaaagatgtctcactgaactgagaaatgagcttaaaattttggagactgaacatgcagaatgtcttgtgaattacttcaatctgtttttcacgcaaactgaattgtgtgttaaagtttttttcttaacatgttcattttaagaaatgcaatacacttcatttgtaatgtccaaaatgctaggtacgacctcctgtgagtgctctaaaagtttcatggtattaaaagctgtataattaaaatgatcgagtgaccatggccaagtgagtattgatgtttcacaggttccaaggctgtcgatttagttgccctaccaattctctcgatgtgttttttcagtggcccacctacagaatgtttcatgttccattcccgagctgcagtggccaaactacattctgctaatgaggtgagagcagattattttgtctctaattgttgaatggaaagcagttatcaactgaagagctatgtagtgttgcagtaatgcagtgtaacactggtgcgacaatttttatttttattttttgctgatcgcagagcaaatgaatctg

SEQ ID NO: 1036 - DNA, 1275 bp, Zea mays
  misc_feature (1)..(100): optimal_loci_346310_G1, chr10:128993559..128994833, Cluster 6
tccgatttcagtcgcctggtgctaggatgtttgcctggctggtgagctgcttggcagggcagcaaccaaacataccgtaagtatttcaggttgtgcttgcctacctggctagtggcttgactataaaattggggggtctgtcatgctgaagggagtgcagcacggtgtcctcgtccttgctcagttgctctagggcgacttcttcgttatcgcctgctcagccacggagctggagctaccggacgcctcttccggtgtcgccatcgatcgatccgtggggtgtgcgcggcgtagttggtcacgatcttcacgacctgtaacagacgaatcttcccctagtttctgttgcagaaagtagagtacccgaggtgaagattttgataaatctcgacaacaatgttgcccaggctaggcatctgggtaccgtaaggctggattacactcccaacactagtagtgggcaatgacatatcatgtggcatagttgttcattccacaaattgctgaggatgactcgcaaattttaaactcaactatgcctagacaagtttagcattgctagctcccagacaaggtttacaaaatcggtcggctatggcggtaaaccgcttggtttaccgaaaccgccgggcccaatttcaattaaccatcgtatttttcaaaattcactctaaatttaaaaattttgatttttttttataaaaacgaaaatcgttagtaaaccgccattttggaccggtaaaccactatttggaccggtaaaccaccattttttgtcgggaaaccagatttaatgccaagactgagttccactttaggcatttaaggggtgtttggcttgaggcataaacaccgtattagtggccagtttaggcatattagccttgtttggtgttatatgctatatgtgaagatgttctatgctatatgtgaagatgatttactgttagatgctatttttttcccagtttgagtgctagttcagagcccagacattgttagtgtttaactgtttatacgtgacatatatatgaggatattttatgtcaactatatattgttcttgtaagagacatgccaaacatagtctaggagcatggagagaaggttggcacgagtttcaaacgtaagtattgtagtgaaacgaagagcagagggatggtacatgtttgaagaagcatctcgcacatagaagtgcaagtatttcatatgcatgctcatataactacaagcaggtcgatgtgttatttttgtttcgtcgataaatatttattt

SEQ ID NO: 1037 - DNA, 1392 bp, Zea mays
  misc_feature (1)..(100): optimal_loci_347093_G1, chr10:133407699..133409090, Cluster 6
atgagatcatgagagtccccttctggtggacgaacggcgcaatcacttgcttcgacaaactgcgtcgcaatgtccagtatcttaaacagagccagagccagagcgagcgtccgggtaaagattcggatttcggaatggctttgcacaattcgagccaattcagaggtggtcgatcgtactcgaacactgctctgtacgtcatcgaaacgattgcgtgaagcaggcagtttcgtttggtagtaggaactaggaagcagctccctcctgaaacgaaaacgagagacgacgtagtaccgcttccagatcttccaaccattgatctgaaccagctaagatacttctggactcgtagttccacatgacatggcatttgcggagaaagatatgctggacaacacaacgccaccgaaaccctagtactcctagaagaacaaatttaggtagcgctgccctgctctcctctctctctctctctctctcttattatatcgcgttcgtctgtccctcgatgcagttcattgcggttgtccaccaacgcaacgagtcgtaacagaacgcgaaagcgagccgcgtgcaccaccagtgcgggcagctctccttctcattctcaaccaccctcccctcccgtccatgtgggagttggaatgatgggtgccatccgaaaagcgcgacagccgaggctatagcgctgccaagttgcaccgacgcgcggcggctagctcactattacactgaggtcacggcggcctggcctggtcgccgtgcgtatgtatgcctggtgcctgctgcggggacggcacggaggagtggttgccaccgtgatgtagatgtacttgcggtcgccgaaactgaaagcgaaggtctgtctgaccgtggtttctctcctccgtattttctggcgtctgaagacatttcgccgcaatacagatgatccgcacgtcgtgatacagatggtctgcagcaagtatattttgttacgcgtctatagataacgtaatttacattacattaaacaaattgggtgtttggtctagtggtatgattctcgcttcgggtgcgagaggtcgcgagttcgattctcgcaacaccccatttttttattatttctctgtatttttttccctccttccgtttttttaatcactaattttccaaagcaaggcaacatgatgcactctttttaaccagtaattgacaaaaaaaaagacaacatggtgcactgcaactgtgcaacatgccaacattggtagctcggtttttttttaaaaaaaaattgtaggttctcaacagtggtagttcggtgtcttttatatctttttttggtgttttttcttttctttttaatctctaactgatcaaaacaaggcaacaatgatgcactgcaactgtgca

SEQ ID NO: 1038 - DNA, 1372 bp, Zea mays
  misc_feature (1)..(100): optimal_loci_347237_G1, chr10:133813008..133814379, Cluster 6
aaataaaattaaatatctttctatttgattttaaatagtaaggaatttaattctttttaatccccttctaaccgataagtctgacgaaacttacagcaaagaggaagcccgtcatccagccaatgccgggctccttgtagcttcccggcacattaccttccgtctcctccccggccatctcgtaggtcctcttgttcagcccaagcaagaaggagccaagcccacctgccaatccaaggttctccacagacaagaacggaatattcaatcgcaaagctcagcacgcctcttacggtcttacctccgacggcgatgctgacatgctgtagcaggcgacgacgcatgtctggacgacggtgttctcctggcgggtgaacgggcgcgtggcgacgccagagcgggcgagcacctgcgtccagccgcggaggacgacgaaggcgatgagcgcggcggagacgttgagcgtgggccgtggggacaagcgcggcggagacgttcatattttaccaagcaaaaatgatttaatttttcttgagaaaatgaagctcctaagctagtctttaaaagaaaaaaaaaacaacgacatctctaattgttgacaggccaatacctcataggaaacatcaaaaggtaaattccctacctgtttatgctcttcagtatgaagtgctcttcatcatcaagggagagtacacgcaaggctatgtttagaagtgaaattgttttattatgtcatcgagttaagtctaatcttaaagaagatattgcatcttggttactcaatttagggttgtaattttccccctctgctcctctttcttttatttctttgtatttttcctcttttctctctaaactcagttcttttgatttaataatattactgtagtacctttttacagtaccttgacttaaaaaaaaaaggagagtatacgcaggctgcaggcatagaactaagggagaagagccatcgtcagcacacaatgagatgcagggttccgtgcaagaaatacttcgtcaccccgtctaggacgagccgatgggattaaaattgtgttcgtaaaaagaataaattgatgtcaacacggataacagaggtgaaatcctcccgctatatcgaacgatgatgacctcaaggaatttgtttattgcagtcacggtgccggctggcatgttcgtaatggcctaatctcttcctatcctcctttgtaactcattggggaccaaagaacgaacaaatgtaggtgcccaggcctcctccatccaccggcttgccagtatcaatgaaaaatattcaggtcaccctgcagtgaagtcttcagaataatggtatcagtgaggtcgccgcctctcgcccatctaggcgctccgg

SEQ ID NO: 1039 - DNA, 1099 bp, Zea mays
  misc_feature (1)..(100): optimal_loci_34742_G1, chr1:211335128..211336226, Cluster 6
actgtggcaccgaacatgatactcagagaacatgtaaattgcacactttggtgcaacactcaccagacatgtctagtggtgtgtccagttagtgtactggatacttgacatagttagcaactaatttatagcctttggaattgtagtcgttggaaagacaatggaaatgtctggtgtagaaatcagtggtgcaccaaacatgtccgagggctctgatttctatgcaccaaaaggtaatggttagatttcatgttacggctacaaatagaccccttgaccgatcttggttggcatcccttcactccttgcacttgagaacatctccttggactagagaaacacactccactcatatcttgtagttcatcatttacttgagattgtagagcttctaatgcatcgcaagtagttgtttcatcctatggcactatttgagcaggctcttgttactcttggtgatttccgtcacctaaatgctctagagttcgtgggattgttgaacgactattggagattaccgttgaatccgaccatcattgtgagggactcttgtggtcaatccccatggtagatttataaaaaacaaccccagtaaaatagtatcttgttagagtctctctagtgtggttcttatgatgcccttattatgggcttggcatgtgatgccaattagcacatgaaccacgtagcttggactcatcataacgagaacgtaggttatcggcaagcaatcgaacctcaaggataatacttgtgccattccttagactgtgtggattgtactccttacctactcttacaattacatctatttacttgtacaatatttgctctactagacttatgtagattatatcgagtaatactattgttattctcttgctagtaagtactttacttcgttcaatatacactagagatcaagctactagtttgtctagtgggcttccataaagtaaatagtgctacaagtgttttctttcgtgccacctttgatagtaattatctttgctctagcgatagttatgttcttgaaggataatttttatagaccattcatcctcctctagccatctatgtcatgtatctaggtcataac

SEQ ID NO: 1040 - DNA, 1182 bp, Zea mays
  misc_feature (1)..(100): optimal_loci_347483_G1, chr10:135332863..135334044, Cluster 6
agctaataaattattagctggattgaatcaactaataaactaattgttagctgtgaggtagctaacaattaattatgatattagccgatggtatttggaacctaacaactaatttttagtagctaactattaattttagaggttccaaagaggaccttaatgcaaccaatttggtggcaccactgcaccagtttcatggccatttgcacctcatccactattttggaaatgaactggtggacagacactactacagcgcacaccaattttggcaacaatcaaaatggtagccatggtgaggtgagactcacaggtttggatccaaaccaaatagccctcaagagttgtatggtagtgcagccaagcagatgtctgctggtccctccgctctcttcctgccgctcctccttcagcccagtgaagcaatttaggtggtgtttggctcaccgaaatataacgtaaatatattacatgaggtaatggataccgatacttttgtttggttgagctctttctagtaatactatcgaatccaattataactagtaaccattaccattcccttaacaaggtctgaatcaaacaacaccttattgcggattcgcttgcagcgactaacctgaatctatccatcctgatgccgactaatctgagtctatccactcaatttaatgctttgttttgtccagggctgtctgcataccattttgctctgagaaagaaaattttctctctggttcacttgaccatactgttctcttataggatcgacgggctgaaaaattacaggtaaaactaatggtgctgtacacacttacgtggcacgagttaaacttcagattctgcttcactacctgtttatgccaaactaaaccaactgcagttttaaccgagcaaagctattttggattttcccctcttattacttgttccttgttaaaactcttggaatcacttgtattattgctgcaactgaaacagtaaaacccccgttacctactagttttctattactcatgggatggtggattccagacatccatgtaaaattagagaacaaactaccttgggcatggtcattttgtttatcagaattctgtaacatcttcttcctccaatccagaattctggaaccaattcaacactggaggcatcgttcagtcagtcctgatggaaaacata

SEQ ID NO: 1041 - DNA, 1193 bp, Zea mays
  misc_feature (1)..(100): optimal_loci_347484_G1, chr10:135334131..135335323, Cluster 6
acacttgaataccggcggtaacaaatttgaataagacgatatccatttgtagtgtggtatcaattatgattagacttaaacaaatatgatttaacgttatgggttactcattacgttatcaatatgtgaaccaaacgacaccttaagatgtaaatgataagacatgagtattgttgtctctctttgtttctgggtatcttggctcggacaaatttttgcaactcagactatatccgagcaaaaaaacagcggatagttgggcttgggcaacggttggttagtttgtttcagttggattccctgtactgatgtgctatttcatttgtgcatgctccgattcatatttcagattcgattgtctgtcctgtgctgcgatgcaccgatccacgagctgtgctgtgcacgaggaaagacaaactgtacagaagcaattttctgaatgggctgcgattcattgggccctcgcttaaatggaccgaatggtcctaatggggagagctaaactttgggcttataaaaactgaaacaacaaaccttagtctattgcaattctaacaatcgcatagttgaagcctaagactaaacagattatactaagagctaggtcattaggaaaatcacgctaaacatgttcatagaatatttacaccaaaagagaggtctgtagtcacacaaagaaagtgtcatccatataataaccatataggggtatgttttaccttcaccctagatcatatttgtataaaaaggttgtgtgtctttctaaaaaccatggagacagggatgatgcctctcgctgtttcacttgaccgagaagcgagaagtatacttctgcaattttttaccggtacaaaattttgagccagctaatttgttctacataaaaaataaatgaatcgttattcctggtctggggcccagcggaaactaaatcgcctggctttgtcgtttccctcggccgtgatccgtttgacgtgatgttgcaatgagcttgagttttatggtagttcgattgaccgtttgggcacacgagtgttcctggccattatttgcaaagaacgtaaattcgattctatatctctatctactatgaagttccagttttaacgctgcgtcgcacacaaatgtttcttccctcgctcagtggatcgttaccctacggatagaccatgtgaaaaccattcgaacctcta

SEQ ID NO: 1042 - DNA, 1220 bp, Zea mays
  misc_feature (1)..(100): optimal_loci_348345_G1, chr10:139731170..139732389, Cluster 6
aaaaatcggtccatatgatcacgactcacgacgttgcgcaccaggtcccagggggtgtctcacgggctccgactcctgtggagcgttggcaacactcgtacttgcggccggacgcccgatagaacttgaaccgtttggacgaatgaaagcctcgccgtcgagccagttttgtaccttgcaactgtgcgagcgtatgcgtatttacggtgcatctagacgtagtcgtatccacagcaccagcaggcagtagccgccgcagaaacagggggggtacagtatgaatgaaggcgcgctggaactggctcagcggccatggtgagcgagcaagtaccacgtgtggtgtggattcatccgtgccgactctaattagtagaataaaacaaaatcaatcaaaacggagagccacagacaaccaccacacggaagcaggagccaggaggtactagcgggctagaggcgccccttctcaagaccggcactcaaaaccgaacaggcccgaaggaaacaaaggcaaccacggacccgggctccgccgcaccgggcccccactcctgcatgcgcggcgcctgcgcgtacgaagagactgacagacacatggaacgaggtgcacgacgcgcagggatagaaagatgagtagcgtcgcagagcagaggcagccagtgtttgtttggcggcttgcctgcgacaacgcacgcaccccttgccaaacacagcatttcgcgcctttttttttaacgcctgcaaccacatgcacatgctgcaccgaggcctccgcccctgccctaggcccctagtcgctggctcccagcaaatgagaggcgcgtcgaagcaactggttgatcgttggttgcgcctgcgcgcggccgcggtgtgccgtgccgtcgcatcgtcgcgtagccggcgtggacgcctgtgctgtgtccccggctccccgctagcgccgcgcggccgatcgggctggctatccgccagagcccagaggtgtccgcgatcggcaccatccgccgccgctgatcgcggctacctgcgcgtacacaccgagttggccccggtcagtttcagcgcgtggcggcaggcccggggcaggccatgtgctcacggggggccgcgatcttggtcgcatgcccgcccgggtgcaacggctcgctggcgctgtcgctgcgcgcccgtgctcgtgctcgtgctcgtgtctgacgctgctgttcccgggtctactacgt

SEQ ID NO: 1043 - DNA, 1307 bp, Zea mays
  misc_feature (1)..(100): optimal_loci_349752_G1, chr10:147131198..147132504, Cluster 6
ccgcctagaggccgctccagatcatgcgattgacggcgttgttgtcaccgtcgccgccgcccaccacctttattcttgttgtctctagatgcgcgaacgagcacctcatgctcgtgcgacggggcagcttgtggtctcgccacccgctttccagcagtgcacacggtgtcccaaaccctaaagacatacgagcgtcaaaactgaggtggaggaggcagtaggtgatgccatggccactcgctcgtctccttagcgaaatgcagggacaaggcaaggtggtgccatggtgggtgatagagaggtatagaagaggagatttgaagtggcatatggttttcaaaaattggagggtttgttctttgcttctgtactagggtgattatattctcaggttaaggtgtcaaataatggaatatatacataggttttcaaatacccactgaaggcttgtttgagagcaagagaacggaaggggataaaatcccttctactcaaaatatactcaattttgaatagaaacgggatttagcccatccaatcccctctatttcttttgctcccaaacattcctttacaattgttttgtcaacactaccctcaaattaggatattggtgatggtataacctattgtagtgggatggagcaataaaagagttgaaagaggctagacagaaggtatgtaacatccttgttacttcgaccacctaccatggtgtatgcagaaatcccagggcatttcggttatagttgacgaggtacgtggatcatatttcaggttctatggtagtttgccaatcattatagttgtgtaaggcgctgacttagttgtgcaatccacacacaaggtgtcatgctccattatactgtcctcattgctaggcctgtgcaaaataaaccaaaaccgaactaatcgttagtattttcggttccatgttttagaaaactgaaataacatgtgtaatttctattttatacgtctgaaaaccgaattaaccaaaagatcgagatatactagaagtccaatagaccaatagaattttaggcatgcctcaatttagccttcccaaatcataagtatataaacacacataccctccaaaacaatccatcctcaaccataatcctttatccgggcttttgtgcactcttgctaaactctaaattcgagtcagttctgtctgtcctagttgtatattttggttctagtattttgggatcgaaaactataaaaactaaggaaccgaaaacgcaatcctactcgttgcttcacgtctttgaagatcttgttgatatagatatggtagg

SEQ ID NO: 1044 - DNA, 1067 bp, Zea mays
  misc_feature (1)..(100): optimal_loci_39573_G1, chr1:236189377..236190443, Cluster 6
gtgttatgtgtttctgttatctgcagacagaacattgagtgcaaacagaacacttatgtgtttcagttatatgcagacatttcagttgtatacagatttcaactaaacaaccatctgctatgtgtttcagttcagtaaaatacccatcgagtgcaaacaaccaactgcagatatgtagctgaattgctagagtgcaaacagccaattgcagatctgcccatcgagtgtagacaatgcaggtcattataaggcatattgtcaagattttaaagctgaatttgaaaacatgttgatccaaatcggatatgtagctgaatttgaaggcatgtacctgaattttaatgcatggttttcttaaacctgagtctaagagcatttggaactaagcaaaactgtgtatgatcataacacaaacaacagatatgccatttatgccagtgagttctactttatttacaaacgaactgcattgtggcataactgaactaagtaatgtattaaatggagtacaaaaaagagaacattaattaaaattgtataactcgggctggttttaccacaaatagtgctttgctgataatgagtctccttgttctttttgtttttatatttttgaatgaaagcatcaagttcaggagctgcattatgtgaaacagtcaccctttctcctatgtcatcgtagttgcaaacatattgtcccatatcgtcgaagttgtattcatattgtcccccgtgctcatctcgctaggggatccactagctctgctggtacctccaagcgagcctcctactatagttgagccacccagtcgaagcaatgtgggtctttaggctcggagtcctccattagtttatccttaggctcggaatcctctaggatgtcctcggtggtcatgtatgagggtccctcctccattgtaggcttagtacgcgggaattgtcaagtgctaatgtgaaccattcttccgttgctcttgcagacggtcaggagggcacgtgccacctatgaatttagtaaaagagtgctacttagtttccattgagtaatataagtgtaagaagttttg

SEQ ID NO: 1045 - DNA, 1185 bp, Zea mays
  misc_feature (1)..(100): optimal_loci_39955_G1, chr1:237960895..237962079, Cluster 6
ctactcctcaaccaaacacacacaccggtgtttggtacgactccacaacaaagttcaagggccgaaattgtaaattctataaattttgggagctgcacaactctgaaattgcaaactctagagttttggggacaacagtacaacacacctccttttctccgttgaaacctaaaaaaactccagagttgtttcatctaaggtgacgtttgatttatatattgataacgtaatagataaccgataacattaaattatgttttttaagtctaacagtaattaataccacactagaaatgaataccggcttattcaaatttattatcatcggtatttgagggtaaatcattacaattatcatttacgttacatttcgtgaaccaaacggtacctaaagttttatattgaattttgtggccgccgtggctcgacaccaacgtcgacgtccgcctcattcctctcgtcaacaaagaggccgagagtaaggatgcaaatgggccggcagtggcggcccgcctcgcgtccgctccaactgcaattttaatgtgtcagcccacatcttgccgctctcaatttgtaggttggagcggcagactgcgaggtgccgcaacgcacatccgctactgtctgctctacgcctctaccctgccatggcagtgaatccatcccacgaaaaacaagcaactagaaccccattggttcatcgttttcaaccacaactgctgctgctcctagtagcaccagtccagtgctaacattcaacaatttgcgattttcatttaaaaaatatcagaacatccaacgacaatacattggctaaatcattgattcaacacaatggcttaaacaaacaacatatgcttccaaaatgtagctcccagatgaacctatgagtgacatatcaactgaatttattttatgcacctatgttcttaatcaagtactaacgaattgatgtacgtgatgatagaaaaatttaaacataacctaagatgctaggcaacccaccacaaacactagaaaccataggtgcacaagaatttgtgtcctcagcttgtagagaactccacagtttcagttagtgacaacaagagctgcagctcaagaaaacatgtgcacaaacaaggtagagactagttcgtgccatcgacagcatgcaagaaaacataatatagcagcaatgtaatc

SEQ ID NO: 1046 - DNA, 1103 bp, Zea mays
  misc_feature (1)..(100): optimal_loci_41303_G1, chr1:244762386..244763488, Cluster 6
aaaataccaaaataataaagatgacataatgatgaatgtcttattgatgagatttaacttttatataatgactctagtattattgatgcagccaacaaatttttaagagaattcgaatatccaactagccttgaagatccatgaaaatttgttaacttgtgcaggtacatgtcaaatccatcgtgtacacggcaactatcaggtggcaaatttagttgaaattcgtagattttattactaacgacaaatttaatattttaaaaaaatccatcgattttttgaacaaattattttattttaatgaacaaaaactctataattgatgtgttctctatctctctatatacccacatatagtagggaccaaggccgcatgtcccctcgtgcactcaacccgttggcgcgcgcggtattacgtacactgacctaccgacaaatgacgtcactctgcatacagtatttgtctatataccaaccatagaacgacaaacctaaagctgtcaaataatacagtcgattagttagttgcagctatatctatatatgtacaataaatcatcattacccaagctactttctgtttgatgtataataatcgccgatatcacacgaggagaagagaagtttgatggagatgacttcctggactcgcctggccggtgcgcccctagctacgtacgcactcgacgctccacggcatgtattctttgtcgcgcgcggcacgttatccgtcacgacaaactacgctacgtgtgcgtgtgctcgctgtggagccaagcgctgttccacgtcactgatcccggcttttgctaacaagatacatgtgtgtttttcttattattatcaaccacgtcatgcctgcatggatggatatatatgcatgggatgggaaccagctgatcggccatcatcagcgacacaacgtgatccgaggaggggttgcgcttgttggcagcatgtgagtgaagcactactgcctggcagtgagtgcgaggcgccgatcgagagtgaggtatctataaaagtggctaactgaaaaaaaatatacaagagacggacttttcatgaagagcccgtctcttgcactcaggaaagactcgttt

SEQ ID NO: 1047 - DNA, 1093 bp, Zea mays
  misc_feature (1)..(100): optimal_loci_42991_G1, chr1:253311578..253312670, Cluster 6
tggaggcatcactacaggaccactactctactttggcctctacgtctttgtctttgtggccttttgttgttcccaaagagatcactgttgtcaatggttcttgccacacaatcgatacacgttataggtccctgttgtgcctatgcatttgattatcgttcgtctttgcaatggttggtccaaccctaacattgtttggatcgtcctaggggattatttgttgcatcattcaacttttatggtggatgatttgctgccaatatcgctttattctctgtggatgctttgctatacagatcctgtccctatggtacattttttgattatggaaacaaagagttccggcttttgcatcaaatgcgtacaaccattacatgtcaattattatctcaatgaacatgtgcttgaataatgaaactaacttgatggaactaaatatcgtgactatggataacactagccacactcaagtcttgcatttgatcgccattcatgattcacaaagacttccattgccaccacttccaaggcttgacacacatcgagaatttgttgatgtgtttccttcttctgtagaagtctccagaacctaaaccaatgagtacctctgaaaatgacatgcacaatttatggtattggtttgtgattaaaagccacctcatttcgagtaagccaaatagaccaaaataaagccgacatggttgtttggggctccctccaatggatgtgttgccatcaatatttgtgcatgcccatgtcgtctcctttggatgaatgctttatggttatgtgttcagtttctctatagacaatcattgtgtcaatgccttcaattttcttatacttagtctttgtattccgtgccatagctaaggctcctctcccccctaatttttcttactgatctatgcatctagtggtgatactttgattacttttataacttaacttatagctaataaactaactctattattgagatccctccgacaatgactatatatatagcgtgtagtgtgtgcgcacgacagcgctctgaagtcacgcctcgacgtcggcctctgttcgtcgtgcacgcctcgatgctggccgc

SEQ ID NO: 1048 - DNA, 1346 bp, Zea mays
  misc_feature (1)..(100): optimal_loci_43736_G1, chr1:257328613..257329958, Cluster 6
acatgagttgtagtggtaaaagccaagtgctttataccaagagagtagggtttgaatcctctataccccttttttggatatttcgtgccagaggggaaatttattcgctcgttgcgctcgctggaggaggcgacacacaacgaaactcacgcttaaatatagtagagatgaaattgttaccgtgtctatatcttaaagctcaacatggtgacctataacattaagatttaactgctcaatgtcatatgttgtgacgctgaagagttactctgttagtgatgtagacatcatagtggcactaatgtggcaggacatcgacaccatagcttacgccgctgaggtctaaaataaataccacacctagttctgacaaaattaaagcgaacatcatctatttctcatctctctctaattctttcatccttatttaatcttttgattcgaccaacccacgtgtttcaaccagggcatccagatatagatgttcattgcttctacacatgtggttgttttaatgtaaataattatttgtaaatattctacttctttgttccttgatatatgttattaaattactgataagtcgttggcatcacttatttggaaccatgagaggtgacttttctttgagtggatcaatgattctaacaagtttgatcgaaggtatctccttttcaacatgtgaagatgtgatataagtctagtcgaattcagtcgtgcatctacgtcaacgaaaggcagccagtgagtgtgtacaggagactacaggctgcagccagagccagactgctgccttcctcacatcaatcatctcggcccccgtcatcacacgtacgtttcgaaaccgctcacgtatcgtatcgtctcgtgccgcggcgcggagcccatcgaacacacaagttgcaattatgggtacggcgttgatcaaatgggctttctgtgcgtattatattgtatatgcctgtgctgcgctacgtctacgtacgatccagcaggctgccccccgtcagtccgtgcgtgcatggatcacgtacggtgtctgcagggatcttcgtttaagcattcaatcggcctgtctatacacagctactgactactgtgcagcgcgcgttgccccaggctaaataagatatttattaaaaacgattatatttttttattttcaaattattagtatatgtatatatttacagtatctctactttatacaacataaatagatattagtatagtggtagaagccaagtgctttataccaagagagtagggtttgaatcctctatactcgttttttttggatatttcgtgagggaggggaaatatattcgcttgatgcgcttgctgga

SEQ ID NO: 1049 - DNA, 1054 bp, Zea mays
  misc_feature (1)..(100): optimal_loci_4420_G1, chr1:23051038..23052091, Cluster 6
taccaactccacgtccacttaagattcattagatttatagtccatagatagcttcagcaatgaaaaaataaatttagaaatgagatccaccatggtgtatagcttagtttattagtaagggcctacgatagagtttcgctttatttttctccaagctgcgagagctaattctccagtagaatgattccgaatgattttctagtagaagtgaatctttctgacaataatatttgacaacagtctgtgaagtgatttttgagggtttgaagagtgtgtgttgggggaggagggttggaagcgacagagagcatttttttagatcccacatcccactctatagtacaaagcaaaactagattcactccgctccatcgaaagccgcttatattaacaactatagatccatgtagagacaatttggttgaaattgcctaatttaatcttgtgttagactccatcccgcaagtgtctcttgttccttcttcgtatcatgtagcagccccaccgtgagtttaggattcataaatgttattagtggttgtgttgctgcagcaagctagcaacttagatggctaaggaacaacatacatgtttagttccaattattatctgtttttctatagaaaaactccagaatcgagcaatagccgccataaatccagcttcctccctccccccgttttttctcagcgcgactttggcagcgagcgtgagcttgaactgaaaaactacaattttaggccctgtttgggagagcttcacttcaaaaactttagctttcgttttccagtttcactataaaatagttccaacaaattgttaaggtgagttccaggagcgtttggtttatatatggactccaacttctatagtgcaattaatttgtgtgggtttccttgattacccttgataattagtgggttgtcgctagagagaacggaagttgtattatgtgtaaccagtggcatggtgggtaattttcgtacagtttcatgaggagatatataaacaatgttcttgaagcaccctctaaggagcttcatgaattttatga

SEQ ID NO: 1050 - DNA, 1095 bp, Zea mays
  misc_feature (1)..(100): optimal_loci_45222_G1, chr1:265525826..265526920, Cluster 6
ggtgccgccctgccgcgagacaagaggagggggaggctcggggtggcggggttgtggggaaggttatggatgatagatgatctaaataatattgtttattgactttgagtgagtaagagagagagagagagggggatggaggcggcggggtcacgaggacggtgagtgataatggatgattcaaataatattgtttattggatttaactgagtagcagagactaagttatccagtgacctaaatcattaatattgattgagtgttaagtctgagtgcggtttgtttggtggatttagtagaggttatatgtgtgggggtgattaggttaagtgtgttctacaaagtttaaaatgttggggttatagagtgacatataactacaaaactaaaattggatggtggttggtgcatgcaaccgtaacatctggcaccgacaagaaataatgcttaagatttgggaaactttcaacgcactacaactgttaagacggaaggtccaggatttgacattactaaacaacataaggtttagcttccaacgacaagaactaggcatcgcacagtttccacgaaggcagggaatcttcgtcggcatttggcaagatccacatgcatgtcgactacaacagaaagaaaggtccatatgcatccctagcttctcttctcgtcgtgctctgagatcgttagacgttagtagtaggcggttagctgcctacctcggggtcccgatgcatggacctttccttgaattttgcgaacgggaccacgccagctttagaatagatcgtggtggatttgattacgtttgacgctgggccagctagggtctcacaactcaacacgcaccggtcccccccaatagacactgcatggtagtactgtagtaggcaaggccacgctttcgcgagagaccttttgcaatggccattggctggctggagctggatggggggactcgggagccatccgatccgcgtccgacgagcagagcacctgcgaaccacaactagtgccgtacgtacagcgtgtctcgtcagtcagtggctcgcgtggccgccgggggcgcgcgaacccaccagcctgtatctgtatgc

SEQ ID NO: 1051 - DNA, 1364 bp, Zea mays
  misc_feature (1)..(100): optimal_loci_50493_G1, chr1:293390914..293392277, Cluster 6
tattttaaattttagaaaagactcaaaaaaaaacttcacaggctcttcgggagctagcggtagggaggctctctcgagccccctccgtcgccgaggatatctctagagatgtgcagcgtccacgaatggaacggttcgtacgtacagaggacaagactgaaggatcgtaaacatgacatcacacagtccacgagctagcatgcaacatgcatatgcagctagcggttacatgagaggccgtagatgcatgtccagagctcgatcatgcatggacactagtcgtacgtgcatggacacgagctagcatgcatggacacctcgcctttgccttgcacgtctccatcatgcatggacacctcgcctttgccttgcacgtctccatcatgcatgcatccaataaccgctcgatccatcccatcgaccgacgtccatgcatggacactagtccatattccatcccatagctttttcttgaccattttatggatgcataccgttaataactgagaggtatttccatctagctaggttagctacatgcatgatctctacctatggtcgacacataaactgtatcgtcgtccctagtaaactgtgattgttccagaaccaatgacatatatgtactagactaaaatctcctggtgtccttgttggtggggtgtggccggggggggggataaggtccgctttgcattgctgccggccgccgtccccgtctggtgtccctgcgatttgacggtggaatctctctgggtcgcggcgcgcacacatccatcatcacatgcagatgcaagcaataatggctgcactgcatctgtctcgacctgggcgtccaggaaaggagaggagttgaggcgtcaaggggaagcctctgtcctgtcctggatgggcgctgcctttctttcacaccagattcggatcgtgccctgtctacagccctgccggcctcgatccccgcgcagcagagacgaggaaccgtgtggacctccacctctacggaacgagtactacccctccggtattaaaataataattattttgaacatgaatacacataccaagaagtgtttaattagaagtcatatttccaatcgtattcatactaaataccttaattctctttagggttccaactggtcagcaactctgctctctatcatgcctacccgagttcgattcttgtggccttagccgcagaatctttactccgagctcgcggcagagtaggagtgagctcgacatagtatatgaacagacacatacgaggtgagaggagtactagcctacatgcagctatgcaagaagagggtgtgtatgccgtgctggattgatgtagcctcgtgacgcgcctttagtttcga

SEQ ID NO: 1052 - DNA, 1339 bp, Zea mays
  misc_feature (1)..(100): optimal_loci_52050_G1, chr2:1649213..1650551, Cluster 6
gtcgggttggtttgacatgtgcgacaaccttggcctggtagcggatgcgaggagggtgttcgacgaaatggctaccacaagcgtggtgctggggaataccatggtggcgtgctacgtcaggtcaggggatatgtaagctagctgctcggatgtgtttcacatgatggcgaaagggacccaatctcttggaacacactgatgatggggtacttgcggcatggggaagcatgtatggcaagggagtcgtttgaagagatgccggagagggatgccgaatgccaatagctagagaatggtgattgttgcatgctcgcagcgttcaatcggatgcgcctcgcaaggttccaacctgatcccgcgatgatggatgtgctgatgtccgcggtccgcctgtgcacaactttgttctttgtccgttccaagacaggtgcatgggattttgagcaaaaactgtgtcaaaatgaattttcatgtgccgaattcattgatcgacattctttactagttttcgaaataaagttgcattgcagaaaatattttatcatttgactgatcagatcagcagagaggcttcttgtttttccactaaaacattgcatagagattgatagagtgtcagatattcataacctgtttgtgtttcatatattttgtgatacaagcatccattcacctcgagaggtggacggttagatcttgaatctctagtggagttgacatttagagtcgtcgatctcaaaggcagaattattgcaaatgaattcagtgctttagatttcttgatttaatcttggcacaactatggtaacctaaaattgaaggaaaatttggtacaagaaacatggttatttcttgaattcggtctctgatacatgcattcatacttcagatttttttgtactactttttttttttccttctatatcttttgtttgcagtattgcatttgtgacatctaactagtggaatattgttttgtgtttctgtaagcagatgctaagcaacagaactttacatagtagcaatagcatggtcaggacatcatggttttctctaaagtgctcagacattttaaacatgtagaaattacatggagaggtctgtctttccaactactccattgttagtatgattcaaggccattctttttggtagagagagcgagcactgcaagtccaagttcggtatcaggtctacctctacctcctccgtcagatgatctgcgtcaatgacaattggcatgggctggcaatctgcaggcttttccatgacctgatggcagtggtgaccggtgctgtctggacctttggtgtcagtggccgctaggctttcatctaga

SEQ ID NO: 1053 - DNA, 1297 bp, Zea mays
  misc_feature (1)..(100): optimal_loci_52292_G1, chr2:3003412..3004708, Cluster 6
cgacaggtcttggagtctagccctgcagggtctgtctcagctgtcaataaaacaccccttggccatttcttctatgaccgtttagaccttattcggttacaagagaataaatgccatcatagatttaatttggatctggattggatgaatccatatgtcacactcaattcaggtcttgttcggttataaaaaaataaataccaccatggatttaatttaggtctggattgtgtaaatccatatgtcacacataatttcatggtaggattaaatccaccatttaatccatgtatctctcaatgcaagctatttttttgatccatagattctaatataaacttgtgtaatatctttatggatttgttctatacctaatgagctatggatagaatccatgccttccatagttttaaaaattctcaaatccttgggttataatccatgatgagtttaaccgaattaaaaaattaagtagacttagattattttggggtatggattgtggcgtgaatttaattccaatctatgctaatctagagctggattggtgtaaacgaataaggtctcaattgacgtacccacccatatgcgttgtcgcacaacaacgtaataaagcttcaacaaccaatcactagatcttgctgaaaatcaagccagttaattaccgccggaaaagagactctttggaggctagcggagacatcacgcgcctacaagtgggcaacaaaccaggtggactttgagtccctcctgactccattcgtccccgcgacagattcatgcaccagccgtcggaggccactcggagaaaaataacatatcacccccatgccggctgatggcaacaagacacgtggaagcgtatttctaataaaattggttagcaagccaaaatcatggtaaaattgacaaagttaaaacatgatgctcgtgtcctgttgggctggtgtggccccattccatgagaacacttcaaatgtgcaaggaaaaaaactcaacatgcaaacaaacaatataagcttctagaatcttttatacaagccatggaaatatacaataatcaagataacttctagaaagttttataacaaccatggcaagttatgaaatgttagatatttgtttccatgccaaaccttgtgttttcatgacaaactttagaatcatctagatacatatatttatagtgaagtttgtagagtatgatatgtgcactcacccatagacaatggatgtgtatatataaagagtgtatataaagagggtgtcacctcttattggcattatataacatacc

SEQ ID NO: 1054 - DNA, 1091 bp, Zea mays
  misc_feature (1)..(100): optimal_loci_5240_G1, chr1:26909690..26910780, Cluster 6
aatgtatatatgtattgaaggcgttcattaatttcattggtgattttacttaacaaaaatgtcgttgcatatgcacaagctcgagaaaccagtacaaatgctgtctagtctgcatgcaagataaaagtgctagattctgtccccggcatttttgaattatgcgcggggcagttcgtattttcgtgcaggaggggagaaaacgacacatcgtggagttgcatcggatctatcaccaacaacggtgacaggaaccgcagtgtatgtagcactagcagcagcagaaacaggagcagcaacatcaaaaacgatagcattgcacatttaaagccctaggccaggatactgaaatactaaacgcagagacagggtattatttggccacttgctaaacgcagacagggtatttggccagctacggagctactcgttcgtcgcatgcatgctgccatggttggtaaacgttcatttactccagagccgatcatttccatcacacatgtatatgtacagttaaataaatgacggactattaccagactatatactagtccacctgataaagtaacagctcttctgtgtttttacgagaaaggcgttattcacattgctagcactcagttggttgtttttccattagttcttatcgttatctctttatgtgcgcgcgctcacgtggacgtgggcgtgtgttgtaatagtactgcagcttccttccttaatacctatgctgttgtttggttcaccaaatataactaaatagtaacattaatgattcactcgattacaagcggtaacgagtttgaatagaccggtatcaaattctagtgcggtatctgattacaattagacgcaaacaaatatgatttaatattatcaggtacccattatattataaatatgtgaaccaaacaacatctaggatgtgaggacatgcatttcatgcatgcatttctcctgcaatttttagaataagtaaaacaacagtttttcagctagagctgatagtggaccgcaaacactgataacagtacagaaacgatatcagtggcgatgattctttactggccacgttcctgaacaaggtaaacata

SEQ ID NO: 1055 - DNA, 1386 bp, Zea mays
  misc_feature (1)..(100): optimal_loci_5267_G1, chr1:27073647..27075032, Cluster 6
aactaccacaagaacgtgttgcccttcagtcatcagtagtcaagtatattactcagctgatttttatagctcattatctttgattaaataggtgtgatggatctgtattgccagagggtttaaggaattttcactgtatgggttatcgatgccttttttaaaactcgctagaacattgacatatcgtgtaaggctcgtatatgggcaactacactttaccatgtgctcaagcgcagctgagactgcctgagaattcatagaactcgtctactatggcacacgcaccctatacacacccacaccaacagtccctttgggaaattccccggtgcgatacccaccgttcgcctggactgggaatcgaacgtgggtggcaatcctggccactgccagcggtaaatcagtttctggcatcagatgaaaacaagttggtgataagtagatgcctttccttgctaactattttctattgtccttgaattcattaagttgtttattatgttcttgttgtttttagtctggctgttaaatttaggaagaacttcatgatcacatggtttttcatcaccaattataccatcgtgttgttgttcttatactttggaatttaaaggcttaaaattcttattctctacagcatgacattgcgatacaggattctagtcattggttttgcaactagttgctgtgtaggttcttgacaacaattcaattgttacaacttcagaagtcaactaggttctgaacagatattatcctgtttatatgctttattggttcgtatacatgatgtcagttccttctaacttttcaggttagtaggactaagctatggctttatgtggcacatattttcaagcagtccaaacaaggttatcgtggagcctaaaggtatgctctttggcttatgattttcttctcgtatggacaatacagttgctaaattttaattcatcattagttttgcaatgtgctgttatttccagtagaatttttagatgttcaataattttttactttagttttctcattgtcacagttgtactgtataacattataaattttggcatgttccccactcctgtcaaaactgtaaactgacactaggatgtaaatatgttttgatgtcaattggaaggtttcagcatgcctcttcattgtatatatattgaatgattagaagagcatgtatgtaggacagcgtgtttacgactacctcaacaatgtgttgcccttcagtcatcagtagtctaagtatattgctgagctgatttttattgattgttatctttgcttaaataggtgtgatggacttgtatggccaagagggtttaaggaattttcactgtttgggttatcaatgcctttcttaactcgccagaagca

SEQ ID NO: 1056 - DNA, 1112 bp, Zea mays
  misc_feature (1)..(100): optimal_loci_53539_G1, chr2:9432896..9434007, Cluster 6
cggcaggcgccacgcgaacgggatgggacgagacgagacatggcatctcgcagcctggcactggcagtccccttccccttgtcagatgccatgccatcgccagactgccagttccattagccgccgcgcgcaagctacccgatggctggctctggctggctcatcgatgaatcctcgggcaaagatgagggtcgtccacttccgtagtggcagcgtagcggtagtatactttgaggcggtgcactggcctggtgcgtggtggccgctgcaactggagacctgcgggcagtccagcccacaggcgttagcggcgccatgccttggcgacgtacggatgtgatcacgagacggggccccgtacgcaggccaggctcaaccacccagcttttcgacaggtgactccaaagtagtagtgtatatataactgaaccactccgctatccccaacaacgccgtcgacgcgtgaataccagcggcagcggcgagagacagcggcgccggagacgccaatgcacgtatgagtcagactccagttaggcggattctccattccctaactactttttctttaaaagtgaaaatttcttatgaaaaatagggttcctaaactgaccctaaaaatgccaaaatcgacatcatgtgagtggctaagattgcagtacatctcgtgcttagagatcgaactcaataattaaagacctataactcgacaattaaggacttgttctgtacatctcgtccttggagatcgaactcgacaattaaggacctgtaactcgacaattaaggacttgttctgtacatctagtccttggagatcgaactcgacaattaaggacatgtaactcgacaattaaggacttgttcgttagagtctgaattcggaaaaagagaaatagagcgtcaactgaacatatagtggtatttttttgacaaagaggaacaccccctgtttcattacgaaatagacagaaacatagttcatacatgaccacagaggccactagaaaagaaaagccgacaaaacacacgcaactatcagccgaagaaaacatgacacggggaaagccttccaccgaagagccacagaccatctaacagaactgaccaaa

SEQ ID NO: 1057 - DNA, 1192 bp, Zea mays
  misc_feature (1)..(100): optimal_loci_53958_G1, chr2:11582056..11583247, Cluster 6
cgacatcagcgggattgcaatgacacccgggcgcgctatccgatacaaggcaattgttacctggcttttgtttgtttacagcgcgaaggagatccaagcgaggcagccagtccgaaaacgccggtggtgcaatcatttgtttgttttcagctaacatgctgatcaaactacagcctagcctgccagaggagcgtattaattgcatgcccagctagttgctgctcactttggacgtacaagtctgaccaattcgtgtggatgcttgtgcgcgtgcatggtaattaagatatgtaattagctttagctagcttgcatgcgcgagcaggaatatattggatgtatgcctcagctggcaagtcgaacgactatactatactgctgccatttccaaatacattggatgtatgcgctgacgacgaacgtgtgggtggatgtgtggattcggatcgtttgtcctcagctgccatggtggctaagacaaggtcctctcgctgtttcgcagccaggatgcatgaagcagccgaggttacgtttctgatccaccaaaatttgaatcgatcttgcacccgcaccacgcacgtgcgtgagagagatatttgtatgctcgcagccgccgaccacgacgggacgtacgtgcatgaaccacatcgtccccggcctggctcaagatggatcatacatgcgtccagatatatagatgaataaactgcagtccgaactcacgtacgtacttgagaaagtgacacgcgacaggtcaagtgaaccagcgacgtatgaccccgcacatcccctggctcaaggcacgccccctcgatccgcctcttctgatgcacgcacacactgcagacaaaactactactcttattagtagtattattagtacgacgactcataactacctaaaaaaactaacaccggctactggaatcttcgtaaggtgagcaaataaaacgtgcgtgtgtaccgcctctttcttatgttagtagcgtcctatctagcataattatatatacgtacactattttctttatttgcaaggcacgatgcaacttgaatagggaacgagcaacttgaatcgtgcacgcacgtgagagttgacctgagatatatattttcaggaacctaacggctaacgcttaagatcagtttttatcacagaaattcctatcacgaagttaccaaaattgtcacg

SEQ ID NO: 1058 - DNA, 1158 bp, Zea mays
  misc_feature (1)..(100): optimal_loci_54212_G1, chr2:13098290..13099447, Cluster 6
ttggcggtgtccgattcttcagcagttctgcaggtctgtaggttggaaaaattcaaacatgcaaaaaagccaagaaaaattcaaacatgcaaaaaagccaagtttagcgtttcctttagatagtttgttggaacccatgctttgtagatagcttcctttagctaagtgtgctctgtaaacttgagatttagctaggatttttatataagctcttggagatgctctaagtgtgtttttttatctcaactagtgactcatcatctttactctttttaaaaacgctagttttgtgcctacgtataagacgttatatcatagttgggccgtgacgtaagaaactatccaaactcaatatgagcggagtgcagcgcttctatatagtatcgcctttctcgctatctgaagaaggacaagccaccgagtgagttatacaaaaatatcgagctccttctcatgcatgcacgtatagactcgatcgagattgtcatcgtttcatgtgataatgcacagacattataccctgttgattccacgaggaacccgcacggaccggatgttgctcgtaacacgcacgtacgtacgtgagcatgtagatcatcagtctccatgcgcgtatggtctgtctcggcgctcaaacagccggccggtgcgcatgccgttatggcggaggaacgaacggccggcactagttgccgccgagtgcgcacgccgatgccgacgcccatctcgacatccttgcacgcgcgcgcgacgacgacgaccctgcaggtttccttgcacgcgtgcggtcccggtaccggacacatgcctcgtcgtctgccgcgcgctgaaaccggccgtgaagagatcagtcgcaatcaagcaccacgtacatagctagtaatgaattgatacttttggacgtggctgacattattgacgagaaaataactaaggccccgtttcgtttagttggagtgactaaagtttagttatttttagcctctaaaaaaataaatatggtgactaaagtgtcgtgactaaactttaattttgtagtcatcaataggctgacaaaaagggagtaaagtatgatttttaacttatttgtcctctctagctagttttcttcttgcaacaaaacacctactaattcatagcagcaatatagttaatatt

SEQ ID NO: 1059 - DNA, 1335 bp, Zea mays
  misc_feature (1)..(100): optimal_loci_54590_G1, chr2:15019104..15020438, Cluster 6
catcaataatgctgtagtagtatgtgtttccatgcatgcctcgaacatgtatcatggcgctattattgatggatatatggaaatcatcgacgatttcgtttttatattttttatacatttcattgaactggaaatctttgacgatatgtagtattggaagtacaacgggtgtccaataatcacacatttcataagctagctataggagaagccttagcttgtagctatacataagaaagttgaagcaaaggtgaaaacaaacatgattcctgtcgaactatcttacttacgtataaagcaaagcgatattaaaaaaaaacaccgtaccccaacaaacggctgatatatatgtgttttaaaaatgctagtaaatgacagcctgcaagctaaggtacgaactatgcctgcacgattataactgtcaatagtggatttaattctatgcatgtatgaagtggtaactatatcctcccctgcatgattgaccaaccaatataattaaagcacaagttcctttttttttccagttccaacagcatttgttgaggccatatctctaatgagcacctgagaaactactgtactagctggtggaatatcggcagcaaaaaggagatattactaatggcgagtgcagctagctagctagctgccactagctagctagcatgatatgaagaaccctacaagtacgggagttgggggcagaaattgctgcgcggcatgtcctggacgcagcacatgtgattatcgtcgtctctgcacactgcactgcacgcccatgagagcgatcgatgtgtggtcgaaagaaacggccctctcccagtctcccccttggctgatctcttggttctaagcgtcgctacgagctgagcgtgtacagagagagggccgggcaagcctcgcggttggcgtgctagctttgatcccccatatcatgacaaggacgagctcacatgagcccaaccagctgattcatgcgggccccaccctactcccgccatcatcctctcctcactcaccacccgcccggcccggcctcctccctgcaaagctacactacacagcgcgcggctgctgcaccacagcctactttcccccggccggcctgctgcctaattacctgctcatcaactaccggagccattcacattcaatatgtactttctttcttcctttttttttaccgcgtggtcagcagacgacgcaaattcccaccccccgaaattcaaagggacagacatcagcgcattggcttttttttggctatatatggacatgcatgtgctatgtgtgtgtttagcggtataagtttatgcacatcatcatttcttg

SEQ ID NO: 1060 - DNA, 1232 bp, Zea mays
  misc_feature (1)..(100): optimal_loci_54788_G1, chr2:16222633..16223864, Cluster 6
gtcttgtatcttttcattgcttgcaccacatataaatataccaaattactcctatcatttcgtagccctcttcctctttttaatcttttctgtccataagaaaaacataaatagataaaatgtaccagctttattttttatgttaaacataaaaatagtcacatattttttatgaaagaagaagttgataataataataatttagtgatgaacaaattgattccgataataataatacaagaaacaacaacatgttctttgaattgcttgataataagtgctatttcctaaacactatcttcacatagtgctgttttgtgtattctctctacggggtacgagttattgagggagatgctttcgattcaagcagtagctgttgacgagccttgccctcctgactcctggaacgggtcaacgtgttggaatcctggaacataagtggctaatgctgcaggcggccctaacaaagcgttgcatgtgcgagactgggaccccggactcctgtcagcgtttcaacacgttgaaaaacgatgggaccccaaactcagagaacagaagctagcaaggagccaaggacaagtggaatcagaagcaactggtgccggtcgcatggagatggaaccctggcaggacatttttttacacaagctggtactgcaggtctgcaactcgaccccgaggtcctttgcagctcgcctcgcacgcgactcgaacgaaacatttgttgaaggcacgtgaccgtcatgaacatgactgtgaccgtcttgaacttaagatgcggtgcgttctatgaatttggtagaacaaagtcatttatcatactattattaattattgatctataaaaaataaaataaggatgaatcaacttatttaatttcacgaaccaaataaaaaaaatgatgaacgagaagatgattgagtagctcattcctcgaaccaaacacacatttatattcagattctgttgttaaacgatgtgccaccgacgttaactgaacacagtcttaactaatcacgaggcctaaacgttccctacagccgaccagtttttatcctgcaagtccgcagtactgcaaccgcaactcgtctcgtgatggatcctggattcgttggggctatcgtgtgttgaccctgatgaatcgcgctgcatttcacgttcagcagcttgacaatgatggggggctagaaagggagcgtttgagcgtcgcagcacaggcgaaacacag

SEQ ID NO: 1061 - DNA, 1067 bp, Zea mays
  misc_feature (1)..(100): optimal_loci_55485_G1, chr2:19986409..19987475, Cluster 6
ccttaacaattataccatcagtatctatatatacatatagccaacgtataatacaaccttatattatatatgctgctccaagtgtgttaaaattaataatcatgcacttttaacggccagcttgacttcaaagagtgatcaagaaaggtattgttgcttgacagaagtgcttggtcctacactcctaccgggaacaaacagctacggagaaaaacattcatcagaggacgagctggcgaaagaaacctagctaccaacaaaggccacactgtctggtcttttttgctacatgacacctaaaaagggccagacgtagtacaggggtgcaccgtgcacggtagggacagtgctactgctaccattgtgagcgagcactacagcttgttttggtcctggccacaggctgctgcctgcattaacccccggccctaatcctcgctcattccttttcaaaataaagcaccttagctagactatactgttcatgcgagagcagatgcgaatcttctaggattgggatcaacaagaggcatgcagtgcagtgcagggaccaaaacagatcaaattaagaccatctccaaccattcccccacaattctccccctatatatactttctattatattttactacatcgtcccaaaagatattccctccacatccaggacgtctctaaccgtgccattcacactatccagctcccctatatactataatccagttatttgacttttttcatcagtttttaaagttcaaaaaccatagactattcgtattgtcataccacacattgtttttaggttatgataatttaaagaggttaatatcacaaagaaattgagtgcttaaagtgtaggagattggaactcgccccatatggggggagtttcttctctcccactatgtgggttgtgggggtggggtgttggaacctcgaggggtttgacaccctaaatgccaccgggtatggggtggggagcccttggagatggttgttctacttctatacaagctagttgtttgttgtcaaagtactacaatacgtaatcatcaaattacatacgaag

SEQ ID NO: 1062 - DNA, 1030 bp, Zea mays
  misc_feature (1)..(100): optimal_loci_56197_G1, chr2:23764760..23765789, Cluster 6
ttccgcgatgcaagcacgcgcaggtgcaggcaaccaaacacaccctaagtgacgatggcggtggaagtgaaaataaacaggtcggcggacgagtggcggccggggactgggggaggccctcgagggcaaccgcagggcgctcgaggtcgagggcctccacgcaggatttacagtttcggagagaaaaaatttcggaccccaacgaaaaggaaatttccgaaatcttaaatagatttaagttttttaaaaatgatacattttatattaaaaaaaggccaatttcgtaaacatatattttttggacccaccaaaatcaagaaaattccagagatttccgtccgagattgtaaaccccagcctattgatcaaacgtgattctgcgctgcctactacgatcgccaggtccgtccacgaccgccgactgcggatcgtcaggtcagtatgcagctcaacgtgattcaactcgcatccaacggcaggtcgggatcgtcgagcgcggatcgtcaggtatgcctgctctgctgtcatggtttgcgttgtttttcccatgtcaatcggtcacggcctcatagcggatcatggactgcattgttttgaactagtagctggtgcgcgcccttgggcgcgctttatcacggatataagctagattataagtgttgttattatagagaaaaaaatatgtatagaaattggtcccaactttaatatatagaaattggtgcacgtgctcattaaagcaagggtacatgtttctgttatggctggatgaaacattgtccaacagttgcgtactgcttcaaaattttcttttctcggccagggatgatgcaaatagattgggaataggcttatacattaatttgggtgtggttcgtcagtgaactgtcctctcctccctttatactttgcatctgattagaatggtttgaaccgcacttgtttcctgattagaatactttgcatctgattgcacgtgattttgggtttgagggatgaagatgagagaaagaaaaagagggatgtgcat

SEQ ID NO: 1063 - DNA, 1218 bp, Zea mays
  misc_feature (1)..(100): optimal_loci_5985_G1, chr1:30294178..30295395, Cluster 6
cgccgactaccccagcccagagacggcagagagactggagtataatagactgtttctgagggggaaaaaggaagcactgataatttgttgcgcgagtttaattgggtggtgccagatgccatgccagggcgatcgccgacatgcaccaacgttgcggctgttgtgacatgatcgcccatttccttttttagcaaatggactgactacaagaacagaggagtactaccctaaactcctttgcatgcttggtttccaagccaaacaacctgcgcgacgggcggcagggcagagcagcacgagcacgaccgaccatgtattttattcaccaacctatgccagatactgctctcaattctcaacagagcctggtcgctttctcggcaaccaattaacctgcctcagagaacctgcacgttgcagagtgcaggccaactagtaaattgtagtatcttcttaaatccaaatggacaatccaaggttgcttctactcgactgtcctgtctacctgggaattttatattttttgtatttcattaaacaaaactaattatatgtcgatattaaatgtttcaacatctcctagggtagttagagaaagtctggaaactaaaattcccttggagattgggatggagcaaatagagtttacatgggttaattaagatccaacagaccggatcttatcttgttcaagtgctacgaatatacacacgagacggacatcagtgtatcagtagttcagtacacattcttcgtaaacagcctactgtggtaacggactccggcgttctatcgagcgcaacagaaaccaacgggcgctacagagccttcacgggccctctatctatactatacctcgccggccgctcacgggacagcttccggccaacgaccgctccacgtatggccacgtacaggcaccgaaacaaaactgcacgcctgccccaccgctggtcgatatccaccatcatttgccctcacaaattccgtccgtgcttttctgtttacatgtcgattacgcgtatctcatgcgtcccacagtactgttctataggggtagatgcgctgctgtttaaacgtcgcttagcaattagcatacgccctgcgtgattgcgagagtactaaattattgccgaattgtgactcgtacatgcgaaattgtcctgttcattcgtcccaattaggatagtataataaacttaggcactgtttggttta

SEQ ID NO: 1064 - DNA, 1112 bp, Zea mays
  misc_feature (1)..(100): optimal_loci_59894_G1, chr2:45763739..45764850, Cluster 6
cgaaaaacctaaaacgtgagcacgtgtgacagcctccataactctttatttgtctcgttgtctcatgtgaagagtagtgaacacctccacatataatttggttttctcctacttagatgagtaatatgggactaaagctctcataccatctctatacaccaccttagctttcttatttgaattggaccacacacaagtgggctaaatttcaacaccttctaaccttttgttatagcctcaaaagaccttttgatcacataaacgaacgatgtgtgatgattgatgctcggagagatgggtggttgggcgcgtgagttgcaaatattctgttgggcgaggacgcggggtcgtattagtgaccatcggtccatgtgtgtatttgtctgatttttttatatgtcctacttttgttaaatttttacgtttatatctcaaattttgatctctagtgcaactacaaatggttgtcgccactgggatcggtgctatgacttaggctatcaccaacagttgcgtcatacgcatacggaagttgcactagccagacacggatgcgcgacggaaaaatagcgtgcacgtccagtagcacacatgaacatgcaaacccactgaggagaatcgaatttttttttgcaatcgagcggttgagcgctcattttacatgaccagtgaattattgaatgtggacgcgcaaggtgctacgcgcggccgggaataacctgtttccagcggactatggatgcacatgcggaaaataggcagcctgacatcacaaccgcatcaggatagagagaggggagagggtatttagattgtcttcagccgacagtgtaaacttcatcggtccgtgtaaaatagagggtttgcatggtagattatactgtttttagagtgaaactttagatttagggtatgtgaggaggcaaagccttttttcacatccacaccctcatggagagatggtatgtttggattgcttctctcaaaccaaaaataggtcgttaccgttggcaacttacatgtttggatgcaggctaattattggccggccaaagacatgcctagctcactagctatttttcctgcgaaagttggccaatctgtgggcagcc

SEQ ID NO: 1065 - DNA, 1214 bp, Zea mays
  misc_feature (1)..(100): optimal_loci_64459_G1, chr2:71895233..71896446, Cluster 6
tataatgcaaaatcgcacagtaatggtttttgtactttagcttatctgatttgagctattatgtgctttgattctgtagaaaggtgatgtggctccttagcaagaattcaaatgaaaaccaagtaaacagtataagatattttacctacaaggccttgtgctcggcaataatcaggtcatcccagattcccagtgtgtgcatcaacatacacattgcaatatacaacccaatgtacagcataagaagcttgttctccctttcttcagtggcatgaaacatcataagcacctgaaatgcccttgaaatagccaagtagactataagatgaccttcaaaaaaaatagactatacaatgttttcagatgtgatctgaaatatatagatgaaacaaggccaaaggattaagaaaattgaaactagtacatccccagttgaactaattaagtgtactaatttactttttttttcgtgtgcgcattttatctctagttcaagctgtttaccttctccccagttgaactaattaagtgtactaatttaccatggattaagaaaattgaaattaatacatcccataatgcaaattgcaaattgtaatccgtcccctaagaatcagttcacacctcaaaaataacggaggggggtaaaagaaatcgacttgccctccgttttatttgatcaaatacactgaatttgacagcccatgtattgccaaagagaacctggtcacgaactccagattatctaaggccagtcagctttccctccatagcctggctagtggttagcaactatgccattcctgaaacaaaactttgacctcactcttgttgaaagcaaaaacggctactaatttcgcacgtataaccatgaatgccgaaagaaagaataagaatccgcttcatccaagacagataaagaggcgcgttgagccacaagcctgcagcgacctgtcaaatccgctgcgttttggagttatataatgaacatgttgctgaacaagcaaacggaggaggctgataagctcgtcctgagaggcggcgggtgacccgtggccaccagaacagagcgtggttgcttcacctagcagctttgactgcagtcgcgaggatgcgacccacgcttggaacggtggccggtaggtatgggaggcacccaaggttattcatcccatttctaacctaattctgcctgtttctcgaaaatggaaaat

SEQ ID NO: 1066 - DNA, 1155 bp, Zea mays
  misc_feature (1)..(100): optimal_loci_64601_G1, chr2:72464408..72465562, Cluster 6
tcctccacacagcctcgtcgtcgtcgaagccgacaccagaaaggaggtgttgcacgcgatgggaagcttttgagctagcgcgggagcgaacgagaggcagcggcacgggagggaacagtggatagcgagcggtcgcctgtgcgccacatttaccgaatgaaacgtgtccaccaaaatttagcgtctcctttacaggacattgttggacgcgttgggtagaacttcatcccttagttttatcgtaagcgtccgttaccggagacaatttaaatcaagattttgaaaggcagccataatggccacatctgggaatcgatttaaaaaacaaaaatatgagcccaaagacaagcctgttctagagcccaccgccaagctcttccaggagcccacaattgagcccattcaaagtgcgccccatcgcttggcctactctagacgcactgccagcatcgagcccacttcatatgtatggtcgttagctgtcttgggtgtatagatgatatcgtttggagagtaaaatttgacatttggaaggagatagaggatatgataggagagttgttgaacagtgagcctactcaccgctgtggacaccacctagctagatccaactacaatggagctctactcatctctgcattggatctactataaggagtgagagggtgaggcgatctccatgtccatagcgccattggtagggccggtcttgggggtgggcagggtgtgcggccgcccagggcccccagaaggtatgggccccctaaatataagtataagatatgatatgtgctatgaatatttagtaattggtcttgattgatacactattcgttagtcctttcgctagctatagcttgttaggaatctgagaaatctgagaaatgaatcgatgagcctactacaatcacaaagaaaaaaaatcctcacataagatgattatagtcgtagtgtataggtactagttcttatattatatgttatatttgtgtattttttcaatctcacaaactaataattgatcattaatatattatatataggattaagtcaaaaatatttatcaaaactcttattttattttggcaccaagcgagtaaaatattaagataagagattttcgaatggagtattgcctgctacatgattttgaag

SEQ ID NO: 1067 - DNA, 1087 bp, Zea mays
  misc_feature (1)..(100): optimal_loci_75292_G1, chr2:143039352..143040438, Cluster 6
gccttaaggattagtagagatatatattgttttgtttggacattagattgtatcttgtgcaccaaaagcaacagattcttgctgatgagatgtccccgtcccgttcgtccccatgcagaaaagcaaatataaaaacacatcaaagagatcgacgtcattatcagcgtggaaagaaatactagaaaatgcaatcatctccggctgctcgctgcccatatcgaagcagcagcagcagcaaccagcgctgaaagaaatggccatcgctcgtcagttacgtgtcacttgtcacggcactaaatgggacgttgccaaacgaaaaaggccgcgtgcgtgcttcgaatccaagccaactacggcgtcgccagcgccacttgcaatagcgtatgcattgctggtggtcgtctgaaagcctcacaaacttttgtttacttgttgtcaggttaagggatatgcaatagcgtatccttttccagttttgatttgaatcgaacagcccctctattgctcatattattattatatatatatatatatatattaatctagtcacaatcagaaacaaagggaggggtacacatgagcatcacaagtgggctctagaacaatagcttgaggctgaacttgagtaacaatattattatagtacaggtagatgaaaatgatagaatggttcccttcctaaaagaacgctcggaggcgatgtgcaaccgatcgctcgttacgcacacgcaccttcctgtgtctgtgagtgatcggcccacgaacatactagctaccctgttgggtttgagttagattgaggggattaaggtcctgtttgggaaggtttcactttaaaaattgcagtttcggtttttcagcttcaccattaaataacttcaacagattaaaggcttgcacatagactataacttttgtaataaatccaattaatttttgaagcaccatttgaggagcttcgaaaatttcatgaaactgttctctagtttcagttttttaatgtagagctcgtggagctagacctgtttgatagaagaagctgaaatagacttgaaattcttgaaatagagctcttccaaacagtacc

SEQ ID NO: 1068 - DNA, 1129 bp, Zea mays
  misc_feature (1)..(100): optimal_loci_7567_G1, chr1:39752080..39753208, Cluster 6
cataatacagtgcactggatccagtggtttggttttcgttatgacttattatagtagttgctccagaacagaagcaatggtcctgcggcgtccttactgctttggtgaggctccgtgtcttccgaaagcctactccactaatattgttggttccaggatcgagtgcttcattgcgcagttgtcttgtctccaaacaatgctgcaggattgaacaataatcagaggttaaagaatgcttggacacaagtgttgctgcggtggagcaaaaggggaccggatgattttgcagaagcgatggtatctttattcccctcggcagtctggcaccagccttcagttgtgcacgattggtgccttgcctttgcccccatgtgagcgcatcatggccgcttgtattgaaaaagaagcgggatagccattcgtgtcgggtcaacacttgtctccagcggcagtttaatcatttgtgagaacgaaactgaatacgacgaacccggtgtcccgttctcgtgtgtagattctgatgacgatagttgcagcgttttgactgatgagtgcgagccacgcctgcatgcatgatgcatgaatagcattttgctactacttggaatctacctgtccgagaccatctgtccaaaattcggaagcacgggcgatgagaaggtgtgaatgtctcacgtttcacgtcagaactctcaagtggcccacatgtttgtgccgtaccaggctttaagctgccttcagcctacaggtctggtggttcattattcgttaggttaaataatagatgcaatcattaatatgcaggcatcagtcagtaattttataacaataatcgtttagtaataaatgtcgtcaataatattgtagtcattagtcaatatttttacagcagtaatcgtttagtaatattgtagtcatcagtaattttactgcagtcatcgctcagtaattttactgcagtcatcagtcagtaatagatgcggtcattagtaagtaattttacaccagtaattacaccagtaatcgcttattaatagatgcagtcaataatattgcaatcatcagtcaataatattatagtcatcagttagtaataataattttagcagtgaagaaatgtttggttatt

SEQ ID NO: 1069 - DNA, 1006 bp, Zea mays
  misc_feature (1)..(100): optimal_loci_78754_G1, chr2:163822722..163823727, Cluster 6
tgttccaaaatagaattaatcgattagcctgtgaatatagtttatatgtgtatctatattaattatcattcgtttgaatgtggatgaaaaaaaaaactagaaagaagtatattttaagatagatagagtattatatttcgcagtgaatagagaaacaaacaaaaaggaatgaaaaaagaaagggcaacggacaaactgtgtttctcttttacggaacctaaagggaagcggattgagatgtgcaaactccgcgcggctgacggtttcggttggttcgtttcgttcaccagccagccagccacagttttttatttttcttccaaaacgtggcagaagcgaaatgggacgaaagaaatatatttatatatagtacagtactagtagatactagatgcaaacgacaaagaacactgtgacgacgaacgaacctccgatctttatttttcaacgagagagacgattagttgcggcgtgccacatctgggttgttaacgacgggcgcctgatgacatcatccaccactgaaactgaaaggtgtgtgaagccagcactaatgaaaaaggatgatggtgcgttgcgttgcgtgtaacaagagaatgacggacggcgcggtgacaactacctggcgtggcggctggcgggtagtgcaaccaactgtggccgttgagtcgtctgccacacagggactgggagtctgggacggggacacgtctgcatgcgcaacgctggccgctccgaaatcatgagcggagcacgcatgcatgcacctcacctgagtccaacgatcactggctgtaggtaggacatggtattcgaaccggttacatcaccggatttctaattgatactgaacgactaagatcctgtttggatcgtcctgtctaactgtatgtcagtgactaataattagccgataaataattagctagcaacagttagtcaggatatgtttggagtcttgactaatagatgtctttttttttctttatacaatctattagcacat

SEQ ID NO: 1070 - DNA, 1036 bp, Zea mays
  misc_feature (1)..(100): optimal_loci_82738_G1, chr2:185765919..185766954, Cluster 6
gtgtggggttgtccacaacaccctgaacctgacaatagcccagctcggggacatcaacctccaaccgaatgttgctgcccccagacttcacaactcgctcatccatctctgctgctagagcatttggaagcataggaactctgtcgttttttatcagacgccacgttcagttcaagacatccggaggcgctgcctagaagaagccagactttggcgctgtaaaattacaggccattctagtgtggtagatgcctggtgtaatatatttcattagcagaacgtgatatgtaaaaaactggtttatctgttttctatcaatatatctaatcaggtggggacaaccgtccgcgcccccccctgttgccctgtcaaaaaaaagtttagccctacagcctacgccaccagagatctgaaactcttgcgctacagaacctaatctgagtagaccttttagttctacacaaataaatgtatgagaagactaatcatcaagaattgcagaggtatgtctctcttgttgattaatccatcctagaacacacaactaccaatcgtcaatccatttacatctataccactgtaaaatccgtctatttaaactttgcaaaaaaccattcaatcaaattgcccccacactcatagcctccattatatctaccaaacaaattacatccagacttaaaacaccataaaaaattacggtttagatagctagataacaacctctctcccttactcctcaaaatctaatgaacaatatcatttgaattattcctcatcccttcctctccccctccctcgcgaccccactgtcccctcccctcactcacaccgctgccgccgtgaaccgctaccctcgcgccgccactgtcgacctctgcccttccctccgtggaattgtagctttagtaccggatatatgctagtttcacagattgatgacttcttttcaccaatcaaaagaacctgctcaaaatggcaacatatccaatcctcaaaaagatattgtgctcatgtgcatattttagctcaaaat

SEQ ID NO: 1071 - DNA, 1140 bp, Zea mays
  misc_feature (1)..(100): optimal_loci_83244_G1, chr2:188825297..188826436, Cluster 6
ggctccagtcgcccattgccatgcccgtcgccgtggtcgctttctccggttctccccgagcaaaataatcaccttcagcagacaaccgttgccacctcgtctatctcggcgctgctcaacatcatctcagactctgcatcatacattcatactacactacactcctccaccgtgatccaaactcctccatccaggtcatcatacactcgatcgccagaaataaacaaacaaacagaaataaacaaacaaataaaaatatgtttgtgccactgcagacgcacatgccagttccagagttcgaaacagtgctcgatagtttaatgggcgcagagcttttggccacgaggggctccatgtgccgctgctcatggctccaaacataggcttttgttgtgttgccacttaaacaaactcgatcgtggccatttgtctatgccgcgtcgtcgtcgtcgtcgtcccgctcgccggccgctgctcgctcggaacaacgggacgggacgcacttggctactgctccgccgctacatgtgtctataggccagcggcgccggcacactggcatgcacagcacagtaatgaccggacccgcgattcgccggggaaacggccaagtgctccgcgtagctagcataaacctatcgtctatcactgcaggtgagcggtgacctggcctaacactcgaaagattccacgggacatgcatagtagacgtatatctatctatctatctatccaatcatgcatggaccacgacgtcgagtagaattaaattcgtagccggaaaggaggattaggcaggctacagtggtagggagagggaccggggcgaaaggtcgacgaaaagagatggcgtatgtcctggagtgtcgccgtagtgctggccgattggcatgtttcaggttgctgtctgctcgcagcacgccatgatcggctgccatgctcgcgcggaaggacgacagcgatggagttatggggaacgtcgttgatgcagacttcgacctctcgattcgttgcaactggaccatttcttttttaattctttttcttttccaagcaggaccgcagtttattgccatgttttctcaagtgtaagccttatttagacccttttaagcgaaatagatttggggatcaaaattc

SEQ ID NO: 1072 - DNA, 1318 bp, Zea mays
  misc_feature (1)..(100): optimal_loci_83327_G1, chr2:189202027..189203344, Cluster 6
tgcacgtatttcgtgtgatttgagcgatgtggttacttttggtaatatatcagcaaactaataataacctttggtagcaaaggaaatagttgtcatggtgaccatgattgcactataagttgaaaccttatcaccatgcaaaagtgatttacaaccaaataggtatgatcggattaataaatttgtagcatggaaatttaaagcttaggtagtcatagggaggaagacaacaaaggtgagacatcaacatccgtgtaatacatttgataaaataggttctgacaaagagctgccattaccactcttgttttattggagaaaaaaagcttatgtacacggttcctattcttcttaagaagttcactgcggtacctctacagaacataatcatatgtaaagaaacaataaatgcaacaaatttctctgcatatgtatagatggaacatgaagaggaaataaatatgtatggttttcgcagggtatattaataatttttggaacataccaagctcatcgctggaggcccatgagggcatggacgggcctcaaatgtcgcagtctaaatttgcatctgagctagtttcgtttgcaggcccacttgcacatctccatttggtagtgtaccgcttcacgttttcatgatcggtgtcgtggtgcctgggccctagcgtcgtctagagctagcggtgcgctagacggcccctgccgggcgacgtacgagcgacatgcgtcgctttccctggtggaccgtgagaatcaaggcacataatgcattgttcaccaccaccatcacagcaagaacaaaaactgataccacctacgtctgaaacatgttctactcgaactatggcctcatgctgcacagtggcagggactgatagatcttttggatcttttcaataatcctaaccactagatcaaagcacagacataaattatacctctgtttagctccaccaccgccgctcacatttgtcggcgaagctctgagctaaggcaacgacagtcagagaagcaagtccgacgccgccggtggacttcgcgttgctcatggccttcgctcaagatcggcctaatgttaaggtggggaaccgagacactagctactacggaacctcatgtattagttcgtgaacccccacctctctatagcctgctcaacaggggcgtgaggtaaaagacccaacggtgctacaaccaatgcacgtacacaataccaattcacgtagacaatgctacaagtagacgcgacgttatgataaaatgatggaagaagaaaacatatacaatttacttgtgattgattccgtgaccaatt

SEQ ID NO: 1073 - DNA, 1277 bp, Zea mays
  misc_feature (1)..(100): optimal_loci_86688_G1, chr2:209108183..209109459, Cluster 6
gtaggctgtacgtgcttgtgggcggtggcggatccaggtgccgcatgcgttgacatgggaggagaaagggagaagacaacggagggaggggagggaagaaaaggaggaaaggaaaggaagtaacaatgaagaaaaggaatgaagaagatgaagaggaaaaagagaaatagtaggggagaaaaaaagataatcagcctccagtcccctttttccacgtcagatcttggatccaccactaaatgtgggctactaaactcccatggactacacaaagaaaatgtattttaattgaggcggtttgcagtgagggacgtaattataagtcgttgccatgtaaagacaatgtattctaactgaggcggtttgcagtgaggggcgtaattataagttgttgccacgtgcccacgtaaacgacgatcagaactcgaaaaacctccccaaactacttctctcgttaactgtccgaaatgctattcttctgctatatccactattgcgtgcatctcgttgcgtggtcgttacaccaagtcgccaagcacgaatgcacgatacaattaccttttgttgattggacgttggttagcaaagtacagtcttaaattttgacccgtttccaggaggaaaaaaataagcctacagtaatcgattgcacgtcactagttgagaacgaagtcaacaacacgacctgcaggctgcaggcttatattatcaccggtatgcggatagcaacctgacaccggcgaacatccacaccccgcacgtttgactcttcattttctaggccatggcggcatggcatggcccatggagccaataattgcccggacgatccgaagcaatgctgcactgcttgtctgtttctccgaccctgacatttctgcacgttccatggccgcagcgacacggaggcggagcacccctcgccacacatgcagcagcagcagcagcagcaggtcggatatcgcttggcacacaagacgacaagcagagcacgggccgacgaagagcgtactgtatgtatatgagtgtatcctaatggccaacggtcaaaaggaggcagcatgcatagcggcgtgcacagcacggccgtcgcggtcatctacgatatcgatcacgactcctcaacatctcttgtacacgtactccagtctccagcacagagtgccagcgccaaatttggcagcggctgcacgcgtctacaagcacaagtacgccacggcgccctggggcgcgggcgcaggaaagcggcgaccgggcctccgggcagggagacccgc

SEQ ID NO: 1074 - DNA, 1022 bp, Zea mays
  misc_feature (1)..(100): optimal_loci_88611_G1, chr2:220146814..220147835, Cluster 6
gaaaatatagatagggaaataaatataagaaaaatggttgaaaatggtctaatattgaataatcctcctcgatccacttatccacattcatggtatggaatgttgcatgcatggcgggatatgggcacgctctgctctcataggtggagcaatgccatgtgcagacatggagcatggaatggtccatgtacgtcttccatggacaaaagtaaaaaaaaaaaaggtggggaaacgttcccgcaacatggcgcacgccgaacaaaggtgaaagtaccaaaacaaaggcacaacaagttttgttcctgctctcttgtcttatctagctcctttgttcttgggcaattttgttctattggaaggcgccacctccctcgctctggtgtatgaatacggtgacttcgtgtctaacggcgcctcctcggttccctgcatgcaagggggttgtgcacatttccccccatggagtgtggagctccaatctccccctgcatttaactgcgaaattaattcaattcaagtttagttacttgataacaatttgtattatggtgttataaatatggtagtattttttaaaactctaaaagctaatgtaaaaaagtcaaataactcagttaagagtaaagtggagctggataggaagaatgattggagagtagataaaatagggaaataataattgagaagggggtgtttaaatataatagaaagtacaaatgaggggatttgggatagagaatgattaggaatggatttggaagtctggatatctgaattattcgtatttgtattcgcttaaaatgttgatacgatatttacgtacaggcaaaacagtgcaccttagcactaccatttgagtgcttgtgaatataacgatatttacatacgggaacaaggagccatcggtaaattgatatttttgtaggcggttgcttatgtcagtcgtatgtaaacatcaatttcaaaaaattaagaagtgttgaaagcctcgggatgagatcatcgttccgatgaagctgccg

SEQ ID NO: 1075 - DNA, 1080 bp, Zea mays
  misc_feature (1)..(100): optimal_loci_91018_G1, chr2:230945046..230946125, Cluster 6
ttgttgcttaattctgtgcacatcagatcatgtacgcaatccccccaccccaacacacacacacaatctacacgcatgctttgttactgtagtaggccggctgcagcatgttgtaaacgcgaaagacaaggatccttgaccaactttttgtttttcttgtttttgcaacagtttagggtcagtcgtccgtccccctgagacccttttgtgaacgacgacatgatatgatttatcaaccgcggcggccacaaccatccaaataaccttgccaacccgtgacgacgcgagcaatgcaagctagaaatggagccgacgatcgaggcagaggaaattaaacggcaagctcgtgcgagggacgatccacgacggcagcctcctcatctgaacaccgtcgttcgttcgttccacgtacgcaagccctgtcatttcttccttttgcctgtcggttagtttcgatgtcagtggcgtgctgcatgcaggcactgacggtcacacaggataggaaacggagctagtagctaggaaggtcgtcgtcgaccaagaccaagttaactataggtcacactcgaggacggccgggcagctgttcggctgccatgcaattcatagataacaaaatagtgtataaaccgtagccacggtcagattaaaaccacagtaaacctgctttccaccgctctcaacctgctagctcctcactctttaacccctcagaaatcacttcacaaaagcctatttggcaaatagttttcgtcgaatagattcacttgctttcgatatagaatcactctattagggaatctaactctcggagctagctagagaatcatgcagcagatcagatcgagttctaccaaaggagccatatatctgttgcaaggggtgcatggtatacaagacagccctgaacccatcgatctcaaccacatttgcatgccgataaatataagttaagaccgtcgtccgtccgtccgtccgtcccagctaagtaaccatgcagcatgctggcggttaaccaggcaatgcatgcatgcactgtcgattcattccgtatgcatgcatgtagggctatctctatag

SEQ ID NO: 1076 - DNA, 1114 bp, Zea mays
  misc_feature (1)..(100): optimal_loci_92963_G1, chr3:4720118..4721231, Cluster 6
gtagtagattgcaaaaggaccgggcaattgataaaattgctcagggtcaacttgagaaagaaaaggaccagtggagaaaagtttttgttcagaagtgttggcattgtaaaattgattgccaagcataatttagcatttcgtggtactaatagcaaactgtatgatgataacaatgagattttttaggtttggtagagatgttggctgaatttaacccggttattcaagagcacgttcgtcgtattacaaacgaagaaactcatattcattatctgatattgataacgatgtaaaaaatagcaatgaaggtaacaggtttggcagataatgaacttggagagtacaaatttatagtatcaattgtcatttggtatgaagtattatatgctattaacttagtaataagcaaacacttgcaaacaaaggatatgcttatagatgttgctattgataaagtggaagggctgatttcttccttcaaaaggtacagggaaataggtttcctagaggcattggaagttttgctagtctatttttttctacttagtaggcccaatctataattacgaacagggcctccatttatgccgggacggccctgattcctgactaccaagtaccaagaggacggagagcactaccttacaacgtgtcgcaaaatagtcagtactaccttgaattcttttttttttccacagagaagagaaagaacgcgtgaggaccagttagcgtctccttttcctcagcgattgacaaaaaagcgctcgatttcactcagctttacttggatcgaaacgtaacgtcttaaccgctacttcgcgtcgtttcagcccacgctctcagcaaaacgcgaaaggctgagttggaggacgacgaaaacatctctctgcaggaagccactgatgaaactgaaatctgatgagcagatgcatggatccaccaagggggtgagtgaccgtgaccgtgacctgctggcgaccctgtccccagttgccagtggatgtctgtgtgagggcaacagatctgatgagccctgacgggtaggcgctcattagcctgacaagccagagcaggcaagctgagctgagctccccgctgctgctacaggatccat

SEQ ID NO: 1077 - DNA, 1002 bp, Zea mays
  misc_feature (1)..(100): optimal_loci_93280_G1, chr3:5880691..5881692, Cluster 6
tgatcgatcccctatatatgtactgtgccgcgccaacgacaacgccagtccagtgccatggatcgactgatgatgatcaggcaggcattaacaacacggcatacacgcatggactgatggacccagcagacgactgaaaggcatgcgcgagttttatttgtgtgctagctagaatgggccgtcccggccgggaccacgaagtgtaacgcaagtgcgtgctcacttctctctctctctctctggatccgacagcggaagacaagcacgactgcatgcatatcgtatgtcaaaaaaggtagcacatgtacgtaggagtatgtatgcatatggtatattagcagcagccgggaccgggatatagccatgcacgcacgcagcgcagcaggcaggcggtaacggactaatggtacgggtgtgtcgtgcagcatgcatgtttttcccgacgaggacggaacacggccgccgtgcactcgtcctcgtcctcgtcctcgtcgatgccgcgatgcgtactactgcagcccggcccgttgacaatagaatagatcagttgagcgcagcctcccacagcgtcagggatctcaccggtccatcacaatcacgccctgcattgccagcctcgccccattagaccattaccgccggcatgcatcgcgatctgctgcagtagtagtcgtcgtgctgcgctctttctgctgctatgctgcatccacacacatgccacacactcagacactctctctctcctttcaaaatctttgcggtaaactttctttgcagagagatagagagagagagatagtagagtagtgcagcaagcaagcaagcaagcatggtagtgccaacaaacaccgcggcgcgcgctctctgactctgactaggaaagggacacgtgaagccgcgcgcttgtcgcttagcacttggaagcacgcccaaactttgatgcgcggaatatttgatgtggaaagcggggcagggcatatgcatatgcaccagcaccagcaa

SEQ ID NO: 1078 - DNA, 1164 bp, Zea mays
  misc_feature (1)..(100): optimal_loci_93486_G1, chr3:6741286..6742449, Cluster 6
caggcgagaaagtagcctccgaataattaagcacggcccgtttgcttacatctgactttgattttttttttctgctagtcttggataaacatcagacagccaagtaggatgcctgtaggcaaggccaaggcaaatcatacgtggggatttgtgtgtgtgtggccttgtggcgcgttggaacttggatcgtagattaacaaagagacgacacggccctgcggcagtctgttgctacgtactgctggtagcctggtacagagctcccctctgcgcacagattgcttttgcggccggcagttgcgttgcgcgccggccctgaccggcagcagagaatctgtctgcgctctcctgccggctgaaactgccaactcaaactgcaaatgaaaaaggctaaaagcaagttcagttcaggtacaagctcttttaattgtgcagaacaagcaccccccccccccccccccagcttcttcttcttcttcggaggctttgaaagttcacccgccaaaggcactgatagcgattatatccactcgaacgttacaagctagaagacaggtcacgtcaatgaacgggaacggaagccaatcaaagacgccttggcctatagctagctcgtacgttcttggactttaccaccctaataatatagagtattgttgtgtagtagtataacaatattctcggatgcttaaactaagcaagacttgcaaattaaagggactggactcgcggcgcgacagcgaggttccaccgcccccgcctcttgtcatgacgcccgcctctctcgatattccggcacgagaaagcgacacggcacgcttttttttttttcctttttttctttctttacaaataatagccggagaagagcagaaatcggagttccggcgaaacaaaacaaatggaacgctttcataatttcttcaccagcttagaaaatcaagttccaatctagtgacgaccattatctatacgtcaattcaaaggctacagaaaatggcttctgtacgtctacggtctattccttacaagatttacttaattatgatatggttcaaattacctccaaaaccaatagctagcggctaaataaaattagctgacatcttggtttagaatgggtaaactaatagaccaactaattattattagttaacccttcta

SEQ ID NO: 1079 - DNA, 1044 bp, Zea mays
  misc_feature (1)..(100): optimal_loci_93980_G1, chr3:9320253..9321296, Cluster 6
ttcattagaacctctcaagatacaactcatttatgtgggttgtatagctaaaaccgtatctagacttagagaactgtgctagagatgtcccttcaccaagataacatcttttgtgttttttttttttgcacttaccccgttgataccacttaagaaaagaaacatttttgtgggttatacatgccctaagagattgtttgaatatcttcatgactctcgatacatgtcatctcttggctgcatttataatccattgtcttggtattgtatcgtgcagtctcttaactgtcttttatacctataaaaccaaaccaaagtcttagagttatacatgccctaccttattcaattttaaagaggttgaggggattaatttttttatttaattttaactctcaagaaatttaatcttctcttgttcactttttaatccgctcataaccaaacaaaccctaaggaaaatgtttggatcgcattgtattgcaactaggttttgtgacactgcccagctgcatattcgttttagacgaaactcaggtctttgtggtctgacctgatctgatcaatctattggttaacagttgttgggccagagagacgtctgaacagcgcccagccctcttccgaattgaaagcaaaaaaaggcatgatgactcggctcgagcgatctggagtcaaacaagtttgaaagaattcggttgcaacttgccacgaatctggcctgcttcgtttgaccgtcagatactgtgggatcctatcctttccctcattggatacgcccacgggccacgtacagacctgcctggagatctgcatgccacgcagcaacacatgcttggagagttggagatccagtcagtcaagtttggcgctctcaagtctgaactgttcctgctacgcggctacgccatttaaaaaaaaacaaaaactctcctagaaagagagatttcattatggtggctgacaggaccatgtaactgccgtctccctcccaactgactcgttgtagctgatgcagcagtctcactcaactcctgtttggtg

SEQ ID NO: 1080 - DNA, 1201 bp, Zea mays
  misc_feature (1)..(100): optimal_loci_93987_G1, chr3:9333799..9334999, Cluster 6
atatatacttatacagtaaaaatggttggtgtagagataatttggttgcgcgagttttataaagtttaaactgttgaactaaaccggtagtaagaactagctagatcttgcgtggagtaagaagtacatgctgcaggcctgagtggcgacaccggcacagccaacgttccgagtgatctcattctcatcccatgcatgcaaagtctgtatgcatgcatgtgatcatgtgagctagatggtgcattgctgttgtttaagcactgatgaatctgcgcttcgtgcccgccgctgtgcctctttgcttgcatcggataccttaaaagaaactaaactattctcgctggacgacggcttcttgtgggcaacacgttagtcgacaacgattcggccgccgcctgcacacaccgccggccggcatcgtccggcatcgtcgacctagtccagggccagtttgatggcaacgcctaactgtgtttagccagctaaaagctaataatcacagtctctctgaactttagatggaattaacaggtgttctatcagccagctagctgatcgacctcatctaatttacgctattttttgtttaatcttagctaataattagttccagctgactcatgacgggttcagacgatgcactattcatgacggattaattcagctgattgatcgatcatgacggctaactgtgtaggcttttagtttatgtgcactgatcttgagatcatacgggttccgatgcacaacagtcaacagtttcgtctttgggcgaattaatggtctgaaaatgaaaaccatctggtacatgtaactttgttgccgttcagttttctgtgttactgaagaaccgtcatgatcaatcatgcagtagcctgtttggttgcctagattttcttaatccagatacaactttcaagctactacctatttattctggcaaattttttttattttgtatatatataaattagtcggatttaatgctctcttcggtttaagttatagaacgttttggtttttatggatgtataacatttgctacctatttaaatatggattatatctagatatgcagttgaaacaatgtatctataaaaagacaaaatgtcttataattaagaacggagctagtttcctatattctaacgtgatgctattttagaattgtatgatgattcttgttgaaggcgggagtcaa

SEQ ID NO: 1081 - DNA, 1385 bp, Zea mays
  misc_feature (1)..(100): optimal_loci_93998_G1, chr3:9435029..9436413, Cluster 6
  modified_base (1043)..(1043): a, c, g, or t
  misc_feature (1043)..(1142): n is a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
  modified_base (1107)..(1107): a, c, g, or t
  modified_base (1108)..(1108): a, c, g, or t
  modified_base (1109)..(1109): a, c, g, or t
  modified_base (1110)..(1110): a, c, g, or t
  modified_base (1111)..(1111): a, c, g, or t
  modified_base (1112)..(1112): a, c, g, or t
  modified_base (1113)..(1113): a, c, g, or t
  modified_base (1114)..(1114): a, c, g, or t
  modified_base (1115)..(1115): a, c, g, or t
  modified_base (1116)..(1116): a, c, g, or t
  modified_base (1117)..(1117): a, c, g, or t
  modified_base (1118)..(1118): a, c, g, or t
  modified_base (1119)..(1119): a, c, g, or t
  modified_base (1120)..(1120): a, c, g, or t
  modified_base (1121)..(1121): a, c, g, or t
  modified_base (1122)..(1122): a, c, g, or t
  modified_base (1123)..(1123): a, c, g, or t
  modified_base (1124)..(1124): a, c, g, or t
  modified_base (1125)..(1125): a, c, g, or t
  modified_base (1126)..(1126): a, c, g, or t
  modified_base (1127)..(1127): a, c, g, or t
  modified_base (1128)..(1128): a, c, g, or t
  modified_base (1129)..(1129): a, c, g, or t
  modified_base (1130)..(1130): a, c, g, or t
  modified_base (1131)..(1131): a, c, g, or t
  modified_base (1132)..(1132): a, c, g, or t
  modified_base (1133)..(1133): a, c, g, or t
  modified_base (1134)..(1134): a, c, g, or t
  modified_base (1135)..(1135): a, c, g, or t
  modified_base (1136)..(1136): a, c, g, or t
  modified_base (1137)..(1137): a, c, g, or t
  modified_base (1138)..(1138): a, c, g, or t
  modified_base (1139)..(1139): a, c, g, or t
  modified_base (1140)..(1140): a, c, g, or t
  modified_base (1141)..(1141): a, c, g, or t
  modified_base (1142)..(1142): a, c, g, or t
atgaaacggcacatcatggacgtacatgccaggacaccaaatctttggttaaacagcagcaacaaaaaatccacagtatttctgtgttaaaaaataagaagcagggaagccaacgtactttttttttcttccgatttttcatcgccggttaaaaagagaaggtgagattgagagcctcaaggagaagtaaaaaaaagagcgaaaaaaagagaggaatccttttgggatgtgggcctcacttccaacaggccccaaggcccgggtgtggggctggggccagggccagtccgcttttgtcaatgccgggccatcgctgtccgtgtaaaaagcggtgccagcgtgggccccacctgctcgcaggtccagccccccacccaacggtcccaccacgggatagatcgcgctcgccgcagtctactctagggtggggtgcggtgtgcgtggcgcgggtcaccgtgcgagtatcccaccgcggcggcgccacccgcccagtgtacacgagcacgccgccgctggccctcttgtcttgtctttggtgcgccgcgcgtgcaccaatggatgatatgaggccatgagggcaatatccaagcttctacgagaaatcacgcaaaaaaaaagtttagttttctttttcttttttttgaaaaaaaaagagtttattctgatctgctatgcagatacactgtgcgttcgtacatacataaaaatttaaaaagtactatccaccaactctcttgctcgcccaaggtgatcctcgcttgagccgccgaacccagggccagtccggatcttctgcagagctcgtactcggcctgccgtcgcttccactaattcgacgggaatgatatgggtgggagacgcagacgcatcatcatccgctgctgctacggcgtctgggtgcgccaccgcccccaccgagtcctgcgctgcgcctgcgctctggagaagggaaaaaaaagagagagagaggggagaagagcacaagaacgacaaaaggcgagcgaggaatccgggtgtagagtacggacgaatctctagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttatattgatttttttttttttcacgcccccccttttgggggggcgcccccccatattttctccccccccccccccggcgaaacacccccacaaaagagatttttttgtttttttttttcaataaagggggggcccacgggggggggttccctttttttggaaaccccccccccgggatttccccggggtgggggattggtttatgggttgagaaattggggacgggtatttgtttttt

SEQ ID NO: 1082 - DNA, 1202 bp, Zea mays
  misc_feature (1)..(100): optimal_loci_94227_G1, chr3:10622478..10623679, Cluster 6
ttttggaatgggctagttacaaaaaaactggctcggcacaaactagcccaaactagctctagcccttggatccaaacagtaccagtggttaatatagttataattggattggatagtagtatctagtactactagtaagagctcaaccaaataatatcggtatctattaccccatataatctatttgttttacatttcggtgagccaaacgccaccatggatctatggatctgctcgcgccgccgtcgctgccaccgtcgactccttccccgcagtgttagtctggactatatggtagtagtaaaggtaatattgattgcctgtcccagtaggtagattgatagtatgtagattgatagtagtacgtagtgctgactcacgtgaaggcgttacaaaaacggctatcacttcatcatcatgcatgtctccaacgacggagccagatcagaggtgtcacttgtcctcgtgctctaccgaccttgttgccatgctagtacggtggtagtagctgtccaactcaccgtgcctagacgacatggaatcgccaacacatgaaacatctaatcatacatgggcttgcaacttgcacgtacgtactactcgttcttgatcgcctgagccttgaacgcgcatcagagctggtgctgctggtggtggtagtagtatgccagcgcacacaccacagcgagccgactcagccgaggcgcacaaaccagcagatgcaaggcgcgactgttcagtggcgccgctgtgccgtgccgtgccgtgcgcggacgcgaacgcgacggcggcgatcggccagaggagctatagggctagctctgcatgcacgcgcgaagtaacgcgcacggcacgcgaaaagaggcgtctttaatgcgcatgttcccgcgcgtacagcgctcgtagctgtctgctatacggtacgctggcgcgtctcatgatgtgcagagccaaaggcggtgtacgactgtacgtatatatgcccgtatatggtacatatggcgcgcccgtacaccgtatgagtgccagctacgtcggtatgcgccgccaccaacctgggccctttttttagcctatcagcgtaaaaaagaccgcggacaatttaaattaatatatgggggtatactgcgatgtaatttgccctccaacgtctcccttcaaaactcactctatataacgggacatagaaaactccacctgta

SEQ ID NO: 1083 - DNA, 1028 bp, Zea mays
  misc_feature (1)..(100): optimal_loci_95334_G1, chr3:17035279..17036306, Cluster 6
tagagtatttttcctcgatgataagaactaattaaaccttgtccaagttcgacacattagaaacacatctcacacaagatataacatatttgccttagtgacgtcaactattagctgctaagttaatgtgatcaactattagctgacaattcaaggtgatcacatcatatagtacacattagttgcctcggtccaaaacataggtagtgtcatataatgagttctcctttcataaaatagaatatgagacatcaaacccacacatacaacatacaaaactttaggattagtattgttagtgtccatataagatcatatatatggatgctgcgaaggcacctgtagggaccccgataaagagaattgataggggggcagctattgctggacctagtctttcagggcccatgccttaggaacctaccttggctctagctaaggtagacctgatcatgggccgcccgacccgacaaacccaacttgacctcccgaaaaaacccggctcaacccaattaatacaacgggcgagtacgaaccataatttttgacacgcaccaatccacgaactgggcatgggtcatgatttttttatccaaaacccgacctgactcaaaaaaatctaacataaagtcaaaaaacctaacccaaccataaaaaaacgacctgacacatccaatgacacatccaacagggaagcatgagccaacccgacactaggaacacccacgacccgacctaaactcgacccgacgtttgaacaggtctaagctaaggtagaagcccaccattctaggctgtatgatctcgtcctcgaagcagagttcttatagccattagcgtctgtaagaacgacctaaaatctaagggccctagatgctcctaacaataagacacttctactcttggttctcttagtcgcctaggataggacgtctgccaccactgcaatatgtgttcttgtagaggttgttatccctccaggccctgagcctcttgagccaagcccttctcaccatgctactcgctaa

SEQ ID NO: 1084 - DNA, 1317 bp, Zea mays
  misc_feature (1)..(100): optimal_loci_96166_G1, chr3:21558777..21560093, Cluster 6
aaatttagactgtgtctaaaattatgcgctttggaccggactattagccacaccacagtgcatccatggctcggggcgcggggcgcaccactcgttggctcgttgcccctgtggaacgcgatgcgtcttgctctggagtatggacaggagtcaggagccaggaggaccactgctggtgctggtgctggtctgtcgatgcaatacatgcaaggactgtatgtacatgtgctgtactgctgtgcggtccgccccccagcgtatacacgaatttgatctacctgtggcccgtggccggacgggcagttaccgtagaggcccacatgtattttataacgcgcagtatctgtacgtataacgctcacagaataactccatttacgtgtacccacgcagcccatgcataccctctctctccccccctctcctctccgtcgtccgcgtattcgggctgctttgcactgcgatgccagggcacgacgagcaatcattcagcggaattcgtcgttgctaaccgtctccctcccgggcttgtttggttgaaagtggactcgatccgctcatatccccttccaaccaaaccagtcaaagctctttgatcttttagagctggttcagtgacaaaggaattgaagatgatccataggaaagaaaatttataaaggatcgaaagataggattgagctagaaccatatcaaatagaaagagacttcaaaatccaagtaccaacatatctgtcacgttctttttttaaaaaaaaaattactttaagaaaggaatcactaagtctatgagataaaaaaaatgtctcgattttaaaattagaacccaggttctagacttgctatctagaatgcaaagtctcaataggaggatgagatctaaacatactcctactttaaatactgtttattctctgtctcaaaattgtgctttttaaatttaatattagtaagaaataccatgtaaatatacgttgccaatggacggaccgatttaatatgctgtcacgcccgtgcttagatgggcttgtccgcaaactaaagaacgggctattataccatcttcagcagcttacttatacttatacctatatttaaactacactatataaacggtgtaatctataatgtaaaatgacacaaaatgatgtttttagtgatcatatagatgcaatgtatcatagttcatctatatggtcaaaaaacacattttacaccgtagattatattatttgtagagtattgtttgaatatgaatataagtataagtaagatgttgcagatggtcttacaggcctcgtgctggtctaggcatgg

SEQ ID NO: 1085 - DNA, 1351 bp, Zea mays
  misc_feature (1)..(100): optimal_loci_9633_G1, chr1:51040128..51041478, Cluster 6
caaataaatattttaatttctatttatatgatatataaaaactacagcaaagcactgacaactgactagtaaatatattaagaaaacataaatatttatgaaccaaatgagtatattataatatagtttgcaatatatctaatagtattaatttaatatcataagtcatggtgttttttagtaaattcgatgaaacttaaaaagtttgatttaagacaactcaaagaattgatttattcaaatattttatagactaaagagaaatttaataagtaataatatacttctttgattctaaaataaatatcactatcgtatttgtgttgattaaaattttagagtttgactatatttataaaaaaatattagtggtatttatatctctagataaattattacaaaaataaacttaataaattatctaacattactaaggcccctttgttttggctccttaagtagctccttcatcggcttctcctaattttcaaccaaacgagatgcttcttaaaaagcttctccttaaaaagaggagggggctgagattgaagcaaggagccacaaaaacgtagcttcttcggctcctccaacctattgtgactccaaccaatgaataaaaagaagttgtagagagagctgttttgccaaatattttagagaagcaaccactgctggagcagtgaagcccatttctggagccacaatcggagccaacataggtggagcccaaccaaagagggcctaattatatactataggtaataatgttttgtcatatttatatttagttgaagtttacaaagtttaactgttttaaaagcagaacgacacttgttttcttttttggtcggagttgagaacagtataaccagtgaagtgacatcgccccgcgggccgggaaggaagcggtacccggtaggcgtgatgatgcccctgcccggctgccgcctcgcctcgtctcgtcccctcggtgtcagacggccagtcgtcgatgtcgttggtgtgcaggggcaaccggccggccatagccggaggcagtgcaaccgcagccgcgtccgccgaacagcgagtgacgtgccgttcgcacggcaggctgcgatgccgcacggacgtgactgagttgccagatcgtactacgacgtgctagcggctacttgtagttgtagcctacaatacgctgctagtactgcgagatggatttgagtcgattcgctcgctagtcgcttccccttcccattgttgctccgtgagtccgtgggacgcagcgccgcacctgtcgacgaggcagggtcctcggtggtcagtggggcaatcgagtggactcgtggtctcacgctcagcgataggcctc

SEQ ID NO: 1086 - DNA, 1031 bp, Zea mays
  misc_feature (1)..(100): optimal_loci_96490_G1, chr3:23179819..23180849, Cluster 6
atcgtttttcactatttttgttttttcctaaattatattacctcatacaggttatagcacatataaaaggatgaactaactaaatttaaaaatttggatgtaaaaaaccaaaaaaaaataaagatctagatataacaaaaaaaatattatatagttttcctcataagatgcatataacttatattttctaccttccctcaacaaatctacacaatacttctctagacaatttaagagatctaaacaaagaaaataactatttcaacaatattacgtgagaggataaacttttgctaatctttttctataaaatgagcaaaaactacttcaacatttttttggaaaaaaaataggcatcatcacctcccctcgaagcttatagtgccatggacaaagctactctattcgcgcaagctcgaggatggagaggatttataaaacatgtatattaatatcggtttatcaatcgatagtaatattaccaattgaaaacaccaacgaacattaaccatgtatattagtatcgattagtgtcttcgatcaactagtattaatgagttagcatcaatgctagtttaagataatactggtattaagataaggtagttaaaatcgatagtgactcttgcatcagtactgaacaatcggtgttgatcttcttagacggaagcccctttctgtcgtgaccatggccgcgttggtggacggttacctacactaccgccctggcggcccggctcattatcgtctagccgagctaatgggccgatgcgggaggatcaaggagagttgcgcgtgtgagcccactcggaaagaatctggatgggaaaagcttggagctgtgctcacttctgaagtgaagggcacgatcaaaatccaacggctatgaaaaggagacgacatggcaagctgagatgctacagagccaagtgcaagattcgtctcgtaaaatattgtatcaaaaggtgctatgtattccatctgccctttttatgtcttgttttgatattcacgttagtaattttttaaaa

SEQ ID NO: 1087 - DNA, 1017 bp, Zea mays
  misc_feature (1)..(100): optimal_loci_96876_G1, chr3:25355099..25356115, Cluster 6
actgatgcatatttgcaaattgcaattgatccattctaaataatttagctaaaaatgccctctatatgagggctacttgcttacttctactgttttacagtgtcctgttgtgcttctgcacgtttcagatcctcagtagtcccctgaagaaatatgcaatacaaaatcatattcttacgtattataaatggcaagaagcatttgatagtgctgctgctactaaacatgtggtcagaacaaattaagatgcatcagcttcactggtaccaactcttgcacctgcagcctatctattcgctgtttctgtgatacggcagaacccagaatcggtcagcagagtgtgtgcttatgagacagcagtgtgtgatattatttgtttccaaaaagagaccacggatgagaaggaacaaatacttgtaatagttcgcaagtcagcaccactgataaatgaccacaccttgtacagaaaattttatcagtaattctcgtttgttcataacctatcagctataagccaagcttctcatcctggtggtgcagatcagcaaaagtagtccctaaagggatgagaaaagggctaaaatccctgataatcctcacgatgtgggaactatggaagcatcgggatgattgtgttatcaatggggctaggcccaaagagaggactgtcctgcagtccatctcaaatgaaggcaaactatggtgtatggctggggcttcggggcttagagaactattagacgggccacggctgcctctctaatctgttgttagtctttctcttttctgcagttgggtggattgtctctgcctctctggcctctataggcttttcactatgggcgggtttccactggccgctttaggctagtgaccccgcttttatgtactaccttttcttccttctgatgaatggcacgcaagccttttgcgggttcaaaaaaatattcagttttgggtccaaaatatattaacaaaattaaaagccaacagtagtccaaggatgcgtttggttca

SEQ ID NO: 1088 - DNA, 1377 bp, Zea mays
  misc_feature (1)..(100): optimal_loci_99889_G1, chr3:43363947..43365323, Cluster 6
cagtctgcacatgtagtaaagaactacatgtacaaaaagctgagcaaatttttttacccattagtatacattatttaatggccgggatttggacatgtgcggcgttaatgatggatatgccgtgcgatagtttatttattacttcttcattttttttaataatgttgcatcatgcacgttattgtgcttcccttccctttccgcactggacagaccaataatagtacaaaacctaataaattcccccagcgtactacgtgtctgtcttagcctttccgggtcaaaaatgtctgcccggaatcgtgcccttgccctcccgttcttcgtcggccttctcatctcctctcctcccccgtgtcaccgaataaatagatgtctgaggttctgttaaactaaatgtttcaaattttaatcgaaatgtgaagaaaaaccatttaaaatctataacatcaaacttttatcgttagatatgtttttcataagatactcaatttatatcacaatagatatgaaattcgaggaccggatcggaccgaaccggtggagaagacgacgagaacgaggcacggcacgcgtgagtgacgactcagaaacgagtaggggggattcccatatgtagcaacaggtaaactttggcaccgaaaaggcggttgcagaaccaaccaccatctggcatctgggggggagactggaatatcggattggatcactcaccgccctgctgcgtctgcgtccccgtcccctgccatccccattcatgaactccaccacccacacccaggggggtaaaaaaaaggtggcagcagtagcccttgcccctgggctagcgagcagcggtagcacaaggaacaattttatgtcacgtacagtgcgtgaaggaggaaggcaacgagtgcagcgtagcggactagcggtaggaggaaggagggagcgtggtgggttcagtactctgctctgggtaaaggtttctggcaggcctgtgcctagcggctagctagagtttgacatggctagcaaagctgccaagagaacgaggaagggaagagatttttttttcaaaaaaaaaagaagggagagagagagatatgagatgagctctctcgtctctctcctgatgaagcaatactagcaagcaactgaacgcttcccttctctctctctctggcctctgggtgtgtgaattattgcaggtgtcagggagacagcaaagcaaggtgttccctcctttcccctcaactgttgttcgcttctgtttcacctttgcatccaccaccttcctcccatgcccactgtttgcctgtttcccgctccccgtcccccgtgtctgcctgtctcagcttactactgcgttccccagagaataaaaaccacaatatt

SEQ ID NO: 1089 - DNA, 2626 bp, Zea mays
  misc_feature (1)..(100): optimal_loci_221721_G1, chr6:91309097..91311722, Cluster 7
ggcttcccagctggcacttttttccacacagtcccacgtatactgcagcaggtctgtcatctgtgcatgcatgttgaaacaaagaagaagcaggtagtaccagatctcgcttgcgcacttgcacatcattaattccagtagattcctaggatgatcaaaagggagctggctgtctcctccatcctcaacctcatcaaggtcaaggctgctcttgctgcagcagcatgcagtgcccaatcatagatagatctctgaagaagcccttgcttggtttcgtacttaccgatgaacacgcaacagatcgaacaactactccaaggctgcaggaaagaaaagagagaaaactactactgttcgtgctgagcaaagtccgtcccttgcttggtttcgtacttaccgacaaagctctgccctgtcttcgatgaaggttagtttatgcgatgcgagcacagtgcctttcgatgcatgggattggatcatgggagctaggtgtataggatgagttacagtttattattgcgcttcgctctgatcctatagacaggcgacaataattgtacagccgctaggccgggtcaccgatcacatcacggggcacagtcgtacgtacaggtacagtactgttcctttgacgcgactggggagaagagagagagaccgaggaggcgctatcggctgcacagttgcatggagtgatgtgagttaaagctgggaaaggtacaattttttctcagagaaggaattaaagccctaggatctagcgtcgaaaaagccatgcgtgccattgccaaacctttactaataaattactcctaattgatatattggcttcactcctataagcagcagatatctggagagatacgaaggaggcttaaagataagcaagaatcgaggagggcacggggtggccttttcctgtgatggagttgacagccaacactaccaccaccatggccgtagccccttgtatagttgtagttaccggaaagaaagaaagaaagaaccctagcgctgttagccatgcatcatctcctttatttcttttttttttcctttctcccaagacgagtagccggggggagcagtacgtacgcgggcccctggtgaattctctgggttttttttttctctgaaccacctgatgaaataaaaaactgcaatctacaccccctcccaaccccgtacccgtccaacagcgactcgtccatggacaaaataaaatattttctgtcaggcgggcgatccagttccgtatctgtatgtcaaatgaaattcgtccatgagaatctgacaaatgcatggagcagtgcaaagactcggaagccacctgctaccgtctgccgcgtctgggaggtggtgtttgccatggctgcactctctaactaccccgatcccgaatgggtggtgctggcttggacttggacaccacctcttgcaagtttgtggtagactggtagttgtaaactgcaaatcccaatgcagccgccaagccctagggcaaccatacgcccctctccctctctctctttcgccattgccgacgcgggagcgggaaagggcgcgcgaaagatgcgccgcgtttgactctgcgctcagcaccagctcgcaggtcagtaaagccacgtcgggcggcgtggctgagagagacctagaggggagagtggtagtgactagtgagtgacgggcgcacgtcgtcggtggtggaccatccatcggcaaggcggtggggagaggaagacccaagacccagatggggaatggtacgatagatgaggaggagggccatggcccatgcccatgcatggtccctgcctgcgacagggacagggctctgtgccccgccccagatcgatctctctgcgccggagctccgtccggtccgtgtgggggcaagctgacggccggccccggccccggcaggggcgagccgatcgcagacagccagcaggcgtgacgcacgcgcgcgtcgcgcagggccatggcggaggaactcttttcaggcagcactgttgccataccaatggaagcaaagcagagctccccggcggcccggccctgcaggcctgcacaggcagctgcagctgtatccggatctgacctcacctcagcaggccacgacgacgtacggtacgggtccgtccagtccatgcatgcaccagcatggaggagacgcacgaaccaccggcagccgcagcagcggcggcgggtgcggcagaaagccgagccatgcatgatttgcatgcgatccagccgagccaggtcaaggtgctcgcaaaagtagttaggacgtcgcgtgcacgtagcggctgtcaggtgggcccgtgccgaggcagggacggacgggacgggagggttttaatggccctagctcgtttgtttgctggcgggagctagcatttgtaaactatcttacggaaattaaaggccagctcaggttcttcagttccgcctgtgcatcgtcgatatgatcttcttcccacaagaaggttttctgaaattcccccacgcgatcacaaatcactactactcgtacgtgttccaacttccaacgcaattccttttaataaagcggggagggaatctggcaggtagagatgtccacgtctgcaaaatttctctcaat

SEQ ID NO: 1090 - DNA, 1801 bp, Zea mays
  misc_feature (1)..(100): optimal_loci_106240_G1, chr3:85750942..85752742, Cluster 7
aaggagaaacaaaaggaaataggaagaaaacggtgaaagaaagcatgcatgcacactacgcaaatagcagcaagcaagcagcaaaaggtaaaagaaagcatgtatatagtgcgtgtggtgggaaaaagtaaaaaaagaatctcggccctttggttttgacagtgccacaagtgacccgagttgaaaatgaatcggatagcacagcattttagtggtccaagaatctacacacgcgcacgcacgcgcaaaagcaaccctgcatatatgaccatatatgggagaagtgctttcagagttcaaaccatgcatgcatccaccggttttcagaatctaatcttcctttaatataatttgcaagtctgaaccttcattataaagttgacatgaactctaaatcacccacattgctcccttcaagccaaaaaaaaaatgtatatatattgcaggggtctagcaaccactactatcattatcgcatgttttcattactgatcacatgcatgctgcagctaattaaaggacacacatggacatgttcctcagctgatgagtagtactaagtttgatctgattcagcgcgctgaacctgaccttattaggtctgtacaggtgagatctctgctcgagcgatattacggtacatgcaataatgcggtcatcaaaatccactagaggacgatggatggatcagctggcaagcaaggtctagaagccccacgtgctgaattacattcctgtgcaggagaggaggagaaaaaagaagcaagaggcaccgcaaaaggcggacgggcgggcactaaagtctccaatatattcttggcagcgacgtcaaccaacagcgactctctcttcttgcccctgaaacaatccttcctccctgcctgtatggctagttctaaagtcagcactagcaaatggcatctaccaaaaaaaatatcccatggcaatcgagagacgccacaaggatggctggtagtagcctgatactaggcgccacataacttaatttaatttagctcgccatttcttttggactaaaggcctgtttggacagctgctgtaggcgccccagcgcgccacacctgcagcggtcgatttgggcgccacactcgcggcagccagagtgtggcgcggtgtggcgtccgagccggcccaccaaacaggttctaattgccaccagaaaaaggaaatctcaacaataggggcagctgagctagctagctagctatcatccagacaacccgatgatcgtttctttcaagcatatttcggaagacgcatggatcatattcgcatttgctctgcagcacgaggagacagttttctatctaccgttctagctgacaagtgagagggggaagtagacgaagccgatcgcgtcgcgccgtattgatttgattggcacaaaaaagagcccaccacgtcgcattgcctttttttttggtttggtgggtggggagagggggtgcttatcaggaagaccagtatgttgtttcttgcactcctgacgctgatggccatggcctgtcctctctagtatagctaatggcccaagaagacggcgatggtcattgaattggcgtgtgtcattaagtggatccatcgctatcaccaaggacgaccaccaatcaatcaatcaggtagcaaaattgtcatcgccctcatgtgcaatcgccaccatgacatgacgggatgtacgacgactggacggaggttctcaaatctcaactcatttacacgcataaagctagcacggccttccccactttgcagaaaccgttgggcctcaaacgtgacagtg

SEQ ID NO: 1091 - DNA, 1472 bp, Zea mays
  misc_feature (1)..(100): optimal_loci_110490_G1, chr3:114860348..114861819, Cluster 7
ttagcttagcacaataggatgtgaagaaacattgttgtgtcgtcttggacgcttatgtgggaaaaaaaactaaatctattcttctttggtttctgatatattaaggtctgatgctgacggtgctttatttcttctttggcggaactataacgctaaactctctgattttggactttctaaacttgggctgaccggtagcaagtcacatatcacaaccagggtgatgggaacgtttggctatgcagctccagagtacgtagcaaccggtatgtgtcctcctgcctatctctcaccagctccagagtagtagagtacgtagcaaccggtatggaaacaacgaacgaagcttctgactggcctgcaaatttgcaatgccgccgatgggctgcttgcggtacgcttagctgctttcctggtgggctttgttagaagacaattaaataataggcttttaacctgagaggaaatatgaacttgcatggcaatggacaatggtgatgaaggaatggttgggtttgaccataccgccaccagtagtaatgaacccataaacctagcgcgcgcaaatgctgcacgagacagacagtgttcagacgagtgtatacctgtctgtgtgtcatagttgaggatggcgttcattgctgtagttactgaactcgaagccagcatgcatgtatggattacaggtgcatctctcatgctatacactcgttcttgaggcaaagattgctgtctgatttacaaagcaacatgagctgttttgctggaagatcatctgaacaggagaaacttgtgagtattgtttcctaatttgatctttcggtttttaaattcatacacttagctttccaacattactcgtttttacccttagtcgtatttttccccctcagctttactcttcggctactatatagcagaagaacaaaaccgagtaaaaaaacacgactaatgataaaaatgaggaatgacaaaactgatagggtgttcggtttaagaaataaactcatgatgtaccaccttaacttgaatgaaatgatttctcaaaccaaacaatctctaagattatatagattatatgaatactggacgctacccacactaagcgcaacggtgcgactgtttactagatctatgtagaacgctttatcgcgcaggagccctgaaaaacttgccgttgctatggatgcggtagtccgggatggaacactcgcactctaaaaaagcacagtacgtgcattttgatttggaatgcgacaacaacttactcggtagtttgagagatcctcagaggccaacttgtaatgtatgaaacatttagcgagaaagagagagaggaaataaacagaacacagttcttcgtcagttcacagctccctcaccatctcaaatcggccttctctcatacgagtttttttttttctatttcctatattttcaaataggcattctttgcaatgcgagattttttc

SEQ ID NO: 1092 - DNA, 2028 bp, Zea mays
  misc_feature (1)..(100): optimal_loci_111796_G1, chr3:123403968..123405995, Cluster 7
ctctgtctgctgccgcattgtatatatataacaggcagctactactagcctcctccatagctactactagtagcatccattctgcctctacggctgcattgcaacaggcagcagcagcaggtcgtcagctagtagctcgagataaacggcatctgtcatggcgagcaatttaatttaagtagagtaaatggaaggttagcacatctccctcactctctgtctttttgttttatatatatgttaggatttgcttggtgacgcgcgcggctgccatgcacgcacacgcacccgttccaaagggatgcatgccactagctccccacgtttgcaggctttattacttcactgtcgtcaactactcaaatgcgcctcaccaataatgcagcagggaaaaaaaaagggaacaggatttcggcgacggaacgcgcgggaacttttggatgaaagaaaaaacgtattgtttgcacgtggttgaaaacgatgtattacgatccatatcgtagcaggctagtacgtatacaatgttatcagaaaagctttgctctgaaagtaatcctgttcgaatcgtcgaaatatggtcacaacctctgagctctgcgtctgccttgggtttggaataatgcacgctttgctgcatctgcgttgggtttggcattcatcgactggctgccacagtcgcgccgcgcgcacgctttgctgcatctgcgtacgccgggcactgtgctgtgcttgcttgggagacgaatggatgcgcccgcgcgctgccccctcctgcctgttccgactgttcgtattcatgaatcatgatgacgatggagagtccagctgctcaactactgctgcttcataaccacccacaggctggttcacttgtctgcttgcttgcagccaagccaagccacgttcatcagtcttctagacgtcacgtggagatgggttctgagacctcatgtcatgacttgctgctttcgaatggctagttcttggttccaggagggtgtagccagtacagtagcgtggcaacagaaaggagagacttttggccggccgcgcgcgtgtggcatgaaaaagaaaagagggagggggctcaaggtcattacaaacagaaacagcctttcagggtgatcatgcagcatttgatggtggccatggaacatctcatctggttagctaaacccccctgcgtgtttagtttgtcctgctgaaagccgcttttttggcgtgaggagacgaggggccggccggggcaccataaaatcaaccatcacttaccaatgaaatcccttctctctctctgtctcactcactttaaccctttcacttctttttgtttttctctctagcttgggtgacatctcagagtacgtgctgcccgcctttctccctccacttccaagattctcattgtctttatccagagagagagagagttgatatatatccaccaccaccagcacgcagtactagactagacatatatgcatgtcatgtcactttgtaggaatgcttacaaagtagtagcagcagagagaagagaagaaacaaaaaaaagagccaccacaacaacactagagaatggtactatactactacgctagagacaaaggaagtcatgcttcaatacacccgagagaacgcgagagaagggatttggtactgaatgaactgaatgaattcaaactctgcgcgtggtcagtgctgagaatggtaaaaccacttgccatctaaggggctgttccgcaccataggaattttctgggggctgtttatttccatatatggtttggatgaatccaagctttccacccaatccatcgagggattcaatccctaaacccaatcaacaaatatttgttcgtttattccatatagaacaatctaaaaaatggaaactgaatagcgctatctgaaaactgaataacgctatctacaaactgaaaactgaataaactcaatcaacaaacaagctgaaaactgcagtctgaataacactatttttttttgacaaagtagagacgagcacatgta

SEQ ID NO: 1093 - DNA, 1672 bp, Zea mays
  misc_feature (1)..(100): optimal_loci_114546_G1, chr3:139526566..139528237, Cluster 7
ggtgactcggggcacaacggtcagctgcatattggcttggacaatattgagctccattttagctggaaaacggagtacttcaagatacctcttccttcctccatgtgatatgaaggggagtggtttttcgtcaggaatgtggctggaagtgccccaccgtttaccggttggaaactggtatcgatggaggaatgacaccacgaggcagaggtgagccccaagagtgaggtggagcatcttctagtggtgatccagatgttgaagcaacgaggtctcaccggtgcgcagctggtgcacacacctttatgcatcgctagatttagcctttgatgggtcatcagaagccgatgcaccagaactcttgtgtcaacaaccccgacctccattcctccacaccgcacgcattgactgagatcgaggctagggtcaaggttgtcacgtcattgtcattgggatcctttatggatgaggactcgccccttcccttttctaaggatgttgtgggcaccttggtgagttccttcttcctaatgttttcgttcctttgtcttcctctatttgttccatctgacgtggactccgcaggggatcggtcccctagcaacatgtcttccgcccctccctaagggtctcaccatcaaggcagagcagaagcggaagagggacatagaggaggagaccttggcggcacgctcaaagtgactcgaaacgaagaaaaagaaaagggcctttcaccctactcgtgtgaagccgagtgtgtgcctctttcctctgaatcggaggatatgacatccactgcctcagggggaatggaggtcctcgtggcggttggtggtccgtctcactatggcgatgctcaggctagctccggctagagggacggtctggctaacgacctagccacgcttgcggtttccttggagcgttgcatggagtccgctggctttagggcggtgagggagaagtggtgcaggtggcaccatgccctccggtgtcctcgctgtcgctaagacaccgtgcggggaaagagcctgtgggaactccctcctctgcggcaaaagtggcgtcttggacggtgcttcttgcggcgacgccacctcaggcgccttcggtggttgcttggaagaaggtgaacaccaggaagcgctcctcgcggtatgttgggttatctcgctcctcttgtctttgatttcgatctttgttccatatttttccactgatttccttgattagcatgtatgtgcggcgcaaatcagtgaaggacgcgacttctgcggcgaggggggccttatgactccttcgaccctcaagcctcggtcgttgaggggaacaactcctttgaccgtcatggccattctgccagccgacgttgtttccacccctcgtgcgccgatccccctagttgccctggagacactaggagtgttggctcctcacgtggccctcctttagctgtcctctcccacggtcgtccctaagaaggcctcatcggtcggcatggtctgccttggtgggacctcgtctgtggaggtggtggttccgacttggtcgctgctgcccccttccccttgcctccgaccgccatgggggtgagcgcttagtctgggggtggcaccgcctctagaggtagtcgagtccttggagtagccaccatttgccaacgttgcctcta

SEQ ID NO: 1094 - DNA, 1693 bp, Zea mays
  misc_feature (1)..(100): optimal_loci_115348_G1, chr3:144615062..144616754, Cluster 7
tccactttgggcggttggcactattataggtgctacccaaaaggtcaatttgcgatacactagaaagatgggtattgtcaggattctagtgggagtgactgatgttgatagtattcctgaatcgacagatattgcggtaggagaagggttgtatgaaatttattttaaagttgacaaagtgtgcaaagatggtgtttggaaggattataagcaagaggtaaagaaaggtaaaggagatgatgatcagcaagatgaggactttgatagtcttaatgattatctacacaagaatgaggctgcctttcaagatactgagatggaagataaatctatggacaatgatggtaatccccaagagaacaaggatagtgattctcataaacaacattctgcgcaatttggttcccaaattcggcaggctgcgcagcatcacctgactttttcttatgaacaaggatagttgattctcatgaacaaggatagtgaacctactaacttttgggatgtagctttacctcctttggtcgctgctcaagaaggacaaaatatctaggggtttactccaatgcagactcagcttctttgtcttgttcaacaacagaaacaccgaactttttgcttcaaggttcagtgactaatttagtgtctaacttggggactgttgctgctagtgtcggatgccaaatgtttataacaggaaatacaacagcagatgctagatgtcttttctcaatctccttcttggttctattgggggccagcaacaaatgacacaaggggatgttgctccttctgagaatctgaatcaaatgacttctcccctagcaacagctgatatttcttttacttccttaaatatgtcaacagatgagactttttcttctcttcttcatacaaaaagaaatattttctttgaaccttcgtctgttccagtacgtgtcaaagccctagagtcgagccttcctgatcatactcttgatacacaaaaatgtgggacctctgattttttacctccttttattgaggtacctcgaattgcactacaacatctgtgcaaaacatttaatataagagctaacatgatttttttgaaatggcacatgcgcttgaactgttggctcagacagacaatattgtcttgattactctacaagaatggtccaaaaataattcttactcaaaggtcaaagactgggccaacaattgctgtggagaatttggtaactagcaggaggatagatttcgatgaggatattatgagcaaggctcagcgcttaggagccaagcgtaatttggaaaacattgagttcttctttattacttttaagcctaaagttattgcttctaacttaaataatgttggaatccgtcttggtagaaacgattatgaagtattaaattcaattgtttccatcaagaacatagaagtggacatactttcactatatgctaaatctctctctccgattatatcacgaactttagaagaggacgaggaggttgagattgacgcaaagctctcccatgcatgttactaaaagatgggatgagaatgcaaagttgggtgttttatacttgtgtgtcatgaccttaatatcgtatcgcgttgaaaaaaaactaatcactttaaatcaaaagggaaggtttcttgcctacctaataaattagttaccccctctaaatttagtttaca

SEQ ID NO: 1095 - DNA, 1534 bp, Zea mays
  misc_feature (1)..(100): optimal_loci_115698_G1, chr3:147185424..147186957, Cluster 7
tctatattaatagaggtggttgccttaaagcgcccacctccgttaacccattaatcgaggcaggcatagtatccacctctgttaatcattgattaatagaggcagaggccatatgttagaggcagttgcaatgtccacctcctaaaatcattttgcctgccaccattaatcattgtggtagtagtggagatagaacccaagggatagataaaccaatgtatgaatccttttcgtcatgatggttagttcttccttcctcggtccaatccttcccttgcgcttgatcatcatagggacctagatgtcacaatgcttgccaacaccctcaatgatgagatgtatagtaccaaccaagcatacttggaatacattttattttgtgtctagcaagaaagatggacccgcctataggacgattccaataacaaacccaggacctctatcagcgctcgaggaagttcatacccccaaatgctgccaatacacattcaagaattctaatatagaatggtacagtggggcctagctattaggaccatcgctccaaggttccatacctcgagacctcccctggcctctactagggtaggtgcttgaccctcaagaaatttgatcttgggccactccaaaaggatggcatctacaccaccaagacctgttgagaacaactaataaacctggggccctctttgtcttgaggcacatcaagatttagggcgctctgcacttatggtggtagtctacatggatggattaaggactaggcccctagggcccctcatgccctaggtgctcgtggtggatttaagtgttcagtgcccttcaagcaccagggcattcaatcaatgacacttatctactcgaggcctttacttgtcgttgggccttaagatcctcgaactcttgtattatgaacgactaggcctcaaaccccttggggaccaaggcctcccacgaaaacaagggacttcctacgactaagtgtaatcgtgtccacacaatagaagaatgtgcttggccccactcccactgagggcattatagcccccaaaacaaaaaacctatacctagggcatactgacaggtccataactctagcatagtgaataagtttcccatacaacacattaaatatgtgatgtgtgacattctatcttgacatgcacactgtcatcatgacttaggcaacatggtactctggaccactatttggtatgtgcatcgaccctatagccacacatgcctatgttagtgtaccataaagtattattaagtatagaaggctacaccggctaccaagtgtatcgtacccaacggcatgggccctaacgtccatagaagtgacataataggtatggcagccgatgaagaaggaaatcttcgacactatgccatgagcgaaggcatggctctgcatacgactttacgaatagaataaaagggcatgggctcttagttatatccaaggtccaactgatgtaacctctctcctcccttgatctttaaaaggtggggagtagagtaacattaaggg

SEQ ID NO: 1096 - DNA, 2396 bp, Zea mays
  misc_feature (1)..(100): optimal_loci_115875_G1, chr3:148298052..148300447, Cluster 7
aatgctaatggtgcaataaattactgtttttattcttctttcagctctacatcaactagctatttgatacaattattgtggatgcgagcttacatgtaggtctgccgctcgctttccgcgaaggctggggaacatgtgccatgcatgcatgctatgatgccgggcgtgaggagcggcgttggcactgtcgaaccaaaaaatcaggtgctgctgccatgccgcagacccgcagtcctgcaccgcacgtaggtaggaaggactgtacgtgcgtttttttcaagtcgctttgtggtacgtagaactgatcgaaaaaaaaaatcaataaacaaggaatagaatggctatgtcgcatcatactgggaaaccaaacactatctaatgccccatttagtttctagtcatctaactaaactttagttagtcattagagtactacgtttgtttttagtgactaaacctaactaaaaaatattaattggtgcgattaatgattgcattatctctattaattagtggatgtctgttgcactaagaaagatgagaggacaaatgaggtaaaatttctacttaagtcccttttagtcatcctttagtgactaaagaatttaaatttagtcacctcattttagttacggtatttgcttttttaaggactaaaatgactaaaagttagtcactaaactttagtcattccaaaccaaaccaaacctaaaaagagacttatttatttattttatgtgtatgacaccgtcaacccaagctagcaatggtccacctccatcccccttgcactttggttattatcaaccggaggagcagcaacagcacgagcagttagatgatcgattgcgtcgtcgccccactgacagatcaatcgctcgcccggccggctgtcccgtaccaaaaaagttgccacaacaaccaaaaaaggagcatggaccgtggattggaccgttcggtccagggaggaacgatctacacggactgtttattaattcatcggcacattgctgctactacgagctgctcatgtatgcgctgttgcttactcgctatatcagtcagtcttctgcatgccctctcaacattgtttaagctgtactgattaagggcctgtttagatccacctaatttttttaaaaaaaattattttatagaaactgagctggtttcgaacatatcagtttatgccacagattatagaaatttgattcacatgtttcttttaaaaatcaagaagccagcctcttctatcttaaaaaaaataaaaaatggttttgtaaaaattggattgctaatttcaaacaatacctagatctagtggtttctaataattcaagtgatgatgcccccatcgccatcaccatcggagtatatcatcatgcacgcttcaccttggggcgggtggtggtgatagcgatcacgtcagacaggtttggcaaaagcacatgccgctgccgctgccgctgcgcccagaaactcgcggcacggtcgcgaacaagggtttagttggcccgtaccgtacaatggtttatttattttttgtttaatagttataattgtttgtatgctcgtatgtcctctcctccctcgacggcgacgaggcggtcgccaggtttggcgatgtcagtcgcgaggccgacagcgatgttcgcatgcaggtcggccagttgctacactagctgaaaacacgagtacacgtagttgcgtggcatcggcaggacggcaggcctgtaccggaggggtggagtggttggttgggtttggttgccagcggtagccgccgcgccccaccgaggaaaagggggaatgcacggtgagcagaaccacgcgagcgagcacgtgctgtccaacgactcacgactggtccgcggcgcacgggcgggcgcagggtaccgctaccacacgaatggttggttgggatgctttttgcttggttcgacttcgctctcgctgtgtgcagtgtgcagctgcagactagtactacgcgccaccacggagtcagggacgggactgctgcggggagtacctgtaacagtgacagcattatgggagtactcggctactcgccaaaaaaaaaagagagtggtactatagggttttttatacgatcaaatcccattaactttagctatatttattaaaaaaacaccagcaacgtttacatctctaaacaaatatactacaaaaatatatctaaagacttttctcccccccccatctctctctacatgataaaaaactacgccatgtgatgggggtaaatgaaaaaaatatagatgacctttcgtgaagagtctgtctctccacgatcctccatacatattgtctcttagatttatttatgatttaaagatttagtgttgtatcatgcaatctcttatctgtctattaca

SEQ ID NO: 1097 - DNA, 1761 bp, Zea mays
  misc_feature (1)..(100): optimal_loci_117811_G1, chr3:159555413..159557173, Cluster 7
catcaattacggcgttgaataaaaatggccacacatatggagtactagtatattacccgtacctggctggctgtagtggaagtggaaatggagagggccggccgggcatggaaagcaacaggcaccccacgtgtaacgtacgtgcagcagctttcagagcctggatcgtccaggcagaaagagacgcgtactagtatcacgtatgcgcatgctggtctagctagctagtctcttgttgttgttgatgatctgctaccagctagcgttgcaatgcgcaggcaaggcttgcatcgcctgctgcactacatgcagacatgcagtgcagcatgcaggtcgttctccgaagaaaattcaagttcagccggtcgcgatcgatcggtcgacgtcgctgtaaaacatgcggacgatccgggggcaggcaggcagcaggattcgatggctccatccatcctgcttcatttctgggtgtggttttggttgctgaccgccggccggcaaccgcaccgcgcgacgcccttttttttcccattccttggggcgcagtgcaggtgcagtggttgttggagcagatcaaagtcccgcacccgtctctttcttttcttctcgtcatcaactcatcatcgtcatgcggcatcatctccagagaccatcaccacgctggaggctttagcttacagctgatgataatcttctttacgaatctagcttattaatccacttctacttacctagctctagctctctaggcgtgcactgcaactgcaactagcgagagcacattgattcgatcagttcctgtggatcgacctggagactgagaatcagccgagtgctctctctcaggacaacgcaacgccggatgatctgaattggttcttctgcagatgacggaagcgctccgaataattgggtctgtcctttaaacttttgaaaaaacacaaataaagtagtactatatatatgtatattctttccgactttgcaaaaggtctagctgaattttaagtacgcggtgacgacactgacgacgcggcgctgctgggctacacgcgtctacgtgcaggcaggtaaaccacttcgccacgcagggtgtggtgtggcatcatgctagctgggccatgatcaggattgggaaaatccggttatagctgctatgctaggcgccactacatgctactaccacacaaacaaaaaattagatgttgttgactaatggcgatgcggtagatcttagatccagactttgaaccttctcgttaatcatttttatagacaataatggaacaaagtccccgcctctatgtttccgcacttagcgttcacttgttacaaattttggtttaccggcttgcttgaaagggaaaacaataatcgaagacggacaaagtctattattaaatttccatccgaatttggcaaagagagctccagcgccgctacctccagcttgaagcttcttgaacgaaaacttccccttatctcctcatactgcagtagcgcctagtaccgcaaccagtatgttccccgtgtacacagcctgcaaaaatgaattatattttgcattgttaagacaaatatcgtttcgacatcgccaaatagactaacacaatgccgctgccctaactagaatcagttttctctcctttggggtgacatctattagtcacccttgaagcatatgtgagacagatctgggtggatttaaccccgtagttacatatactaccctctaaatgatttttttgcatgatgacagtcggt

SEQ ID NO: 1098 - DNA, 2863 bp, Zea mays
  misc_feature (1)..(100): optimal_loci_117866_G1, chr3:159802094..159804956, Cluster 7
gggtgcaagaagtaggtgccatgttaggtctggggcctatatatactctatatgcacggggtagctagctgcccttgttctttttccacatggaaaacacacacagagagtagtcgccgcaagcagacagatgacaaatgtccctgatgaacgaaaccctgtcgatcagaaccggggaggtcggatttatcattttctccgtgactaatcctggctcttacactcatcagctattaaattacgcggcggccgacgtggacggggtggtgccggatgcggcacccgtccggctgtatacgctttacctgcgggggccggggggtcgctttcgggacaggaggaggactcgtgatcgatcgatcgatcgaccgatcccttccggctggctacgcggtcaatttaaagcccagaagaagaagcaggcggggcagctcgcctgatgtcagagcgcaggcgagcggtgtcgaattgcctggcacggacgcgcttggcttctcccgcgctggtgatttgtaaaaagccttaatctttaatttgcgaggctgtccggaacctaatccagcttcgtactgctacagaaaagcgcccggccgtctctggattaacaatgcgcgcttttggtcctgcatgcgctagcctgcgcctacagcaggtagcagcagcagttgctgttgctattgttgtttaacttatcggggaaggagggaggcagggttagttagcttctcggtggtgttgtgtgtgtactgctgcatcatctgcttagatcagtcaggcatgcgtccgttgtgcatgttgattgctgcttttgcttcgttctgaagaggaagctggcggagttcgtataagcacgtcactgtagtctataacacagtggtcgtcgtcgggcggatgctttgttcgcttcgggttctgctgcagctacaatccccttctcctagcctgcttccttcgggattaaagccttttgctcgctcgttctttcaaaaacatcgccctgttcgtgcatggaccaccccaatagtctctctgtctacgttcttcctcaccgaacaaacaaggcctgctcttcagtgcacgaacaggcagcgagcgtcaacagcagcagcaagaggacccgaggccggagccggagccccctcaagactctcccttccctgacgccgtattattttacggggaagtgacgccatggcggtggcggtgcgcccccggaccccggtgggtgcgtgcgcgtgcgcgtctgcgtctgcgtctgcgtccgtccccgtccctgtccccgcccctctgcactgcggcgtgctctctcgcgtcccctcgccatcagacgcgcgcgcatccaacgtcaccgaaacgtcgagcacagtgtgctcacgccagtatgtcacggagggacggggtgcagtgcagccaaaggaaccagggcgcgaaagagatcgagggggagaggagttgttttgttttccttcctccagctccacggtagtagagtagccatagtcaggggcggacggacagatggggtaaagtgggacatgaccctccctcaattttaaaaattcctatatctgatgttagctcaatttttaaaattcctatatcttatgttaagtataaaaaaatagaaagttaggtgggctaaaacagtctcgtatgtatgtctggattgtctcgatctctttgttttagttctcatatctatctattcggctccattttttctgacatcacctgatccaatccgctttgacaccctgtttctgtgacgcgcgacgttatctgacctcgctccctttctggctctattctttctgaaagattgaatatttggattacactagaatattcacttttgattgtgaatttggagattagataaatagttgatgattattgctcccttttatttagatatctaaatgaggagattttttaccgttttaacggggtccacggccggtggttaggacggtaccaatgtgaacgactcgtgtattgcacaaataagaattttagaataaacaagtgttgaatgggcatttaatctagatgaaatagttgtatatccagccttaagaacacaaattgatgattaggtcattattcgacgattgatgatgagatcaatattcgacgatttttgcaccggtcagcaagaacttaacgacatatttacttatttttttacattgtttctttctttgaacttacgcgtattgaattctatgcggcaatagtttttatggtttgtcgtgtgatttttttggctttctataagttcccgtcctacgtccgccactgagagtaggtgttgcagatggagttcggttctgatcgcatggtttaaaatttttaaccccgctgtctcgatgcggcagttagttaaagattgttatcctggaggagtagccatgacatgggcctatatatgcaggatgtagccatagatatacacgtactgagtacgacagaacagtgcgcactcgatccgttgctgtcggaatttacacggcccttccaaagtattcgggggcaggttcggttccacgttcagactgacatcgtcttccgtttgtttagtagccgttctgagcagagagaggatcgtcatgctttattttgaacccatcagatgaatggtatgcaggcgtagaaaaggtcgacccgacgtatggctttaacagtacatatatatatatagaattgaagctgtgtttttacatgaactgtactctagtctgcacactagagttacatcgcagcgcaggtggtagctagcagcctagcacatcggaaggattgattggtcagaagtcagcaccttagcttcaggttatatatattatgtatacctatatacaat

SEQ ID NO: 1099 - DNA, 1772 bp, Zea mays
  misc_feature (1)..(100): optimal_loci_119456_G1, chr3:170057544..170059315, Cluster 7
taaaaataatatttatagcacataattaattagtattagtagatagatcgctgaatctattttgataacaagattatttaaaaatattactaacattctataaaaatctagttaaatataatctcgatgatgcatggtatagcggccgatgagaaagtcaagagttatatacacacactgacacacgatgcatggagacgagcaacgacctcgatcttaaattgcacacacacacgatcgcggagcttcttgagcatctaacaattaaaaccgtggccactttatgtgcagtagtaagggggcaagagcagagttccattcaaaatctccacgagcaatatatgacaaataaacctagctagtagctagctttattccatgccatcggccagtcgtccaaggacaagaacaaagatgtgttttgtatgcaaaagacattggcgtgatgacaaagtgcgtactgcagggacgaagcaattaaagaagcccgcccccgcgccgagaaacgaataactaataactagagcatcactgtcagataagaacatgccggccgtgagccctactaccctgcgcacagtgtgtgtgaggctggctgtgacccagcagagattccagcatgcatccgtagctccattagctcggcatgcagtgtggaccactgtatcgcgtgtcagcactcagcagtgtctgtgcatatatatacgcactttagggcacaaatatacatatgcacagcatgcatggggccggcggggcctccgttttgttttgtcgttgcctcgtactgtgtgtagctcctcgtgaaagaagaaacaaccagggtgggtcgtcttcgtagtagccagagggacagatctgatacgcgatggttaaaaatagcgtccgaagctgtcagacagtggttgttattctttttcttccgaacatcgatctgcctatctgctgctgctgtaggcaacggaaacccggcccagcgtctagatctatcgcacgtcgtcgctagctagctacatggttcgtacatggattccttccctggaccacgtgcgttttggcgtgggaggggacgatgaaggcgcgcctctctgacaggtccatgcatgcacacagcaacgcatgcggagcgcgcgtggctccaaaaccatgcgcccatgcagctcggtcgcgcgcgcgcgcatatcacgggcgcagaaacaaattaaatagagttcgtgtgggattcattatattgttaaccgatcgatctttatatatgtcagtagtgagaatacattcttctgttttttttaatttgtcatgacaagttttatgttccttctaaccacacgcacgcacgcacgcatggacgatcgagtacacgtcgacagacgaccctacacgtacgtacggaagcagtcatttcctgtctcgttcgagccgcatctgcgtaacagtagagtacatcagatcgacggagcatgcgggagcagtggcgcttctcgatccgacaggtgaactgaatcggccagaaggtttcgttttacaaataataataacctgtcgtggtcatcgctactaatcgccaacttattaactcaccgcgcgcgcggcgccagaaagttccaacgcagacgtgggcgggggacaaaaaaaaaattgtcagtaaatgcgcatgaaaactacggcggcgacggcggggcgatgtgtctgtctggtcgtcgatccgcagtcgtccacacgcgcgagaaagaaagaagaatcttagctaatcagtgggcgggcgcgcgcgg

SEQ ID NO: 1100 - DNA, 2074 bp, Zea mays
  misc_feature (1)..(100): optimal_loci_120002_G1, chr3:173550485..173552558, Cluster 7
ggcgcttcttctcttgttcgttcatgtgggtttgtgtgtctgaaggggtttggttgcgtaagagcttttgatcctatctgatctctcttcttctccctttgccctgaggccagcctctcctttttataggctgaaaaaagggtcgaccaacagtggcttttctgggaaggagtcacaaggcaagggtaaaaccagcgttttactctggatagagccacgcgtactcatgtggggcgaggcgtggcagacgacatggggcgacaatggtcacatacggcatcagtatggctatgccgaccctggcctccgtagccggggcttggcgtatgccttactaggcctgccttggattctcctgtgcacccggcacatggactggatgtataatggcagatgcggtggtggcgcagttggtgtgtgtgagccgcgttggtagtttctggtccaggcctctttgcttatcatgggctgtaagactttatcatatgtaccagacgtctccgaggctctctcggtctctcctggcggtggcttctggacatttgcgaccattttgcagctgttagctgatcgaacttgaagaatggtggctcctctttacatacgtttcctgacgtggcaggagttgaaaactcgtgataataagaacttgcggaggttgccggttggttgagctctctgtgcgcattccgtctgggcagtctcttaggttgtagaagtttttatttcgatttgcgaactattgtaattgtaattgtaattttgttcccgatgagtaaatggaatttccgttcgtccgtggctggcgaaaaaaccggagagtaataactcaagataagaaagaaccgcagacatttacgtgagtggtcactggtcaagctggacctgatgcttcccggtagcaaagattgcatatagaggagcatcgtcatggggctgcggctgctaaagtgcagacccggaaccttcagttcccgacttctcccaacctgaccgcatggacgtgaagctgggcaaagcgactgcaggatataaaaaaaggcgcagcagaattgacctggatcatgcacgacaatctgcacctgtttcagggccgtggcctcgctgaaacggtcagtccggttaggcgagctcctcctctgactgttcatcgcaacgcaagccgttcagctacacgcgtcttcagtctcctgcagtcgcagtcgcgcgcacgtaggagccgttcagctacaagccgttttctaagcatacctgcgcgtgctagctgttgttgggacttgggagagtcttaacaaacccgtcaatggcagcgcgaaagccacggccgaaccgtgacgagttcggcgacgcgaatgtgcgatgaaagctacgtcggtgtagcagctgagcgggggtcaaaacggctgcgaacaggaaggagacgagcagattccagtcctacttttatttattttatttatctaggatggaagtcaactgttgcttactctatggatctttttttgttattatttacaggagtcaggctcaggacttgttctgcatgcatcagttacggaacagaaacattagaaaagtaggtgtctttgttttgatgaattgttccatctaaaatgagatggtgcatcatatgtccatttctcaaatttggtgggataactctatctctcgtattagtactaactaattgataagttgatcatcttatttcagaaaccaaacaaaaaagtgagaaaataacagactagtccgttactcaaatcaaacatgttattagagatgttttagataccgcgtggctgatttcgatattttagattagataccgcgtggcaagcatcaattacggagcataaacttctcgtgcatgttttttgcagcaggaatcaaaaggtactggtacgtgtctgctactgtgttgcgtagaaagttctggtcttctgaggcatgcatcatcatctatctatctattgctgagatcgatcagtgcaaagaacaggagagcggggagaagagtatcggcaacacaccagggtaccgtttggttcaaatatttgtaacgtaatgagtaaat

SEQ ID NO: 1101 - DNA, 1871 bp, Zea mays
  misc_feature (1)..(100): optimal_loci_122516_G1, chr3:187013875..187015745, Cluster 7
gtcgctgcctttcgccgcgctccaaacaatgctgccatccttgggcaggagaagctccagctccagcctccaggacgcgcgtgtgcgtgcatccggccctggccccgtccgtctctggacgaccacgatctgcctccgcaggtggtccgatgcatccggcacgcgcggaccccacacgcggtggctatcctgagctcgacacgcacgcctgtgcacgttaggcgggtggcggtgcactgctccgtcggtccgtccctgaaattcggttgcatcggacggttggccctgtgaagcaccagtagggacgatgcactgcacagtagcctgctcgctggcggatggccaggcccgagttcagggctggaggctgtttgaccgcgggtacgttatactagtacgtgtgacagccctgcactgcactgcattgcgtgcacagccagtaggctgtttgcaggctagcagcagcaggggcgaaaaaaacggaaagatactgtacctaccgcgtcaggcttcacggggaggccgttaattggcttgggttctgccatctatttttttttaaaattttcgttgccgtatttgattttcaaaattgcgatcctcttcgctgaaatcatgagatgcatcttatgaaggcaggtacgggcacgtcaggttcaaggctaaatacccgcagaaatggaaaaaggattcacaggtatcatcaatctgcgtggttcgaccgtcaagtgaaaaaatatgcagctagtcgtccagtccgagcttgaatggtgtttgcacctagtgtacgtacagaaggtaatctatctgtactgtactgtactactgtaccacaccgggtcaacctcatgcatgtatttgtccagtactgatattgctatttgaggacataaatatacgcgttttcaagatcggagactcgcgctcgcctcctagctacctagtctgtgtgactgtgtcagctatgtctctacgtttgaccgatggagtgaaacctgcagcaaccaagcaacggtctgcgtagaacacgcactccatacgtacgtacgcgtttcgttttcaaaaggttacgagtcgtggactcggtgctagttcgtgtactgtttctacgtacgtactttgtgccttctgcatttgaccggatcgaacgtgcaccaccttcttcgtacacaaaaatcgagcgtgccttctctcttacaggcttagggcatgtacgagccgtatcttacggggtgtttgtcactgttgtgtcctgtggtgtataatataaatttaaattattttaaaaattattttcaatctaaataaaaaaaaacaaaataattatctaaatatcttctaaaagcttgcaacttcaacttcacggttttatgaagcttctaatgaactgcctcttcaacttcaccaaatttggcgaaggtgaagcggtcccaaaacagtgacttaactagtacttgtttgggagagcttcacttgaagaattttaagtttatttcaacattttctatccaaacaggtttagctccatgagctctagctctacatgttagtttcatgattttttcgaagctcctcaaagggtgcttcaaaaacactgttttatacctcctcgtgaagttacacaaaaaaaatatccaccatatcattggttacataacttattgatttatgtctctttctccactcgcaagtcgcaaattattaagggtaagtaaggaaactcacacaaattaattgtattacagaagctggaacttatgcgcaagtcaaacactcttgaatccagtcttaccaatatgttcaagttgtttcatgtgaagctggaaaaccgaatctacaattcttgaagtgaagccctcccaaacagagct

SEQ ID NO: 1102 - DNA, 1506 bp, Zea mays
  misc_feature (1)..(100): optimal_loci_123098_G1, chr3:190155014..190156519, Cluster 7
ttaggggtcctgggaaactagtaatcagcatgtccgataccataatacgcgtccataattccagggccttgtcttgagccgtgctgtgcgcagtgcgtgtagtatagtaatgctgtactacttgtacatcatgttcatgtgtgtgtgcattctgcaaagcgccgatcgagtgagatttgggacatatccatactgtttgctccccctctgtctttctcccgtctgcttttagcaacagacaaacgcgagaggtcaagaggcccgatgtaccctggctgccttgcatggacgcctcgcctttgtcccccctcgtgtgggggcccttgctcgacatgcgcgcttatcaaggcatccatcattgcagttttctctcttgtcctcgtccccatacatttctttcccaaggtttacgtattgttcccaaatcccaagtcgcaaaggaggagaaaggtcgcatggggatgtgtgctggacatcacatgcatgcatacgacatgctgatcagtcgatacgtgtatgtagtgccagcgaaatggatgcgtgcacggcgtactgccacggatgtgtcccgaagccaagcgcgcgccgtcgtctacgcttctccggaatctggacgtttgtggtgtctggtgtgtgccacactgccataggatcaaccgggagaggaaaccaacgatggcgaactggcagctatctatcccgggatcgcatcgcgcggacatgtgcgaggcgtcggggtcggacgcatggcgtcgaccggatcagcaacgtcacgccgacgtcgagcgcacttgtgggagcgcgggcccggcccaggcgcacgcgtgcccccacggcccgcgcatacctggacacggggcccggccagattccggctgccgtcgcggcctctcgcccacaccccctgcccccgagatgtccagcgcctcgcggatggccgccgaggcgccgaccccgcacgaaagcgacggatcgtgcacggccacgccccgccccgcgcccggcgactgcgtgcgaatacagcggcaggctggcgggctggtctggaactaatcaactaacccacacaacaaataaagaacacgatacacgatcgagcgtggcatgcaaggtcagtcaacacccacaaaacatggatcggtttcagtcagttccctaaaccggagtggatcgaacgaactcttccaaccgcagacacgaccgaccacaaactatcactgtactactgaacacagacaggtacgtaccagcatgcaggagccaagagcgcccatctgcctgacgaagcgcgtaccaaacctccttcctttttaattaactaataattgactcccatcgatcaccaccaccactagcgttgaaaacggatgggtaaaattttgtctcgactcgtacccttttttacatttgacctaaccgtttccgtatttacggaaaaatatagcaacgagacgaaaacggatggttattgtaaccatcggctcttttcaatgacaagtgatctaa

SEQ ID NO: 1103 - DNA, 1995 bp, Zea mays
  misc_feature (1)..(100): optimal_loci_124293_G1, chr3:196445004..196446998, Cluster 7
ttcgtaacacggaacaaccttttagggcatgtttgggagtgaagtattttttacagtttctatgtgataccatggttttgggcagtactgtactattttataccatgaggtgggttgcattcctgaatactatggtttcaaaatcatagtatcctagataatatggtatttttgaagtattcgaaactccactccaatcaaagtttttatgatatggctagcttttgcctaataccattgttcacagtgttgtatctaaacaatgtttcttaaaaatatggtatttttgaagctatcaaaactataatattatcataacaattacaaacaatcatcgttttgagaaacattgtcgcaaagagtcacttattttccttttcctccacacacacgcccaacgtgtcggcttccgccgggcaaaatcctagtcccaaaatgtccgtacctggccgtcccggcgaactctccggtcgcggctcaggaggcggcggtggcggctcccgcccgcatcttcgactttggctcaggaggggcctgtcacctgtacgccccaaaaatgcatgattgtatcttgaaatttcagtatacctgtaacttagcatgaagcttctacacatgagtacttttttttctctcctgggtaacatcttaaggacaattcatgtggactatagacagaacgtgcatggaagtcctatggtctactttcccctcaaatcaatcaagcctaattgtccgttgactgttgtacacttgtgtctcatatgtaaggcccctttcctaaaccatggttgacgacagtcctttgtatatgaattggtagatgtaggctggaccgctggagcaaacaagttgggtagatataggctggactactggagcatacaagttgtcgctggttctgtcctaacatgtatcatgttctatttagaaattctctaacaaaacctgaccatatccaaatttggaggcagccccaatgcggcagtgctagaggcttctacatgagtggggttcaaagcatcgggttattattttgggtacccgaaaggcccaaacaggcccaccaagacaacagccagtcgacggatactggacttggactttagctgaccagcccccaaacagccaaatcggccaaaggcccaaatgcaaacgcttcctgtctacaacagactttctcgcaaccattttctccacccgcacagcagtctcagactcccagctatccaatgtgcatgtgcagcagtttccatcagccccaatccaacgttcaacagtatcctcctcctcctctaccagtgcaatgacagcaatctagcccacagcttgctcaggcaatgcaaccacaacatcctcctgtgcaaactcagataagacctcaagccccaccaagctaccctcattatccaccccagcagccattgaacaccacccctaaaactcttctcggcattgtagctatgcaaggagcacacaacgctgttgctccatcaggtgccagccattctgaaccgccatattacgtacggaggggttggcatcccactatctcagccaccgccactgcgccacagcacaacatgcagaggcaccagcacaggttagggctcgtttgggccacccctccaagcaaagggtcctacgctggccttccacggtggtatgcgccatagggcaatccgcaaggctacagcacatgctacgcttacccaccaagcggacctccaggctccagcagcagtccagccgcaacagttgcccccaggtggagtcgtaatgagccatccgggatcgcatatgatgcgtggccatccctacggagaaatgatggagaaggcgatcgccgagagtggccagccaatggatttcaacaccctgctcgacagactgaacgaagcagggtcgggaccaccacccgcacgcgcgtggtgattggtgttagttatgtgacttatgactattatcatgcagctaactcgctaaccttaaaat

SEQ ID NO: 1104 - DNA, 1652 bp, Zea mays
  misc_feature (1)..(100): optimal_loci_124740_G1, chr3:199261794..199263445, Cluster 7
tatacggctacgcttcatcagttagctctggcagcgccagccgtccgtgcttctcatgcatcgacggcggtcgtaccgaccgttaatattacaacaaagacggtaaaaggttggacgagcgcaggaggacgggtcgtcgtcagaaagcgtgagagaccttgtgttgtgtaaaactgcacgagacatcgaaccccagaaccgaagcgcatgcatgcatgcatgcacgagtcccgcctgtcagttctcagggtcactattctatttgcgtggttagtaaaggcatatatatatccgatgcgctcgcgaatgtcgaacggattatggaccgatgctctggttgagctgaaccgatcagcgatcgatgcgtcgtaacgtggacacatgaaaggcgaccgttcatctgactacgaaacgacaaaggtactgtaacgtggaccacatgacaaggcattcaggacatcgacgtcgacaactatatatatcctctaataactaattgaaaacctttgaccatccatgttacccctcgttaattatttttttttaactctttgcgccaccagaaactccacaagttacccctctaccttgtgccagagcagcaagcagtttcagtgttgcatacaggataggagccattttgcaccggaagtccagaacaacaaacagttccagttcccctttccacaccattttcagcaagatatcaatgttcacagttcagggcagggcatttgtgatccttgtcctctcatgttacctattttaagaccaagattcttgagtccattttataaaacatcaaacaatcattgccctactgttccatttatatttaggaaacttaaaaatttaggagcccaagaattttggaagctccatgtcgccggtccatttatgctgggcactggacgtgccgcctactagggtgacggctatgtatggattgtggtaggtgttgaataagtagacattttaaaatttaaatttaaatataaatcatgaataacaataaataatctagcaggttgtttcccatcaggctaggatagtaaacagtatgcagttcacatctataacagcagacaaactgaagaacgagactaggtcagatcacatctataacatcaggctagtaaacagtatgcagtccatttacaaactgaaggacgagactaggtcatgaacaacagtatgcagatcacgcatggtggagaaaaaaaagagagagatgcacacggtgaaggggaaaagcagtgcaatggcgagcacgccaataaaaaaacatgagggtactttgcccattcatcaattttagctggttttggaacagctaatgagataacaacttttttttattagctaagaggcatttagctaacattttagctagtaaatgcgtccaaattcactctagcctatatggagttcgaaatgccacgagccctcccgttgcttttctttttaaatctgctgggccaaaatgggaaatttccgcaacaacctgaaaaggaagaacttcatatcgggtttatcctgggctcggaaagctctcccctttcagcccaactgtacgtctgtacttaccaagcagccgagcaggaggaaaacgaactaggcttggagccctgcgactgcgagcaaccgggaac

SEQ ID NO: 1105 - DNA, 2345 bp, Zea mays
  misc_feature (1)..(100): optimal_loci_125230_G1, chr3:201937208..201939552, Cluster 7
  modified_base (1778)..(1778): a, c, g, or t
  misc_feature (1778)..(1877): n is a, c, g, or t
  modified_base (1779)..(1779): a, c, g, or t
  modified_base (1780)..(1780): a, c, g, or t
  modified_base (1781)..(1781): a, c, g, or t
  modified_base (1782)..(1782): a, c, g, or t
  modified_base (1783)..(1783): a, c, g, or t
  modified_base (1784)..(1784): a, c, g, or t
  modified_base (1785)..(1785): a, c, g, or t
  modified_base (1786)..(1786): a, c, g, or t
  modified_base (1787)..(1787): a, c, g, or t
  modified_base (1788)..(1788): a, c, g, or t
  modified_base (1789)..(1789): a, c, g, or t
  modified_base (1790)..(1790): a, c, g, or t
  modified_base (1791)..(1791): a, c, g, or t
  modified_base (1792)..(1792): a, c, g, or t
  modified_base (1793)..(1793): a, c, g, or t
  modified_base (1794)..(1794): a, c, g, or t
  modified_base (1795)..(1795): a, c, g, or t
  modified_base (1796)..(1796): a, c, g, or t
  modified_base (1797)..(1797): a, c, g, or t
  modified_base (1798)..(1798): a, c, g, or t
  modified_base (1799)..(1799): a, c, g, or t
  modified_base (1800)..(1800): a, c, g, or t
  modified_base (1801)..(1801): a, c, g, or t
  modified_base (1802)..(1802): a, c, g, or t
  modified_base (1803)..(1803): a, c, g, or t
  modified_base (1804)..(1804): a, c, g, or t
  modified_base (1805)..(1805): a, c, g, or t
  modified_base (1806)..(1806): a, c, g, or t
  modified_base (1807)..(1807): a, c, g, or t
  modified_base (1808)..(1808): a, c, g, or t
  modified_base (1809)..(1809): a, c, g, or t
  modified_base (1810)..(1810): a, c, g, or t
  modified_base (1811)..(1811): a, c, g, or t
  modified_base (1812)..(1812): a, c, g, or t
  modified_base (1813)..(1813): a, c, g, or t
  modified_base (1814)..(1814): a, c, g, or t
  modified_base (1815)..(1815): a, c, g, or t
  modified_base (1816)..(1816): a, c, g, or t
  modified_base (1817)..(1817): a, c, g, or t
  modified_base (1818)..(1818): a, c, g, or t
  modified_base (1819)..(1819): a, c, g, or t
  modified_base (1820)..(1820): a, c, g, or t
  modified_base (1821)..(1821): a, c, g, or t
  modified_base (1822)..(1822): a, c, g, or t
  modified_base (1823)..(1823): a, c, g, or t
  modified_base (1824)..(1824): a, c, g, or t
  modified_base (1825)..(1825): a, c, g, or t
  modified_base (1826)..(1826): a, c, g, or t
  modified_base (1827)..(1827): a, c, g, or t
  modified_base (1828)..(1828): a, c, g, or t
  modified_base (1829)..(1829): a, c, g, or t
  modified_base (1830)..(1830): a, c, g, or t
  modified_base (1831)..(1831): a, c, g, or t
  modified_base (1832)..(1832): a, c, g, or t
  modified_base (1833)..(1833): a, c, g, or t
  modified_base (1834)..(1834): a, c, g, or t
  modified_base (1835)..(1835): a, c, g, or t
  modified_base (1836)..(1836): a, c, g, or t
  modified_base (1837)..(1837): a, c, g, or t
  modified_base (1838)..(1838): a, c, g, or t
  modified_base (1839)..(1839): a, c, g, or t
  modified_base (1840)..(1840): a, c, g, or t
  modified_base (1841)..(1841): a, c, g, or t
  modified_base (1842)..(1842): a, c, g, or t
  modified_base (1843)..(1843): a, c, g, or t
  modified_base (1844)..(1844): a, c, g, or t
  modified_base (1845)..(1845): a, c, g, or t
  modified_base (1846)..(1846): a, c, g, or t
  modified_base (1847)..(1847): a, c, g, or t
  modified_base (1848)..(1848): a, c, g, or t
  modified_base (1849)..(1849): a, c, g, or t
  modified_base (1850)..(1850): a, c, g, or t
  modified_base (1851)..(1851): a, c, g, or t
  modified_base (1852)..(1852): a, c, g, or t
  modified_base (1853)..(1853): a, c, g, or t
  modified_base (1854)..(1854): a, c, g, or t
  modified_base (1855)..(1855): a, c, g, or t
  modified_base (1856)..(1856): a, c, g, or t
  modified_base (1857)..(1857): a, c, g, or t
  modified_base (1858)..(1858): a, c, g, or t
  modified_base (1859)..(1859): a, c, g, or t
  modified_base (1860)..(1860): a, c, g, or t
  modified_base (1861)..(1861): a, c, g, or t
  modified_base (1862)..(1862): a, c, g, or t
  modified_base (1863)..(1863): a, c, g, or t
  modified_base (1864)..(1864): a, c, g, or t
  modified_base (1865)..(1865): a, c, g, or t
  modified_base (1866)..(1866): a, c, g, or t
  modified_base (1867)..(1867): a, c, g, or t
  modified_base (1868)..(1868): a, c, g, or t
  modified_base (1869)..(1869): a, c, g, or t
  modified_base (1870)..(1870): a, c, g, or t
  modified_base (1871)..(1871): a, c, g, or t
  modified_base (1872)..(1872): a, c, g, or t
  modified_base (1873)..(1873): a, c, g, or t
  modified_base (1874)..(1874): a, c, g, or t
  modified_base (1875)..(1875): a, c, g, or t
  modified_base (1876)..(1876): a, c, g, or t
  modified_base (1877)..(1877): a, c, g, or t
  modified_base (1880)..(1880): a, c, g, or t
  misc_feature (1880)..(1979): n is a, c, g, or t
  modified_base (1881)..(1881): a, c, g, or t
  modified_base (1882)..(1882): a, c, g, or t
  modified_base (1883)..(1883): a, c, g, or t
  modified_base (1884)..(1884): a, c, g, or t
  modified_base (1885)..(1885): a, c, g, or t
  modified_base (1886)..(1886): a, c, g, or t
  modified_base (1887)..(1887): a, c, g, or t
  modified_base (1888)..(1888): a, c, g, or t
  modified_base (1889)..(1889): a, c, g, or t
  modified_base (1890)..(1890): a, c, g, or t
  modified_base (1891)..(1891): a, c, g, or t
  modified_base (1892)..(1892): a, c, g, or t
  modified_base (1893)..(1893): a, c, g, or t
  modified_base (1894)..(1894): a, c, g, or t
  modified_base (1895)..(1895): a, c, g, or t
  modified_base (1896)..(1896): a, c, g, or t
  modified_base (1897)..(1897): a, c, g, or t
  modified_base (1898)..(1898): a, c, g, or t
  modified_base (1899)..(1899): a, c, g, or t
  modified_base (1900)..(1900): a, c, g, or t
  modified_base (1901)..(1901): a, c, g, or t
  modified_base (1902)..(1902): a, c, g, or t
  modified_base (1903)..(1903): a, c, g, or t
  modified_base (1904)..(1904): a, c, g, or t
  modified_base (1905)..(1905): a, c, g, or t
  modified_base (1906)..(1906): a, c, g, or t
  modified_base (1907)..(1907): a, c, g, or t
  modified_base (1908)..(1908): a, c, g, or t
  modified_base (1909)..(1909): a, c, g, or t
  modified_base (1910)..(1910): a, c, g, or t
  modified_base (1911)..(1911): a, c, g, or t
  modified_base (1912)..(1912): a, c, g, or t
  modified_base (1913)..(1913): a, c, g, or t
  modified_base (1914)..(1914): a, c, g, or t
  modified_base (1915)..(1915): a, c, g, or t
  modified_base (1916)..(1916): a, c, g, or t
  modified_base (1917)..(1917): a, c, g, or t
  modified_base (1918)..(1918): a, c, g, or t
  modified_base (1919)..(1919): a, c, g, or t
  modified_base (1920)..(1920): a, c, g, or t
  modified_base (1921)..(1921): a, c, g, or t
  modified_base (1922)..(1922): a, c, g, or t
  modified_base (1923)..(1923): a, c, g, or t
  modified_base (1924)..(1924): a, c, g, or t
  modified_base (1925)..(1925): a, c, g, or t
  modified_base (1926)..(1926): a, c, g, or t
  modified_base (1927)..(1927): a, c, g, or t
  modified_base (1928)..(1928): a, c, g, or t
  modified_base (1929)..(1929): a, c, g, or t
  modified_base (1930)..(1930): a, c, g, or t
  modified_base (1931)..(1931): a, c, g, or t
  modified_base (1932)..(1932): a, c, g, or t
  modified_base (1933)..(1933): a, c, g, or t
  modified_base (1934)..(1934): a, c, g, or t
  modified_base (1935)..(1935): a, c, g, or t
  modified_base (1936)..(1936): a, c, g, or t
  modified_base (1937)..(1937): a, c, g, or t
  modified_base (1938)..(1938): a, c, g, or t
  modified_base (1939)..(1939): a, c, g, or t
  modified_base (1940)..(1940): a, c, g, or t
  modified_base (1941)..(1941): a, c, g, or t
  modified_base (1942)..(1942): a, c, g, or t
  modified_base (1943)..(1943): a, c, g, or t
  modified_base (1944)..(1944): a, c, g, or t
  modified_base (1945)..(1945): a, c, g, or t
  modified_base (1946)..(1946): a, c, g, or t
  modified_base (1947)..(1947): a, c, g, or t
  modified_base (1948)..(1948): a, c, g, or t
  modified_base (1949)..(1949): a, c, g, or t
  modified_base (1950)..(1950): a, c, g, or t
  modified_base (1951)..(1951): a, c, g, or t
  modified_base (1952)..(1952): a, c, g, or t
  modified_base (1953)..(1953): a, c, g, or t
  modified_base (1954)..(1954): a, c, g, or t
  modified_base (1955)..(1955): a, c, g, or t
  modified_base (1956)..(1956): a, c, g, or t
  modified_base (1957)..(1957): a, c, g, or t
  modified_base (1958)..(1958): a, c, g, or t
  modified_base (1959)..(1959): a, c, g, or t
  modified_base (1960)..(1960): a, c, g, or t
  modified_base (1961)..(1961): a, c, g, or t
  modified_base (1962)..(1962): a, c, g, or t
  modified_base (1963)..(1963): a, c, g, or t
  modified_base (1964)..(1964): a, c, g, or t
  modified_base (1965)..(1965): a, c, g, or t
  modified_base (1966)..(1966): a, c, g, or t
  modified_base (1967)..(1967): a, c, g, or t
  modified_base (1968)..(1968): a, c, g, or t
  modified_base (1969)..(1969): a, c, g, or t
  modified_base (1970)..(1970): a, c, g, or t
  modified_base (1971)..(1971): a, c, g, or t
  modified_base (1972)..(1972): a, c, g, or t
  modified_base (1973)..(1973): a, c, g, or t
  modified_base (1974)..(1974): a, c, g, or t
  modified_base (1975)..(1975): a, c, g, or t
  modified_base (1976)..(1976): a, c, g, or t
  modified_base (1977)..(1977): a, c, g, or t
  modified_base (1978)..(1978): a, c, g, or t
  modified_base (1979)..(1979): a, c, g, or t
cactagagcctcttctcgtggaattacacaacttcggtgtcgtttggtcacatatttgtaacgtaatagttaactgataacgttaaatcatgtttatttaccgtaatcagataacacactaaaaattgatatcgacgtattcaaacttgttaccgccgatactcgagtgcaaaccattatcattatcatttacgttacatttcgtgaatcaaacaacaccttcatgcggttctagactcctttaccgaagtaatgggggctctgcatcaactatgggaaaagaaccctagttccgatccatgtggattcccatgagaggctcaatgtttctctagcatccttcagtgcagcatgggaagcttcccctgccatacattgggctccctctgtcagtagtgccacttaaacatagggatgcctgcaccaaataatgcagccgcctgctcagtctccttgggtggtctcaacatttcatgagtcacgatgaatcggacaatacttgttttggctggctggctggctggtcactggtggctgcgtctaaaacccacgttgtggccaagacttcgaaatcttgcagcactagagctctgatggtggcatgtgcatcacagttcgcgagcaaatgcactgcatcggcatgctgatggaccgggaccgccgcagcgtcaagggaggtaataacgtcgtcgtggagcccaaagctttgaaatgtgcgtcgccaattcgccatgttcttggtagatacatcttagaggtggatgtggccactggctgtcccctgcagacgccacactcactcggaagccctgttgataaagcggcgcatacacccatcgaagcaaagcggaagcagtagcagacctccgatctgaatctggaaaaaaaagttggaagcaattagcgattctgcagcaaaagggcaaaagacgagtaggaatttctcgtggttgacgacggtgcgtggatgagagggttaattaatactagttactagcgttaatcgttcgtaccgccgcacgagggagcgggggtgggggtttaacacagagcgagaggtggctgctgctgctcagctcgtgctcgactcgactaacgataggacaacgacggctcgggaggcgacacctgccgcccatgacctgtgacaaaagctccctagggttactaatctaatcaccgtgtttggccgctgctgtgtcagtctcaatgatggttaattaggttgatggccgaaaagcacaagtgcactgcattcatctcaccagatcacagagaacgctgaacgccgacaggcctttgtacggcaccagcagtaatttcagtagcactgaacgtggaacacaacttgagaggccgaaggcaagacactagggtcgtgggcccgcacgtaactacggtccacgcgacggtggtgggctggtggcccagcggagcggacagagtactccaccatgtgctgtcgcttttcaaagggtagagaggcgaagagaagtcggcaaggcgccaagctactagatgctactgctagcaggtcccctccgtgcatccagtacgacggatgctcgtgctccggtcgataggagcacggccataacacgcgtcgtaccacggatgtctctgggcgcacaaaacgacaaaacccaccattcatgtgtgttgtgtgtccgtttcaacgtttttacaacggcggtcaaagattgtacctacggcaatagtctcctacctatacgactattcaattacaaccacggcaatggtcgcgggagactagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttcccccccctccgaaatttgagggcctgttttaaaaaaagcccccgaaagggtttttggggggccctccccaattcccggggagacttaaaaggggttgcaagaacttgggggaaaaggttccttcccttggcccgggcctctttttttttcccgggccatttgtatctaaaaattacatcaaaataagtgtacaccatagtttgtcggtagaacctagagatttttcttctaacacaattgcggctgaaaaaaattcaatctagcgcttgaattattcgtgtgtggccaaaaaaaaaaaattagctgctgaaatccaatcagcgggtcagaacttttggatgctagagcgttttactgct

SEQ ID NO: 1106 - DNA, 1494 bp, Zea mays
  misc_feature (1)..(100): optimal_loci_126640_G1, chr3:208700302..208701795, Cluster 7
ctctctttatatatataaagacatgagaaggagatctggtgaattgttattcgttgaggtcagtgacgaaaatatcccatagtgaattaaagttactttcaccgatgagaatataatcaccaactaggtcaactgtagaagtctaaccgtgacaaaacatagacgcgtgacgacaaacatacatgcacacacaatatgtgattgattggcaacagttgagaaatgggtcaactaagtacacgtacatgcatactgtacatagcatgccctaataagtggtcgtttggcattcttctttcttgggcagcatgagtagtgtgcatagtcaagatgttgtcacaaattgccatctttttggcaagattaggccggccaccaatcaactcatgggcatccccttattttgtcaatgctatatatataagacccggtgctggcccctccctccactcatcacccaagtgttcccggccttatcagaatatagttgtcacctctctctctctctctctcttgcacgaaatgcaaagtgagtcagcccccttttttaacacaaggatgctgcccatttctgtatattctgaaaacgccgttcctagacctgccttttctgcctgttttcgtggcttttgttgcaaccgcgcgcggacaacaaatcattgtttctctaggctaggtgtaaccgtgtaccacaccagcgtgaatgcgtcacgcatgatcgacctagctagctagtagtagcagaagcgatcgaatgaacaagtgctgtcgtctcaatgctttgccctggcaacaaaggctaatagcaggcaacttcaataaataatggttatttgtgtgaggtactcgatcgtatgcatttgacagtgtgtggctgatcagaggttaaagagtgcctatttatttaattatgaggagtgtagagccatagtaggaatggagaataaagctcatactctcaccacacatgcgcccacttctaaataaatgctaaagcatcctactgaggattgatgtgaaatttcgtcgttaaaatatctgcaacgaacgttaaagttaattaccagtgaattaaccgccgttcatgatggacggacgacaccactgcgagggtttagatgccaggagaaaactgaaagaatgttggtgtcaaagatcttctatctggagaaggacttaataatggtggggacatgtgtacatacaaggtaaatctcgaaagtgtataatgatggagcacgttgatcattcaaatattctagaagatcttttttttaaaaaaaagtaaaggtgatttcacctagactagggcaagcacaacccaattaaatgaggagtcttttgagaggggtctctaggagttaagtgaaaaaacaaactctctatacatattgtgtcttgactacatttattatctagaggctcaagattgtatcatgcagtctcttagttgtatcttatgttcaaaaaaccgttccaaaggctcagtgttgt

SEQ ID NO: 1107 - DNA, 1588 bp, Zea mays
  misc_feature (1)..(100): optimal_loci_127038_G1, chr3:210603611..210605198, Cluster 7
ggtattggattctaacatctctaattacttcgataccaaacctactacgtctaaacggggtggtgctagttttattcctttttcagatcctaacttcttcaaccaccaaatctattgttctataaagatttcaacaatgtttgtgtatcttctaagtggcctgatggccctaaaacaattttagatgcatcttcctggcaagcccatacgttttgttgcggtgaatatactcaaacccgaagttagtctggagagtagaccaggctagttttgtcggctgtgcgttatgagactcaatcattcaagccttcttaagtcttggagaagtgagaattcatggagacaacggacagatcacagatcggggccaaggaaggcatgcgctgcaccgcagcaccggcgtggtcgcttgcgcacggagccgggcaccggcatgcgtcccgcttttttcctcggccggtcgatctcactggcagtctctcttccagtcttcctcagtcactggagcctgtgctgttgctgttggcactgtggttgagcgcgcgcgcgcgcatggccgcgcatgggcgggttacacgatactacatgagttacgtgtggacaggcctctcccgtgccgcaggccagccagggccccccgtgcccctgccgtgcccgtggcagctgggcggaaaggcagacagcgcgcgaagctccacacacatgcgcaggacagacagctactcctatctcctatctgttgcgccctacgaatgtcgcagcacaggacaggactgtccttcccgtccggcgtctgcagaccaaccggacgcccctctttgcctttggccttttgccttctttgactgcctggtctcgggctctgtctcgtcagtcaagcagctctggactctggtacgatgcatgtctggtctgctgttgtcgtcaacacggcaggggtcagatcagatgatggcatggcatgccatgggatgcatgcgtgcgctcgtgctcgtgattacaaccaaccaagcctgatctcggctgcacttgttcggcagatgcaactggtgtggctatagcagcagtgataatctacagggcctttcagtttggatttctgcagtgctgcagctgcggccaccagacaagtgcagcggatcagggcttttagggcaaagtggacggacttgcatactatccgacatgaatgttactaatatatttccgtctatacgaatatgtatttaaatatccgatagttcagatacggattgccgtgcatttaaatcaactatatatggacgttcatccaatttctaaagaaagaagttacgcaatgagaggttgaaatatgtgaagtatattaaacacaatacatatcaacaataataaaagtacattgtaatcggggttcaccaaaccggattaagggtaaaaaccggcgtccaccgataaccgattaatctcgataaatcggtgaaaacaagaaaccggccaaaatcaaaatcacctcagttttgaattctaaatggttcgaagccgattaatcggccgataattagcttatgacctgctaaaccagcgtcacagaagtagaaagagccat

SEQ ID NO: 1108 - DNA, 1592 bp, Zea mays
  misc_feature (1)..(100): optimal_loci_128517_G1, chr3:217654371..217655962, Cluster 7
ggcatccttgacttgagaccatagggagacgcacggaaggcgaagactctaagttgtagggcccccatgcgtaaagttagcccctaagggttcaacactaggtgtaaataagcctaagccaatactgtttcgtaattacgccattgtgaagtatattatgagaattaggtacgaacatactttagaccttagcctctacgtcgccctataaatacccccgtccggcgtgtgaataggagtacgggatacgcttgacaagacatcgagctttcctgtgttgttgagcatcgttgtatcaccaactcccgctataacttggatccacgtgtcaaaaacccaacaaatcactactatatgcaacagcataacgcaaaattataagtcttcatttgctcggccgagatagaagatatatataaatatgttgttgggcaataacaaggtctatataaaaggagacgattctaacaattttgccgagatataaatgtgtcgttccgatagaataagcattgtgtggaaaaaggtgttgagtcgctttagatataggtagtgtttggatgaagggacgcagaaggatgaagagggatgggatcattttaacttgacccgcgtttgatttggaggtctatagtcagggtcaagaaatgtaattcaaaaatggtgcatgaggccatccctcaaaaaataagggacgtggtcgacccaggattgatctcgtcccatccctcgttgacaccgaaccaaaacactactttcggtcagtttcgatagaataagcattaagtaactgtctcgctgggctttaatctttcggtcagtttcggtacatgtctggcccggtgaatgtcgtactgcatgggtacccgcccacttggaagaagatgaagctcaccgctagtagtagctaagctttaccggctttatttggacggacgcccctggaaccagttgtcgcgcaacgcgcgacgccatccaatcatccgaccaggcgtctgcgcaggctggctgtcccacaatactacgggacggagacgggtaatatcttttgctcggctgacacagcgttggctcatggctgggcggcgatacagagtcacagataccgccgccactagctgccgccttcctcccgtcctccacgggtcgggtcgggtcccgggtgcaacgacggtgcggtggagtcggactcggagcgctctcttgtgggagtgcggggtgcggctcgcatgcggcatgcatgcgtgcagtgcgccgtcggtcgccaccctggcccccatccagtagatcgtcgttcatcgttagcggaaaggcgcagtcgagtgcgtcggccgcgacgacttgcggatcggtccggcgaccgagcccaacgcagtgtggtgtggcctcagctcgatcgaccggtcggtccaagcactgcagccaaagctagtggtctgttagaaaggtccagcgtgcgcctcttcagcctgcaaagcggagcgcatttccgcacgtactgttaagagatagtgtatgtgtatgtgatctcattggaccgaatgcgatttgtcaggtagatgaaataaagagcgcagcgcactcgagtagac

SEQ ID NO: 1109 - DNA, 2104 bp, Zea mays
  misc_feature (1)..(100): optimal_loci_128519_G1, chr3:217657322..217659425, Cluster 7
gtatgtacacgcacgcacgtcatacatgcatgctagctacatacacgctataccccccttcttccttttaccagattttgccgtgatccgtaccgctttgtttatgtggacaatataagacgacgtggacgtgaacgtcccatgttcagccaacggccattgtaggattgtacgcgcgttgttttcttctgtaaacaacagggtttggtcgacctgtactgtacgtatctgtttgtgtgtgtgtgtagtagtagtagggtccagtctgtgtcgtcgtctagtagcttgccgcagttcatcgaccgaccgacctggcacttagttaagtgcgtcgtcgtacggcagctaggcacctacccggccgtgttgtgattagttaagttatactcgcgtgtgtttgtgtgtattagctgtccgcaactaatttaggagctagcgccgccgaaagatacatctcgatcgtgtgttctcttctgttctgcactagtactgtattgcgcgcggctctatagccaatacatctgcacagttgtacactgaatgtaccccgtttagacgctgctggttcagatatgatatgccctgtgctgctgacacggagtagtagtcaaccaatggagttacctaatctgcctaatctggaacaaaagaatagcaaacggaatatactacatacatgtagaaaataatacaaattctggcggtagactatctgaaaaattgactagatatggtagaaaaaggctatcaacatttatatgacactaaattttatgttatacaaatataaatgtttgtatagggttgatcaaacttgagatgatttgacttggtactacgttaaaaatttgtattttttatgagattgatgcaatatataacatatgctctttgttattgtcgctaatatagaaacatcttcggttacatcatattagctaatagttatgtctagagttgagtccataactaataagcaagcaagcatgtattattcatattaattccttgggttttggaaaactaaccagcccgtgtgttaaaaccacactgtcgaagagactggatttgttttaaatttccttaggcctgactctttcaagcatcgtgatgtcgagcgttccagttgcaaccttgccttcatatacggccgcctggttgttttcagttgaatagtatatatatatatacagttaggaccactatataactaatataatacacgcgagcaccaagagcagagaggccactgtttcttctcaagctggatgactaggcaggcatcgtacgtccctatttaatttctccatggactacatgcatatttggcggtgttgctgattttattcagcttagctattcttctattgcttgtcagcgcattatgcacgtgtagcatcgattcggtacgggatttatgtagcaggcacataattggttcagatgccagcagccaagtgcatgcgcgcggctggtttccagacatgcatgcatccatgaactcctgcctccttcttcggcatatcgaattcgggccgggggaggggaaagaaaatttctggaaattcgtgttccaggaagctccccccccaccagctagccaaagagagtactctcgatctgcatgattgcgctggaaattctggcatggattcttgaaacagtgaactaacacttcgtcttgctaactaggattagtagtagcttcctagctaggaagttgcacgaaccgcacgtactccgtactactcggctagctagctacctagtccgcgtggtctaaacgaaattgttggaataatatatagaaatagtgcttctgagtcatgtccttgggcggtgtccattgccaattttgacatgggatcagtgtatgagcgtacttgttatactagagcgtgcatatagttaaggtcatatacagtagtgctcaggtaacacaaaataaaaagacgtaaggcggcacatgcatgctccgtatccaagaggaatactaggaaggtctagtttttcccccaaaggaaaagaactacagaaggctctagccagtgttttaaatagcgggaaaatgaatttatcttccaaaaagtgcaaatatcgagat

SEQ ID NO: 1110 - DNA, 1437 bp, Zea mays
  misc_feature (1)..(100): optimal_loci_139762_G1, chr4:44502864..44504300, Cluster 7
taccaatcctaaaaacattagataagccaaaagatctaacgttcggaaatcagttcaaaacatatctggatcaatgaaagaatgtcgacaattgcatcgtcgacacaatataggatgtagattattcatcatcttcaatccttgatttcgtgcaaccatcgatggatgatgtgattgacgatccaaagtaagtaattgtccttgttaggagcgcctaggagcaaccctagataatggccgcaatgcaaaatggctgcctgccaataaaatcgacagttgcaccagtgacctcgtcgttgcaatcatcgaaaccattgcatggaacaagatcatgacaaaagataatatatctgacttcgtcgttagatttatttagcctaaatcttgaacaaactaactagatctaaaaactacgaatgaaagatatatattggatctcctttcttcttacacacatgcgatgcacctgacgaaggaagaaggaaagaggccaggacgacaggagcaagtgcgctgatggcggcaggcaatacgcggccgcgccctgctagctacttcgtttttagtcacactgcaagctagctcgatgtgactgcagacagtaatggctaccagcttgattggcaccggtaataagtttataaacaccagaggctgaatcccaaatcctactacgcagctaatcacgctcacaattaattgttctagctctatagcgcactgtagctagcaacactagtcgtactacactactactagctatgactactatccaaacgagagatgcagaaagcgatgaaggagccattaacggcccagactttctttcatcatatcagcaggtctgtcaacaatcgacagcgcgaatgctctctctctcagtctctcgttgtcgggggttccgaaagggaaagcgaccaactgaagctgaagcgcgcgtcgttgtctccggccggcgctgctgtcgccgcccatcaccagcgacatcaaggccggcacgccacagagaattgaaggccgggcgggcttcatgaaatcatcgccagccgcaacagtcgccaccactcacaagcgcccaagcttacgtgaactctacgtgaacacatctgatcgacgatgcctaaccaattaattgccccacccatcccaaatacatgttgatttcttacaaaaaaaaattgagtatactactcttataaacacgtaccatcaatgaaataccgatgatgaggctatgatcgatgttgaagttgacagaaccacataaagctaaaactaaaaccatgactcgatcgagcgcagtggtcccgcgcgcgtgtgcatgcatgcgccaaggcaaaatctctgtgtcgtgtctcgtattcatccgatcatcatatatatcatctccgtctctctcgctttcactctctcggcgcaaattaaagcaagcaatcc

SEQ ID NO: 1111 - DNA, 2161 bp, Zea mays
  misc_feature (1)..(100): optimal_loci_143055_G1, chr4:64113919..64116079, Cluster 7
aaccatgcggggcatctcaacgaactagtcttgatttcttgtgagagagagaagcgaacgaatggccaaagaggcggctctgcgcgttgctgcggatctgtcaggatggcaggtgctgcccacgcaaaccgccaagaaactgatgaaatacacgcagataatatactgcacgtctgcaggcgacactagccaggccagcttgctgacgctacacgtacagggccacacagcagtatacgatacgatcgagtggtccatgcgagcacaggccttggcaggttcaggaggcagctcgcgattaatgccatcaacaacactactggtaggctgtccggagctgttcccaacatttctcctcctatatatccaatgttgcctcacattagttagatccctctctctaattttccctctcctgcagtcgttcaccttctccatacaatctatcatccattaatatataaatttactctgaactaccacaactacctccatgtgggcaggcagcgaagcaactcgcgggcctgttgagatggcggctgtggcggcgattcacctgacgaaggtccatctactgaggttatcgcatgacgttgcgagcacgagagatgggtagacgaaacaggttgacgccgtgtaggggggcgcttgatctagcaggagagaggagtccaccggatagggggtcgtagagggcactgccgcggcgattagagggcaactgtggctttgtaggagagggggaagtgaagaggcaaccgttgaaggcagcaatatgtatcgtattttgtcagttcaaaaaaatgttgctataaaattttaatcggttagtttttaaaagttaattcagtttatagaaattattagcagtatcgataccttctagtaatttttttataaaatagatctttatctatctaatgatattaactacataatataaatattaaattttttatatttagttaaattttgaaaacgtttgattgtttgttaaacaagagcggcaatatttttatcacacaggaaggagttagctagctgaaacggtatatctactagagtgcctgtaacgtgtaccagctgctatataaattaaactgcggactgctccggcaagggcacttctgccctctgcatctacaattctgcagtaggcaggcaaaagttcggatgtccggattcatgaacggacatatgggtttatttttaaaatctatctctaattgaacaagccctacattggaacctgatctttgcatgttcaatttttttgaaacaaaccaaggaggagagcagccattatatcaataaagaggaagacctataataggcaaataacaacccaccaaagatgaatataacaaaaacaactgctacaataaaatctacgcccaccctactaacaacagcaacaccctaacaacaagagcacaagacaaaaaaaaactcagtagaacaaagacaaaatctaatgaaaaggcaaagaaacctccgccacaaagtcccaaaaggcatgaccttttaaactcaaaagcttcttgaggaggtcgggtggcaacaaactcctttagatggtctgtgcatgcttgaattgaactctcgttgggctttctgtcaatccccaacaatgcccatatctttaaacacactacattgtgcaagacgggcacttcgacgaagcgaagaactattataggacttacattgatgcctaactgttgtagtcgatggtgaggggggagctaaaggagggcatgcaagatcctcatcctctctagctttggtggatgaagaagacattgtctctatcgaaggatcctctagcagtcgaggttctgtattatcctcaaccatagaaagagaaggaccatctttgatggtagtaagaaagattggatcctcaaatgtcatttgcgcaaccaaggttgcttccacatcatctaatgcgtcctccaccaaaacatgttctatattgtcctcaatcatagaatgagaaggaccatcttcgttggtggtaagaaagatgggatcctcaaaagtagtttgtgcaaccaaggtagcttcctccttgtctgatgcatcctccatcaaaacaacatcctcaacagaggtgacaacttgaagcaacgtggaggtgtccgaaggcacctcaatgttc

SEQ ID NO: 1112 - DNA, 2124 bp, Zea mays
  misc_feature (1)..(100): optimal_loci_154770_G1, chr4:145378407..145380530, Cluster 7
gcgagggtgtgctcgaccctccattccatcaggggaacgggcgaggggcgccgttggaggccgccttagagctctctaagatacaagacccttaagtgccttgggacttgaaataatctaagttcacaagggtacaaaataatctaagtctctaagggcccttatgccttgggatactaatcaacaatctaagttcttgggccccctcatgctttgtgatgcccatgagattaagttcctgagtccctaatgtctttgggtcccttgtgatctgaggggctcttaagtctatgtccctaaggcctaccataccctatgatgctatggaggcaataggtgccaaggaagtttgtccacgagcactaaaacaacacttacaaactcgaggccatatgctggctagtccttaggagtatgcgacctcacatcgagagagtggccaggccctaaaccctttggagtccaaagcctcatgagcacaaaggactgagattggctaaatataatatagttgtaagaaagaaggatgtgattagacccatcggggataatgcaaccccaagggagaggcccgcacctagtgacctacaaattgatccataatgttagcttaatggataaatgttaggtacaatacaataaatgtttgatagatgaccttatgagtctaacaagtgtaatgttgccattacttaagatgtatggtactcaagaccactatgttatacgtgcatcgaccctgtagccacatgtgcacacttagcgtaccatgaagtataataaactataaaaggatgcactaactaccaactacatcatactgaataacataggtcttcatgcctataaaagcaacatatcatacctacccctatggtaggtatgacatccgcctaggaaaggacacctctgacactatgcgatgatcgagcatatgggtcccggtatgactccaagaataggataagaattgagtagttggatcatagtcggtgggatccaaggttcatgtaacctctctcatcctttgcactataaaagggagggttgagtaacatttcggggtattttgatccaaggttcacatattagagattttcctagtagacactcttgcacttgagttcatctagtatataggcataaaggtagattatgatcattaggctagaactcccactgcaaccatgaggtgagaggagctattttatgctcaccagtgtttgagcttgtaatgtctttcttctatgtattcatcaatcaatgagtggcaggaggatgtaggatattatgcacaccatggtatgaacctctctaactgctcacgtgatggatttcactcatgccaaggttcaacatgaccaccgacctacgtcatgcttcctcctaactttctccctctctggtacccttggtaccatggtgttcttatgcaacaacatctaccaagctaggttgatgggtgtcttttcttttgagtttgtcgtgttttgctatgtagcatgacgatggtgatgtcaatacatttgtcaatttgagcaggtgcatgtatctaacacttgctctagcaactccgaccatgagccatgccataggaggcataggaaaatcatgcagtccccataattatggcctccaccaggtggatttgccttagtgggctcgcacaacatggctcacatagcccatcctttgcttgcacccccactagggtacataatgccctaggagtgctatgttgcatgccccatggccctagaggagcataattgttatacatgtctcactcctctagcctcgcatcacgactagggaggcgacattacaaggatgagagattctccatgcattgatcagcttggtaggtttgttggtgccttgactttagtgccaatgatgtcattggccctctcgacaccatggaggctctcctctataatccattggcaacagatgccaatgaagctactacaaataatggagacaagtcattgtcaggtttatagccactactagggtaaaccctagcccatctctccctacataacatgacccaaagaaggctacatcgggtaggggtgagacttttgcacgatcttgggctccaaccatggtctctctagc

SEQ ID NO: 1113 - DNA, 1574 bp, Zea mays
  misc_feature (1)..(100): optimal_loci_158162_G1, chr4:164190779..164192352, Cluster 7
ccccggccagtccaaaagaacctactttcaagttaggccatcctttttataaaaatatataaacatttccaacatcaagtattctcttaataattctaaaatagctgtctgcacacattctatatatcttagttttgccaagacatataaaaatagtattaatatttgtattttcgggaggtcgtcgcccaaaaaaagagagagcagccggcagcgagactgtccatggtgatcgtaaagggcgcagcgacaatggcatctagaggaatgaggttctttttttttttgcgacttagcatagttatcaaaatatttaactagattttaaatagttcgatttagaaaaatccagaggacgatatatacggatcagccccggagccccccagccttgtggtcagtggtcaccgcgcgacactgtgcgctccactgcagcaacttggcagacaaggacggcgatcaggcggtggctttgcgtccgctcattgggtggttaacatgtagcttcgggagtccggtcgggccagcgcgctcgagtagataagcacttgcagtggtacggtaggagtaggacgaccccgtacgtcacacgcgtgcccggttgtcgacggtctcggtcgcgtttactagctcctacggtcgacgcctcacgtttagaatcaaaatatttaacacttccactcgattaagattttaactttggtccaaaagatgtggaatatctctacctgagttttgaggcatttttttttcaaccatagctaggttaatggatatgccgtgttggtatatatcgtttggtcaaatcgaacagctagctaccgccggtcggtacctgtccatccatcgatcgatcgatcgatcgatcaacggtggattggtggcagatggtatatacagtattgtttaggcaactagtccgtctagatcgaagctagatgactaggcttaatgactgttgaatgaagccctgtgatattgggcccctgcatgatggatggccagaggccagtcgatgaaccagcgcatgcagcagtgccatgcctaacaaagctagtagcactagagagagtgagagagcaagcgagaggaggacaaagtttgcctatttcttctgagttcttctgatgcatgccgacttggatcgatccattccagcctcaactctcaagtcgctgctagtagactgtagtatcatcgatccggcgagtccgtgtgtgcagtcacagtggtgggctggttggctagctgcgacgtcctgacttgtgtgagagagagagaggcgcgcgatgctgtagctactagcgcgctgtgacgtacggcgtggggtcgtgtaggagaggccggtagagtgctatagcagctacggcgagcgacggagcgagacagcatgacaagaaggtgacagcagcggcactgcacggcagctgggcgcgcgcggtgaggatcccaccaccacgaccaccaccccccgccgttgctttcggtgatccccgcgacatggattatattgctgtggcctctcgtctgtgggatagccgaaagcgacaccacacggcggggagcacagcatg

SEQ ID NO: 1114 - DNA, 1467 bp, Zea mays
  misc_feature (1)..(100): optimal_loci_159220_G1, chr4:171050368..171051834, Cluster 7
agctcatcagcatttagcctagaaagaaaaaattaaatgttttgtaaacaaaatcagcctaggactgaccaaatcgaggagccctcgccttctaccagagcgggagaaataaccccaaaaatttggcgccacgaattaagaaatcgataacattccaacgcacccaacccaagagacccgcgtgaagctgcaaacaaacccaaacctcgtcgttgtcatcctcgggcggaggcggtgaacgtggccgtggagaaaagggtttcggttgcggtgcgagccgtggtgcttctgtgccagcttcccagctacaatagagttgtatttgattagatgcacgacctgccaggacagtctcgccgccgaaactgacagacacaagaaagtggagaggttgcgatggggctaagaaaacacgggcattgtttgtggttgagaagaaaaaaaaaggaagaagatgtatattgtcatgaatcttgagcaggtggagcagatatgaagcaaacaggggaacctgctgccgcttcccagctgtctagagttttgtcttttccataattcaggaacaaagctacatatgcaacaagactggtgtcatttcggaaacgttcgttatgccgattctgatgacgaacgaaccaacgaatgaatgcaggcaggcaacttcagttttagctgcagaaacgagctaataggcatcttgtgcttccatatgctagcttcaaccaatgttccagcagagtaggctcagactagctcaaaaacaactttagtatgggctgggtgtgggcctttaatgtactgagtttattgagaactgggctgtgtcgttatgggccttgagtctttgtcgaaatgacttaacatactaccaattaatatggtttagtccattctaattaccgtttagtctctgctttagtcctaccgtttggcaatttagagactaaatgaaactactaacttttagtccatcaaatcaaacggggactaagattatgtgccatgatgcgtactgtgaggagtaatattctgtcacaatattcttttgaagctcgtgcatgcctcgcaagattctgagttcttttatctcttcctcgttcatttctcttttgcaacatgtacagtgtgagcagtagtctagattcagtgtatatagtagtagcaggagtagtaagtaatgcatccgcagatcgacgagagacaacagctagctagcagggcccggccggggtgtccttaaaacacgctctgatctggaccaagctactgcatgcatgcagcgtagtactacgtacagtacagttggtatagctgctactgggtgtagtgtagtgtagctgcttttatttccattccatccgccatcgcttgttgcactactactgctcatatatttccggttcaacacagtgacgacgtacagtacagcccatgtttcgacgaggagacgtgcatgcgtgaccacga

SEQ ID NO: 1115 - DNA, 2144 bp, Zea mays
  misc_feature (1)..(100): optimal_loci_170668_G1, chr4:231515593..231517736, Cluster 7
cacccagccagccacccacaattaaaggggccattagtataataacgctagtcccatctgattctgctgctccttgaggcggcccccctacaccatcaacgacctctctgttgcagacgacgactccgataaatacagggaaaaaaaagccatgcgacgtcggcacgctgagtcagtcgtcagtcgactggctagctactaggatcctccacttgtgcttgtgcagcagcacaactcagcaaaacagaatcaagcagaactccaaagacatggcatggcatcgtcctcacagcatcaaggaggggaggacgagggcgaacaatgcgaggacgaggacgaggccgcgccgtggctcttgtatatctgcatgccagacagacgacaggcgtacgtccgggcagcaagcaaatgcaagcgctgcgatcgagcatcatcggcgcggccggcagcggtagctagctgcatcaagggtcgtcggggcacgaggtcacgagcccggctagctctcgggggctgcacctgcactgcacccggccagcccatggtttccaggtcggcggcatgcatgagatgagagacatcatctatccgatcgaggccggcccaattcatttaataggcggggccacatgagacgctagcccacttgattactacgagcgattatcgccacatagccactactagtactaggtcatgcgcggcacaggccccccagcaggtaaatccctctccacctcctccacgtcgtctcaccatgccatgttgctcagctagtggagctagggcggtgctgccgctggggcgagtgctgcccctgctttgtaccgatgaatctgccccgggaagcgcggcaacagtacagtagtatggttttttggattggatttaaaaagagacactgctgcaatcctatggaatgagaaggatccataccgccattgctatactctactacatatatgtctcgagatatacgacacagatattactactactttacattgacgctggagctggactactactaacttctagtaagcgaaagggtctatagccaagttaattagctgatctaagtagcactccttaggttctaaatttgaattccagtagaaacgaattttagaccgaggttaaaaaaagtggttcccctagttgtgtgcacataacgggaagggttaaagaacgagtaaagatctgacctataagtgacggaccctcatattgtacgaggagaccagctttcgtaacctttctcgatcgtgaccattctcggtagagacggtctttttcttaccggtcgagttttttttactagcttttaggattggtttcagatttccaatggatcgaatgcttgcccgttgccatgccactctacctgatcttaaccggtcagttaagtagttagttactccagttagttatttcatcagaggtggggtggtctcgtcagtggatatggactggcagttaacatctgctgtgcagcgcacagcacatctgccgagctggagctggattgctggagctgccgctagcaggaaagcaagcgctggctcgtcaccagatcggactcgagagcgccagagaaggacgcacagcacattgctcatctcgtcttgtggggcgctactgtaatactgctaccgaaaaagggcaaggcagcagctgccgaaacgccaagcttgtgcaggccaatatgttggacgtggtcgatctcgcaaaggagtagattgcaccaaccaattcaacacaaaagattaaactgatagaaagaggtggaacctccactcacatcgagtcgtcgagtccagaagtggaatagaaacaagtaacaattattttattttaattatgctaactagaattcaaactcacaacttatggctttgatataatattaagttgtatgcaccaaccaatttaatcctaaaacttaagttgacagaagacttctacaatttacttatactatatttcaatttcaacaatagcaaggggccctgctcgctggcttgctggctcttgagcatccgcatcgcacggctctgcacctagccgcggcccaagggtacctgactacctgtgtctgtgtctctggtgactgtacccgagctactacagccaacgctgcacat

SEQ ID NO: 1116 - DNA, 1983 bp, Zea mays
  misc_feature (1)..(100): optimal_loci_172777_G1, chr5:2322428..2324410, Cluster 7
acagctaaagccttttgatcaagtgaaagaattgttggagcttagcagagactatcttatcaaccgtcgtggttacctagctaggcggccttttcagctccaaaaaaatgacgcaccctgaagaacttgtcctctagcgaacgatatgatatgatggctgttgttctccagatgcagtctgcacggacgctctgggtggcccaaagcgcagcagcacatgcatgccgcgccgtgctgtccgttccccgccgcgcgccgcagcaggctgcctgcctctggctgatacagacgctaagaagataagacgatagctcgccgatggatgcagactcgcacgagaccgagacgagacgacggtggccttttcgaaatttcgataccaacggctcgctttgctggagcgatcgatcgaccggatcggatcaaaagggaaaccggcggtgggtgcgcggcgcaacgcggtgggcgcgtgcacgccgcacgcccggccgccggcgactcgaccggcgggaggcgtgtgcgcgtagtgcacgtcgttgctttagccgtgtgtcgcgaccacccttacgtacgtaccctagctagcctagcctggcgatcggtatcggcgatgatggcgttgatgatccgatatggtcgatctatccccagcggcgaggtgtcgcggcacggcacggcacgcggcgacgatgatgtatctgcaggtggatggcggccgccccccggctagctagctatgccgcactgcggttgacgcactgcggccgcgacgtcgcgctcgctcgctgctggcagcgtcgcatcggcctacagcagctgctagctcgctacgtgcgcgcttagtgcgcgtggcgttggtggcatctatcttgcgtgcaagcgtcgtggtacagccgccgccctgccctcgaggccggccgggccacatgcatgcatgtcccgtccgcgcgccgtcgggccctccggcgaccccacgaaaaggagaggcaaaggcgaggtggtggaccgcggtaaagacagctgcagaggtagctagctagctaggtcgtcgatgtggatccatgtctgtgtccggggccagggccagggccgggcgggcgagcgcgcggcagacagggacgatccgaatctgctgtgaaagaaaggcggaggcttccccttgacgactcctcggctcagctctcctggacggccgcggccccatcccatccatggcagcatgcagtcagatgcagcgtagggcgccatggcttgcatgtgatgatccgtgtgtgcgcgcgccgcgaccgagagagattccacggtcaaaatggcagggacagcagcgcagctggggaggcggggcagggacaggaccgggacggggacggggacggggacggccggcagcaaagcgtaacgcaccaccacccacaggagcataaagctatacgtcctggtaccatacgttcccgtcgatccgatccgatccgtccgtcttatgatgaacccggccgcatcttgtaatgctgcctgcgtgtgtgctccacaaactaaactaaactaattaacccctcttgttcattctcgttgatttattttcatgcgacgacaattaagagatcggatggcgggtagagtgtgatcgagattcggaaaaaaattctctacagctggattgataagcggctctgcgacatggtttggatttataacacgagtccactttccaatagtcggcagttgtttctttctgcgtcagcatgatcaattaattaaggctccgttcggcaagccaggaaccaaaccagctcaagattaagtggatcctaggctgtcacttattccgggtcgacagcccactttcagcataggaattaatccggatagttggtcacctggctttattctgggctaaaaattgaagcggaggagttaaaaccaggcggctttgattctggtccaagacaaacgaacaactctaataaactacatcagattcta

SEQ ID NO: 1117 - DNA, 2121 bp, Zea mays
  misc_feature (1)..(100): optimal_loci_17413_G1, chr1:96609808..96611928, Cluster 7
agattttgatcacaagaggtaacaagggggattagtcagacgtagtggccctctgggagtgagaggaaggccaaggtaaggctcggggaaggccaagaccacggttcaaagacaccagctaagctctaggcaaagtcagcatccacatggatagggagtatggtggttttatggtagttgatagtgagcccggttgccaaggcaaagtcattgagagcaatctttatgccggtgagggctcccacatatgcctaataaaaaataagtgtgtgttccatgtactgaagaatgggacagggagcaccatccgacatctagtcgcaccaacgacgagagaagccccggtggagaaggattttgataaggctcccccaattaaccgaatcaaaggctttatgcaaatcaactttaaagatggcagagaggattttgctaccataatagtaacatagaatatccatggcatatgcataattcttggctatgttccttttttcacaaagccagtctgatcaccccgaacaagatccggaatatgctcatgtaaccttcgagtgaggactttagagatggctttggctgggcagttttggaggctagtagtgcgaaaatcaacatgagtcctagctgtcccttccagaacatatcttttttttctttaatatgtacgagcgaggacatctttaggtagtgtttggttcggtgttaataagggatgagacgggatcaaccctaggctgacttcattccttattttttgaggaatgacctcatacaccatttttgaagaatatttcttaacctgactctagacctccaaacaaaacgcgggttaaattagaatgatctcatcccatcgtttttcgtccttcctcgtccttccatccaaacattaatgacttgacaaaaagtccattaggggacaaaaagggagtgcgtttcctgagcgaagttaataagatgggtgacaattttgcagtcctgctcccgccgacgaatggaatcggtcgtcctactccatttccgtcaataagatgggaccggtagccggtgtcgtccatgtccatgcctgcgcgtcggaaacagagcgcgtcccgtgcccattccagtactctcgactctcgtgcgcacctcgtatgcagtatgagcgttaccaaggcacaccggtggacagcacaaaaggggttgggcttttttttttgtagcccacggtcttgatgcaggtccaggaagacagcacacaggtcagccagccattggttgggcgtgtgggccggccgggccccctgttacgtttctgaatctctctgaaaacggccacatgatttcgcgccctgaaacccgcgattacggcaacgactaaatagaaactgaaagtgtactgtataccctacacaagcgtaagcgtaacccgcgttcgtcttcgtcgaccccagtcccaacagaggttctccccactgcccaaacggagaagatcagaagaagaaggggaaaaggtcagtcagtacgtctacccctcctccgccccgttgtttgattccttcctcacgccgcctccgttcctttcctagtccgtccatgataggccaggcctaaagtactatggatgaccaggagaagcaagtcgatctcgcgtcgataggggcgcgggagcatgtggtctcgccctgatcgctggatcgcttgtcgccaggtccatctccatccagtcagctcctgcagttaagcatcagcccctcggtttcgaaagtcgtctagcttccgggtcgcaactgatcgagggtaccaggtcgcaactgatcattggtcccgcccgccgcacacacgtcagttctataccacaagtagcaatggagcttcgaagtcggagcctctttagagggagccagcccagatctgtgcattctgtttcccacttggggctgatgggtatattcggagtgacctggagattactactaatactactactagttaattgcttcctgccaaagctaccgcccttccttctcacctttcggccgctacacactcatctacaatcactgctaatccatgcatgcatcacagtaattaatcatcatccctgcctctgcctctgccttgtaaaaaaaactagac

SEQ ID NO: 1118 - DNA, 1608 bp, Zea mays
  misc_feature (1)..(100): optimal_loci_174709_G1, chr5:13818222..13819829, Cluster 7
tactactctattaagagtctagcgtcagcgtgtacatcctgtccccggctccgcccccgcctgccccgcctgccccgcctgtgtcagtcgcgtccgcacgccccctccatgcagcgccgatacgaaaaggaaacctgcacaaggaaatcgatggaatccacggctgccgtgccggacccgggaagcaatcaccgcgatcgtctcccgcgctttccatccatgaatccacgctctcgccccttgtaggaatcacggctggatgagatacgtcctcaccatcagctccttccatattcgtcagtagggacttttgttcatcttctctcaatagtgttttgagtccgacgtctcttcctccctcaactctggtccactccagaaccctaggcggcacccacggccctcggatccagcgtcctagagcctccacccgtgcaacatcggggttgccgcatggctctcaccttcgatctcaagcgaggcctgaacttatccggccgtcgtgagcacgcgctcgaactgcaccatcgacagccgcagttgcgaagagcggaagacaggcaccggcgatggcctccactgtcggtgaagctgacctctcgccgcctccggcttcagcgtgtgcggcagcagagtgttaacagagtggcgagaggaagagagaagatttggggagaattcgtgatcgaagcggaagaacaggattctgctacggcttctctccgcctcgttttccctcgttgaacacggcaaaatttaaatactggctagcgcacgtacggacagcacacacacaacacggcaggcataacccattctgggcctgtcatctcggcccgtacgcgcgtactccttcttggcccaacttccttcacctggtccgcttcggccgacacagctcgagccgttcccgccatctccttcctgacacagtgcgacgtctggcttcaccgaggcgagatagtgcggcgttgggcgaaacagtggtggtcctcctcatcccgacggcaggaggtcgaacacctcgtcggagaagaggaaccggtgcgccgcagagaccagcagtgggaacggtcccctgaccgcaccaaaagcttccccgaggagtaccgtggtgacctgcggtccggcccctcatccgactatccgagggtgtcgaagcgccagcggcgactgtacggacttcgttttttatacttgatgattgccgggccacgaacgcgaagcgcctgcagggctcgggaggggcgagcggggaaacgccccagctcactgcaccatgcgcgtggcacaagtttgtctcgtcactagccactactaaaaatccctggcaggtaagctaagtttggctggttgatccaaatatgacccaagcatccctaggattggagtaatagtaatactcaagtacagtgtataattactgtcagaaaacatgtacgcacatatatgtactactagctaataaccaaagtttaagtttggtactccagcatatgtacaatctagagaaacccgatgcggcttacaccgtccgatgcataggcaacaagctacactgtgaatagaggaacgcctgcattttctgcgccgtgtgcacggcacaac

SEQ ID NO: 1119 - DNA, 1860 bp, Zea mays
  misc_feature (1)..(100): optimal_loci_176218_G1, chr5:22016985..22018844, Cluster 7
ttttaaattaatcatttatgcaatggtttgcactttacgttattcccaacctttctttcgatcttaagggtccatataatagcttcccccttgtgatactggcctcttgattgccaaattatcatgtgacacctactaattgtcatcttgcttttagatgtacacatcatgctattacaatggctgttttgtcatgttttttccatttgatcacgcttggtgtatcactcatttcactaccattatccttacctttcgcctctctttccatgctagatatgcatgtaactaaactgacaaaaaatgtcttggttgtcctcttagaaaatcactcttggtactcatatacatatttgtttttgtttctcatggttgatattcccttatttgactcctaaaaagatgaacaaaaaggaagtagacaagcaagtgcaaactaagagacgacatgttctgtttaggattggaatttgctgcttggtttcataggacttgatgtcctcagacttgcaagaataatgttgaaccttcatgtttcatatacaaggaataacaacaacctaatttattgcttccttatatattgtttcatatctcccttgcctatgatttgtgcgtttacaatagctccattgtcttccggtgcctatgcatgtactggtactgtattaactgtgaactccatagccatgaattttgttggctttgtccacttttaccatgctattatttttgttgtgtgcaattatacattgcctggtaaatattttaacaagagtgacattttccaaaactatctaggtgtatatggacaggaaaacaaatcttgcttatatccaaggagcaattgaatgaactgaggcatcaacagccaaagcatcacatccattaacagaagaacatcaaactacaccatcttaacctcaaaagatctacatccaaatctaaaaggtatccactgtgcaaaacatccatatacatggacgatgtgtttaatctactagggttctcgtatatgttagtctaaatataatatattttggtctaagaataatgaaggcatgtaaaaaagtatggattgtcatgccttaggcaacaggccgtctgacctgaagcttgtatctgctctatggtcggtagctcagccgacccttggggtcagaagctccattttccccactgaggtgggttgcacacatcctcctggggacggctgtgtccaaccaccttggggccaacatggggtcttctgcaaaaggccaaaccagctccaataagtgtagcctgtatggtgctctatcttctgtgggaagcatctagctcatttgcaaaaccagagaagagagagctaggcttagagagaggagagggaagattgagaggcaccaatccacaaatttgagagagtgatttgaggatctagagcctcccctcacttgttggctcccacctcttgtactcttcatctttataacagagttcttgctcgccgccacctgtgggttttctctccgcaaggagtttcccacataaatctatgtgtcttcacttgctgtggtattttacttgtcacatgtggtgattgctcatcatcttgcttgctgttggagccatccattatgtttcttggtgtatggtcaagttggcatatatgtgttctatgacatattggtgatctgttgatggggttgaagttgtggtgagctcattgctgcacatatattgttgttgtactgctggacagtgtgtggttgcttgatttgaagcttagatgcttcatttggttcatacccacaaggtgttcgatgaaatacttgtgacaacttagcttgctgttgtttggtgcccgctttcgcagtg

SEQ ID NO: 1120 - DNA, 2003 bp, Zea mays
  misc_feature (1)..(100): optimal_loci_184530_G1, chr5:73109398..73111400, Cluster 7
aaatttacctctctcaacttcagctaacaaatgtatatcatcatcattttattttcttaccgtggagttactaatgtatgtgggcaaacaactatttgtgttaaggcatgtgttacaaccgaagtaatgccatactaaaacaaaacatataactccaataaatgttgtacaatcggtccctatagcatacaagtgactcttctaatacgttagatcatgatccagctatagatttaaccatgatttttagagggtttttataaatctcgctgatggtggaacaaaaaatacacgacaaactatttgattgattcttctgagacggtgaccattcttatgagacggtgcgctccattctttgcaaaccaatgacacatgaggcagtaacaaacgcttttggtcccacctttcgtactcttgtgtctcgcgtctttaaagttcagctgttgtttggttcacatatttataatatgatgggtaattgataatcttaaatcatatttgtttaagttaaccgtaatcggatactacactaaaaaatgatagtggactattcaaactttttaccgttggtatttaacgtgaatcattactattaccatttacgttacattttatgaaccaaacggcatctcgtctagtattcgctcatacacatcgtatcggtttacaatgatcaacaattatgctacagggctactgaagaatataactttccttaattttttttggtatttctagatatatagtttttattatatacttagggtttgtttagttcgttgtctaagctgtcacaatctgtccaactttttgtatctaaggttaattcttcaatttaatcaactaaacttaagcaaattgtggtacaattagccaagaaacaaacatactcttaaacatactcttagatatacactacatataaatataatatttttactatatatacacaagtaaaaatattttacgataagaaatagaggagtacataatattttttttattaaaatagtacagtatgacatatggcaacaaggtagaaaaaacatagtactgctggtaggttagaggtaggaagaaaaggtatccaaaagcctctcactccaccgcggcccggtccggtccggcacggcccacggtcccgaatcgagttcagggatgcacacaacacaaatttgaaatgaaaagaaaacgaaaaacagcagaaaaagcaaaagcacttcgagtactccacaccacaccagtccagctgtccgcccccgccacttcgagttcggttggaggcttggaggcttgggcaaaaccctcctcgtcgtcgcgcgctccgcctgcaccacccgccgccgaaggtaagctcccacccttcccaccgcctcttcaccctcaccctcttctctctctcgcgcgcgcccgcgtcggcgaaatggcctctgcgatgcttctatttccaagcgcgctaacgatgaaaaacccaaagtctccatgccgtcccgccggtcgcccccgggggagggaagcgggtcgctggggaatgtgggttccctcgctcttctatccagcgatcggggccgcgcggagggtgtttcgcctctggatttcggcttcgccggatctgatcggggttttggcggggttttccgttgggtggtggccacgcgtgcatggtgcttctgtgcgtcagaaattaatttgcagcccaaaccatgcgcggcgcggtctggtgttcggttccagtggaagcggaaatgcccttttgctcgttgctttctcaagttctatagatcgactagactggcaacgcagtttttgtagggtcctgttttctgacgattgatgcatgtgccatgtgtgtgcttctctatgtgttctgccgaatctgttagctctgccgactggacaacgaaaggtggctgccaccttgcatcccattcactgaatagcatgttatttactagttcatggatttgcagccagacctttgcttactgtgattgtttgtt

SEQ ID NO: 1121 - DNA, 1460 bp, Zea mays
  misc_feature (1)..(100): optimal_loci_200220_G1, chr5:174983488..174984947, Cluster 7
attttctgtgtggacatgacctccaaatcggcacttaagatgatcttgaggttttattaaatttatgcaatagtctatcacctgcaagtgtgtaagttattgttaaaaattatagggtgggtaaaaaaatatacatactagggttaccaaatgagaaactaagcatgaattatctcattacctagatatcatagttgggattgaatgtaatccaacatgagtcaagttggctagtgggtgggagcctaagtgttctactcaagacatctaggattcaatccctgagatggtagcaattttttttttgatgcgggtagaacaatagcggacaggggagggcagaacggggtgagagcctacccattaccgtctttatagtagtatagagatatagagataatataaaatatttcaaaatacgatctatacatccttttgatgcaaggtacaaaaaacgactactaattatgctctttactaaacactaaggcctggttttattaccaaaaaactaaggagatccatgagaagaaatctctttttatccccatagatcctcctccaactctctggtcactagataagcactaaatgcagtaacgatcgttttttaacgattttgagcacgagtgctcctcctaccatgcatatagcagtatctgaaacacccatatttccgtctggatttttgctcggcacaaatgctccccttttttccccggccaatggccagggcacacgtcccttttccacgaggcctttttacgagatttttgctggggtgccgctgtcgctggaagaagataagattctatatacggacgagggacgattcgataagctggctggcgtgaatctcttccttcacgtcgaggcggaaaagtacagaagaggagggacaaaagccatccagtgacagcagtagtcagcgccggtcacatttttggctgcttcgagaatcggattaccatggcatgtggagttcctgtcctggaccaatggagttcgccgaaagctgttctcctctctttctctctaccattagttacatctgttaaaacatcggatcatattaagatcggatcatattagttatagatctgttaaactactattagtttgcgtttgctgctgccccggaggcaaggcgaatgaccggcccggcccaccttcccctagctaggttagcaaccgttaacgcgtttgccgcggtcaatggttccattcgccggccctccgactccgatccaacgcatcgcgtgcgtccccgccgcgaccggcgttctcctacatcgcgtggctgcgtctatgccgattggtcatacgctacctatggtcaccggcccaatagatgctcggacaaagcaaagcaaaaaaaaaaggcccataaatccataacgcttcacgcacaacgtaacgcttcgccctcctctgtgcgctgatcagatcggaaacagatg

SEQ ID NO: 1122 - DNA, 1637 bp, Zea mays
  misc_feature (1)..(100): optimal_loci_201123_G1, chr5:180129879..180131515, Cluster 7
gatcatattctaagcatctaagtacttcacccctggtgatgttcttggaagcatacttactcatgagctcatggaggtagaggtccaacaaagcagaaggtctagataatatagcccaaatcagagaacgtgaatatcaaggatgtagccctcaaggccaacaagtcaagcaaaactataacctcaagcaagtcatcaaggccaaggccaagtgatagctccaagtgtggttttggtaattgagacaactagtggactaaccttcactctagtactatgaatgaaataggttaaatccacatttaagattgagcaagattggcggtcgtgcttaaggcaaagggattttcgtccctgcaatcaagacacaataaagtgcatgattagatttaggatagttggtcgtactactaagaggggagcctaactagataactgagtcatctagtgccactaggtgttgaaatcatatgcaccgcatatatgcctaagtgacacacataagataaagtgaaaatgtgtattgaaaatattttcaaaaatataattagacactaatatgttggataaaacatatgagagttagcacgcttaagaagatatgtgaaaacactctcaggtacgaaatcagcttatatttagttcatagtttctagctgagcactattgtgtccagtgtggactggataaggtgtactagacttgttccttaaagcatcaaatggcccaatggataaggcactcagagagcacccaaagagcctacaaaagtacatatttcagcactacactcattggaggtgtccattggtatgcccagtgagtccaccagacatctgatactattagcgattagtttatagccattgaaaaggtactagaggtgtttggtgccctcaatttgtgtgttttaagaggtgatggttagaaattatagggttaattgtatacatgccactcaactttttccaaaattagataactagttcatttggatgccatagattctattgtgggggtataaatagaatgtttagtagccttggctgatattcttcgaccacaaacacttgcatacatatcttgaggatagagagacacactccactcgcctgcaagttgtagttcatcatttgggtgagattggagcacttctagtgcaatgtatagagtttttgcatcttatggcactagttccgtggtttggcctagttacactcctattattcttggtgattatcatcacctagatagtctatagttagtgggatcattgagcacctaatggaaattgtagcaagcttgaatcatcattgtgaggggaacatgtgctcattccccacaggaggttcgtaaagaacaactacaatggaactatggcttattggagtgcctctctagagtgatttttacaagtcccttattgcgggcttgaaattttatgccaattagcatctaaatcatctagcttggactctccacaatgaggacataggttgctagcaagcaaccaaaccttagggatatatcttgcgtcaccttttggtccttatagtttgcactacaaacttttattgtaattacattcaatttttacatcatattagtctacgtagttttgtgaagttagtaattaa

SEQ ID NO: 1123 - DNA, 1559 bp, Zea mays
  misc_feature (1)..(100): optimal_loci_201863_G1, chr5:184692781..184694339, Cluster 7
tcatgtcccctagtatttccttacactaatcatgtcctccgtataccaactatatttaactgttaacctgaacactggttactgttggggatgaaatgaaagatacagtttcgtttcgtgactaaaagctattgatgtgtaagatgagtgacacttgtacttctcaatcgtgcaccctgcacatgctaggaaagaacaaaccatttatttctggtgtggcaatcatgttcccttgagtattgtttactttataccaatctggagactgatagcaacataaacttttgaacgggaatggaggctcgctattgcttcatagactattgggttgctttgcaaacagaaaatactaatgttcgtgtatcaagtgaaaaccggctcggtccattacgagatgaacaaactactaatgcttgtggggctgacaaaggtggctatttttccaactcgagtgatctttgggccggcaggcgcaggcagagcaaaataagctggtgggggttctaggaagccctttgttttctatgtcgttgctgttttggcttctaaggacaaggatcatccagcacacgcatttagaagtggaggctatcagtttgaaagttcttggcgccgcgtgttgatgcttggtcatgggacatgtaaggccgaaaaagtgcctattattggtgcttctctgcctagtgtccatgatggcgatgattaggtgcacttgcaacaggcaggctcaccacctctgcctctatggcttctccaccattccaccagtctgaaggaggaaaagggtgttaaaagaattccaatggaggggtccatgcagtgggctgtgggcctcagccattaaatcacacttttgtagaatgccattcttcttaaatcacactttcttagaatttttctctcctttattgtggtgcggtttgcaccaaaaatgcatggcatattccctcttaaagtcttaactctgaaataattatctgttgcagttgcagatgcagactcaagaacagtatattgcacgtatttttctcattttgctgcttttcatggtcctgtgaaattttaggaagaactaactcggctggattgatggaagagattttttttccactcgcactgaagagttgagagatgcagaggtatcaggtcgataagcacgaagtagtggcaaaacaggaggccacactcctcaatctccctgttctaaaaagtgcgcctcaaaagaggagattgccctcttcagccttttgcaaaaggcgcctttatttctctgcgcggtggatctgtaggtttggcctcttcggtgagatctgagtaagcctcagtttgttggtaaagattggttagttgggtggggttaagcctcaggttgatcgttggaagcttaactgctaagcaactgggtagcaagagaggacatttggctttccaaaattttggcagcgagcatgcaaatggtcaaaagctgacaccggattattacttatagaaaggttaatgagattagtacagatgttgtcatagcttttatcagcatgaacgccttgggtcgctggatg

SEQ ID NO: 1124 - DNA, 1833 bp, Zea mays
  misc_feature (1)..(100): optimal_loci_203676_G1, chr5:194644831..194646663, Cluster 7
ttggttggtggtatgatattaatcggctgcggaaataaagccctctcacatcgcttcaatattttgcaccgtcggatacatatcatacggttgcgtcaggacaccagaccgtcgtcttccttgctgccaaccactccaattttttttttcttaccgaaacgttctggatccattcttccccaccctccctttccccatccccaagtcaacacacgaccaatgatgcagccgcgctcaggggtcgctccccttgccaccgcgcgcggcgaagactgcctgcgcaagcatgctccacgccgtcttccttgccgtagctcaatcgtgtgcgcctctgcggcacatgcaccgctgtttcatataggatcattgtccagtttcctcttccttcctttcccatatagaaaattaaaaaggttggtgtttgtttctctggagctttttgtaaaccctgggaggaaaagctttttggaaagcatgtgcagcacaaaaagaatttcgtgatgattttacactgtcctttttttctctctctctttctaatacggaaaagcggtgctatacctccaccattagttcttttctgtttcggtgtcttcctagaaaccgaatgaatggttccaagcaactggaaccggcccggaactgagatggatgaaaacgtatttgaattctaaactggaagtgtggaacatgtagcgagattctggtttcatttcaagttttcccgagcgtcttttttttgtgtcgagaaacatattcaagtggtagtagttcctcaagaaactgataaaaatcctagcaaacaacatggaaacagaaactgagagctgcaattatcttgctagcgtgctgaggtagtggcagcacagcacgccgcaggccgcagatgtaaaccaacagagcgccgccgaaatatccatcacgattcacgcgccaactctccaacaagtcgcgagcgtcgccgacgtcgtcccccgctcggtcacccttcttctggacgcccgagtcacctgaagccgggacaggcggattatgcatgtcagtatcgctcgtggcggggcatcctccttgcgttggatgccagcgtcgagcggcggccgggaatggtggctagctactgtctcagaattcgtcggggacggtgacggagagccacagccacgcacggaacggatcgaaatgcatgctagctactggttcgaggtgtctgtgcctgtgcgtttgtgtgatcggtccactgtccattgctcgttccggaacctggattttggtggtggtggagtccatgaaattgcagattggttcggaatgactacacggcgagggccgagggtgcacagtggccgtgcaaagcgacagccgttgccgtgcaacaggaccggccgtacaagcagtactccgagatgtcgtccgctccgtttgcgacatttctcgcttgtcatgtttctttctgcaacacgcagcgaaattcgtcgacaccagcgagttatagtcacatagacagtagtagttttttatgtccaagtgcacacgatgttcaaacataagtatgcctatcggtcaaacttcttaatttaaaccaaactagattttaaaatatattagaaacaaatgcatttctagataagtttgtttagattcggtgatctaatactaattatatattataaattttaataaattttaatacatatacttagctaaaaaaactataaactaaaaagagttaaaataacttataagttagaatcgagagacatgactaagtactgtgacaatagatgttgatgagacgacatgtacttgggaaggtagaggctcagatctcgttct

SEQ ID NO: 1125 - DNA, 1560 bp, Zea mays
  misc_feature (1)..(100): optimal_loci_204431_G1, chr5:199030715..199032274, Cluster 7
tgaggcatcacgacgtgcttctaggtacagatactcaaaactggatactcatatatagcatattaatattattttactgtcattttaaaaagaataagtattcatttgatcttgatccctggcggaccggtcgcgcaagatctttgatcttcccacggaaccaatgaattgtagaggctgctagaacgcttgaaatggaatgatgtttctatggaacgttagacactaggcattgggcacaaaaatgaatgcccctgaagcttccattatgggatatgtacctatgggaataggtttatagtctctccatctcttaaactcgatttagtgcagaaacttgctcttttgatatatagcttatgacctcaccatcggttgttttttatgtattccttacgtttcactgtccttgtatttcatgttattgctcttctttttacctcaagttcttaatttcctgtgctcaatcccacaggtcaggagaaatcatttccatttgattttttattttgactctaagatatgagtagctgagtaggtacttgatatacttaaacttcaaaattttatcattatttctttcaactctttcactttgttcctagatcaatacataagttattaaggtactagactataaatagaaaacttgaagggataatgctgcgtagaactatataggtgttgtggtttcacaacgtttgaggaaaagtaaagcatgcttggttgtgttgctgaccttttttcgcagtgctctagatgttgaggtaatcagattagcttgccttacgtttcaccctgcacaatgggattagatgcagtgtcctgcgaatgaggaagttgttctctgtatgtatgtgttataagcaaacttttgggatgttgtttagcaaatcataatgggatagtttttctttgtgaaacattataatacgaagtgtgcaggttggtgatgatatgttgttatcattttgggtgtagtgggatggctctgatgatgatcagctagtacggtatcacaagttaggtccctttgagagaaaatcatatccttctcctgcatgtgcacataagaatggaaagaagaatgagatagagataaaaaatctggttgatatttttgtttcccttgttactcttattgtattaacatttcttttgttctttagtttataattcaggaagtaaaccatgcaccttaattagtaaaccttgcattttgtatggtgactcagaggtacgacaaaggcaattagaaatatataaaattagcttaccctgatgtctttgaggagagatcgacggtatacattctggctggcattccatttctttccttggaagcattttactcaaatgcataccctacttcatttttttgtttgctatcttttttatatctcggcaaagtataaacaagattagtacacatactggtggtggcatacttgcatgtacttcttttaaacataaaaaacaaaattgaagaatgtgttacccaatcattcaatcagttgaagattacaataccatgctatctatttcatgctcatgtgccag

SEQ ID NO: 1126 - DNA, 1864 bp, Zea mays
  misc_feature (1)..(100): optimal_loci_204480_G1, chr5:199364825..199366688, Cluster 7
gagccatttgcaatacatacaaactaacgttaacgacgcgtgcccggccaaagatgaaagactgaaagatggtgagtcgtcgtccatgagacatgagagcatcagagcatgcaatgcttcgtacgcactgacgatgttgcatgcacgaagcacaagcttcggtgtggccggcaacccgtactactgcaactgcaaggcaagcagcacaaggcaacgcagcgtatagcgcgcgcgcgcgggcgcagagtgtgcagagctagcgagcttgcgtggttgatcgcgtcgcgaccgacccgacgcccatgcggccatgcccatgcaatggaagacaccgaaacgaacgggggggagaagaatccaggcagcgtcgcgtgatttccgcgggatccatgcatgcccgcgcgccaaacccacccaccccacccgtgcatgcgaactcgcgcaagtgcaatgcaagagggccccccgctctctcggcctgcatcggtcgcgggtgtgtgtgtgtggactgcacagcggaagcgcaggggacgcttggctttctctctctctgctctggtctggtcagctcgcacgtacgtacgtacaacgccatatagtagtagtacgtgtgtgtccgtgacggacgggacgggtcccccgtccccggccgcgcccccacttgcaccgcccccgttgccttgctccgcctgcgttcgaattcgcactgactttgaagcattgcatcaaaaggcagaagctactaccaccgctagcgttttttttaaacttttgcgtccgcagacgcagcacgtggtcttatcagtctgtctgtcagccattccctcgcgcgcgcgaccgatgcagcacaccagtcgtcggactgcccttgactcgactgccccccatgcatgcgtgcctgcctgcctctttgcattgcatctatctataccatgcactgttacggcaacaaatttgttttagatagtttggcaagattaaactaacgggtagagtactactctgtttgtttttttatatataagcatatcagcacatgaacaatattccagaaagcaagttgaggtggttacggcagctggcggttcttttttttcggcctgttgatgagaaagcagaagcagaagcccaactgctcctcttcaagcagtcaagctgggaggaagaatctgtgggcgacgggcgggcgggcggttggctcagactgcacgcaggccgaggaggagaaaggctttgagcgcagcacagagagaagaagaggaggaaatgaatgatgaggcactccattacgctatgattggggggcgccccaaggagaagcaacaagcgatcgagtaggcgcagcagcaactgctggctgcctggctgctactgctagctagcctgcctgctacctaggggcagcagcagggcgcagtgtggccggagagagagagagagagagggagagagaggacggaggaggactcaggtctcatcacgtcaagcgaacgcgacgcgggcagagtgccgggccgtgcatgggaacgaaggatgggagcgggggcagcgggcgctgtggcctcgatcgcggcaattgaaggcggcagcagggcgcgcaggcgcagcgttgccgcccaatgcggatacgaccgatccctcctccgtcctacgccctgacggcgaccagacgtggctgcatgctgcatccacccgcccggcattcaaggcgccaacccctgtccttcttttctgctctcatgcatctgccacagcccataggacactggacacccctctccctcttcccctctctctagcacttgaacttttgcagtagagtagaaaatcttcttctgccttttccatccacggctaatagtaa

SEQ ID NO: 1127 - DNA, 1883 bp, Zea mays
  misc_feature (1)..(100): optimal_loci_205047_G1, chr5:202400499..202402381, Cluster 7
gatgttgctgctactctctctaaaatatactccctctgtcgtatgcaggtacattattcgatccatctaagatatactcgcgggtctctataactaatagctaatcgctatattttttaagaatatatttggatctcagataataagctcaattactgtcttaggctcttagctaacaatgagccattatatagtttcttgtagctaatgcaggtaatagttagttgggtggttttctcggctaataagttgagttaatgtattatcaattagctattatctattttttttatagctaacacagatatgatattgacgtacgcatatgcgcgtcagtaatttattatctctgcgcgcgcgcactggcactacacagcacacagcacagcaggagcacgtacagtacagtgtcggtacgtctcgtctgctacaccgtccggccaggcgagccgcgcggggccatcgacatcgatcgagcggcggcagctgtgcagcgcctgcgctcccgcaaggagttattgtatgtaaaccgcacaacaaagtcaaaacgcaaacagcgacgtctggattttgttaatacgtacgtgctatccccaggtcgttgtcgtcgccttcggcgcttactttgttcgacctttaggtgcacgggtgagatcagatgagatcaaaaactttatattatcctccttgtcgctagcatctaattaatatctcacagctcctcgcagtgattgacgttttgtcaatgcaaaaggcgtagctagctagctccagacagcgcatgacccctcatgcgcgtgcccttagctttgatcgatctataatctactgtgttgcgcgttgcagtggaagagaattaaactatggaggaggtaaatatatttatatgtgcaatcgtgcagctgtagttcaaatggtgcatgcatgcatgtccagcaaatcgggtgtggctgtacagggcactactagagcaaacaagagctagctagggagcaaaagttaatttggaagtagagcaaaagagtatgcattggtggcggacaaaataaagcgtgtgaacgatcttcacccaatcaccccagtggggctggccctgcaggcagtaaaatattgagcatcagttgccagttcctgcaaaaagcttttaagatattcgagcctgacggtgttggtttcctagctcaactaatataaaacccatttgtttatgtgttggaacctatgtgattatattatccaggggactgctagtgctctatcagttgagagctagaggacgaaccaccagttcccatcggctacacctgctgtaagctcctgatgtgacgcgcctcttggcgtgtggcgacaaattatattgtcttccatgccatgtcctaattctctttactgtactgtatagcagtaggtacatgtttgaaagggaagatggttctcatttactatagagtgaagccctcattggccgaacaggtcccaatatatgggtacaccatttgtaaatcaagagagccgtcaatagacagatattattcactgagttggaaaaaaaagttcttttaaaaatagtgtaagtacattgattgttccccacctcattatgtcaggtagaacacaaaccaactgtacaggtgtgtacatatcgattatagcagagcgggggtgcttggtttttgtttatgtatatatactatacgtaaacaaggagagagctgctagacgacctgtcagtgggtgacaggattttagtttagcatattattatcagcttccatagttagttgtaagtcaactgcttggatggataaatgcatgagcatgacgtaacaagagtcgtttaatttggagcattattatatataatataatataattccgtatac

SEQ ID NO: 1128 - DNA, 2930 bp, Zea mays
  misc_feature (1)..(100): optimal_loci_206621_G1, chr5:211083445..211086374, Cluster 7
aagtcgtatagaggccaactttattttttaaataacactctagagaccatttaaaagaccctacattaaaggtgattggacatcgtttgcgtctagtaaacgaacaaaaagggcctatcagattcagaccacgggtggcggctctctctacttgcatgccatagaagttagaattgatgctggggtccggcgccgcgcatcagtgcgtgtgtacgtggagtgcgtcgctctcgatcggcttcattcaggcggccgggccgtgcacgcgtcttcggtttattttgccagcatgtgtaagcacggcgatgctccggcattgaatggcgcaatcaatttgccatgctgttgcgacagcgccgtcgatcgggcagggcgccgggcgccctaattcgtcattatcgatcgatcccatattttcggcgttcgggagctggaaccgttgttggctagctcgtcttcatcaatgccggcctggcctgacctgtataaggtgttcctccgtcccaggcatcgcggcggctcgttcatttgcgctcggtccgtcgtctcgctcgctcgtctgtcgccgtaatcccccggtcctgctccgttcgtgcttaggtgctggcctcagttgatgccaaatggtgcgtcccaacggaagtgttgcctgcctgcctcgcgctgcttgctgttgacaaccatggcaccgccaccacggtgaatggcaagttggcaactcgtactgctccacgcccgagaacacgatgcttcttttttctactccagcagcagcaaccaaccaaccatggagataaagacgttcggtagattcgctcgcacgccgtttaacaactagaaacatgacatgggcctaaagttggtatgggccaagctcgatgacagccctatgctaccgggctcagtccattgcaggtctaagggtgtgttgagttccatccaagtaatagtcatctctagttctatgattttgaaggcccgagacgaacttatcgtgatgggtcctctcggctatataaaaaatttataacatatatatatatacacacacactaattttacgacatatttgatctcagatagttcttcaacaacttcgtttttgagaaacttctttcaaccgaagcacagtcataggtacagttaagagagttcgatgggcatctgaaacatttggatagtattttgtatctataacaaacttcagaatctccggcattaacatcgaataatttggcgaactcacttgcaacacctttaattccgaataaaaatcatcgatctcaacatcggatgagttctcgtaaataatttttttttcgtaacgacgctctagccaggcgtgcgatgtttctttcgcttttgtgcaattcggcaagataacaacttgatagcagccctactatgcatgaccatcaaatcaacatataaagagttgatccattttaccagagttgagtagataagactctacatatctaggggtatggtttatgaaagagtaataaccatctatagattggaggaaaagcttgaaccattcaaccatatatttagcttgtttactttcgatttcctcgtttccttttgttaggagatctctaaatgtcttgaagccttgatggtcaacatctttgtattctagattttgaaggaatgtggtcgtaaccataccatgacctcttgtggtttatatttatgaagtatctctctttgtatctttgatggcttaaagttctctctttggtttctccttccaagctcttcgttttgatgttttgagggattttgagaacctaagttattggagtcatttgggctggatggaaaggtgctaggacctcttaggatcattgccacaaagtggcatgggctcattcacaagagcacaattctccaactctttgaaccattttgagaaacccttgtttcgaattcatattgttatatatgacttttaagtttaaatctttttgagctcacatgttgtggacacctttttgaaactcccttgtgaaggtgtatgcaaaattttaggtcaatccgagtctgttcctgagtaaaagccatggttttgggttattttggactttttgatgtctgttttgtgattcgtttatttcgtcagacttgtgtatgtcctagcattatttccaaaacacgcactcataagttggttgctatatttttggtttgagcattctcttctatttccattgaggttaagtgattagttttcggttgtgaaagattgtccttctacctattgctagccgatttgagctttttgctatgttcttcggtcatcaccaagaacattcaattgctagtgggtgcttccacataccttgtgtgtcatttggagtttttggagattaaggtgtaacaatgggaagaaatccaatattgcctaagcgcaaagaattgttattggctcctattcactcctctggccgcctgatttgatcaaacaaaataaagcatcaattctatctcatttacatggggaacaatggaaaggtttacgagcaaatcaccaaaggataaccgatcgcactggcttgttggggcaaggatgtcgttggattaccctaggttggccaacaaggccaaagtgccatcattggtcgtcagatcaagcgatggtaaaaagagagataatagattgattttattcgattgaatgttggaaacatcaatttcgaccgtgatcctcttgtatatagggagaggtgaggcgatcttatcccaatagaaaataaatatgttttgtgtatttctcacataaaacaccattttagaaatgggtcagttcaaaatctagacaaatcaggtcaagcatatactcggacaaactggctttcacatgccctagcattgttgacaagtcgttaataggtaacctggtctgaccaacttccccctggcct

SEQ ID NO: 1129 - DNA, 2033 bp, Zea mays
  misc_feature (1)..(100): optimal_loci_206636_G1, chr5:211159841..211161873, Cluster 7
tttgtgtatcaagattcaagagtacatgagcaatgcttatattactagtatttgtgttcaatgttgtataatctaactagtgtgtgactaatgcacatatgacatattggcacttgaggttgtcattttttatgttgtagtttcaatttagaaattctctactttttcaataaaatggacgtgtccaaagcttttgaaatacgtggcctttaaaacatctagcttgcttgtttgcggttgcagctatgaataatttgcagggtcataatatcataacacagccactaccataatcataacagtgccattgcatggagtgtaatggcatgtccgaacagtgattaagcctgcttctttggaaggcagaaaaggaaaagaaaaaactagacagcctttcaggtacccttgacaggaagctagcaagctggcttggacagacccaacgcaatctgcaagtaatgatcatgcaacaagacaagaaatggacatgcatgctggtcccagacgttggactcaacatggctggatgcatcatgcacgtatacacagcagcattacgcacacgtactactacatttcggcgtcaattaagcatctagctctgatccatcagccaatagccatgcaagccccttaactcttccagctagatcgacatgggcacccagggcagggcagggcagagcaactagctggcttgatcggccgatgagctgctgccctcctgcctgcctgtctgccggcgtgctaatattaatcagcgagcagcgagctactccagtcttcggacggtcagtccacagggcacgacagcctcgtgtagtcctgtcaatgaacgtcgccaacatgttgcacagagggcatgcagcctggtccatcctccagtgaccagtcctcctccacggttaattacgccatgataaggtttaaagcttgctggacgtactgcgactgcgtttatggcgctgcggcacacctgcggcggtcgcaggctccgcggactgcaaagtgattcgatgatgaccggtggatctcccttgcagccttgcaggtcgacaagatcagaaaaataaaaggtagaaggtgcccgtacgtgccgggtctaggattccacaggtttgctcggggctgaggaggtcgagccatttcctttccaccttcagttttcagacgatcggcgacgcaagtcagcgacaggaccaccagatgccggcggacgcccgatcgatatatgtagcgcgggtttgccggagatcttgtcccttctgttctgaatctggatggtaaactgtttcccttccataacgcatcgatcttcagacgaaccatgttattatatgcgtaaaagaaagcattgatcttcagacaaatctgattgtcctcgtgatcttttcgtcaactactgcacgtccaggtagtatccaacaggcaaggctgcgaagcataatttgatttttgatggctataaaattacgcgctaaaaatggagcgtctttgcaactcaccgataaataggagttcaggaaagatgcagctccacaccatacatatgaacgttcatcaaggcggttgtttagcaaaaaccgggcagggtcgatatttaattaatcgcgatgaaatggtagaaacgggctaaattcagatccaaattagtttttgaattgaaacggaagactgattaatcggttactgaaccgataaaccagcagcacaagtgtagaaaacgaaccacttgttttttttgcaaacaaagcacattgaggtcctaaaaattgaacagaagatgactcaaatgttatcacaagtccaataacaatatttaacagttcaaatacattgaaaccgtacgcatagtgggtctgagggttcaaagccgcagccgtagaagatatagttagtagtgattcatgacatgaacattgaaaatcgtactaagtgctcccttcctgccttggtcaacgaaacgaagaaaaccaaataatggctctattgcatcaaccacatacttcatttggtacgaccatgacaagctc

SEQ ID NO: 1130 - DNA, 2530 bp, Zea mays
  misc_feature (1)..(100): optimal_loci_206641_G1, chr5:211168688..211171217, Cluster 7
caaaagtttgaactagatacttaaaagttatttgtagtcaacgttttgaaactttgattcaaaccttctcaaaacatcgagtatgggcaaactatagggagtactgcaacaattgatttgaccaaccttaacactaatgtataattagctattgttttctatagatgtcagaaaatagcataaatttagctactgacatagtgacatttcagttttttatatagacctgctactttctatctccaactaatgcactgaattctcatttctagtctattttaacacaaagtaggcgttacaatcttcaaaaaatcactatatcattgaaccccatttggttgagaaatatgcattgccatagttggaattgttagcaccaatgagggcaaatgtatagcatgaattccaataaagcatgcaatattttgactatcaccaagctacaaaagtttgtgtattcatttcatggcttggttagaatatcattacttacctatgactaataactattactggatcttaaatcttctgtaattctgtttcagtcttgtttacttggacttgttttgtcagcacatcttaacatgctgttccctgaaaagtgaaatctaacacctcaaggacatatgcagaatggatgttgcacgctacagatcccagaatatgatggaggcatttggtttaaatcatctgaggtttggttcatcacatattgatttggattcagacttggatggaatggataacaaagtaagagctggaggccgttactattctgcaaaaaatgcagtttctgaaagaaataaaggtttcaaacatctgaaaatatttaagggaaacacctctgtaatgctcgctgaagattttgtcccatttggtacacaatcacttcctttgaaaagcacaactgtggaacaagagctagaggagtcttgggaagatgaaatacttcgccggactagggaattcaataagatgtctcgtgaacgccctcacgatgaaaaagtttggctggctttcgctcaatttcaggtaccatgaatttctatggttttatttgtgatgtttctttgaagaagctatgcttattctgccctagtgctccattgtcagttattttgctcatttcgttctgggacaaatagtttgctcttacaaatgatttttacaattttgacacaccactagagttttgtttcagtcatcatttcacatttctgttctgtattatctctgccactgaactacaggacaaagttgctagcactcagccacaaaaggctgctcgtttacaaactaccgaaaggaaaattagcatattggagaaagctgtggagctcaatccagatagtgaggaattattgctttgccttctgaagtcatatggcaagagggacaacactgagactctattgactaaatgggagcaaatacttacgaagcacccagatagctctacgttgtggaaacagtatctgcttctgtgccaaggggaattctccagattcaaagtttctgaaattcggaagtcctacgtgtatgctgtacaggctctatctgcagcttgcaccaagttatgtaggcaggttatacttcaatgcttctctgtaaattactttgtctgtttcccatacccctatgaactacgaaacattgctaacgccttttctttttcttttccatacaggataataaaagcatggattccaaatcttcatccttagttcaactagaagtggggttggtggatatatttgttaatctgtgccgatttgagtggcagacaggacatcgggaactagcaactgggctatttcaggcgcagatggagtttagcttatttgcccctcctttgtatctgacaacaagcagtaagcaaaggctctttgaacacttctggaacagtggtggtgccagaattggggaagatggagctcttggatggtctgaatggttagcaaaagacgaggagagtagacaaaagttgtctatgcaagaaaattcacaagagactgaaacaggaggctggagtggttggtttgatccttctctgggtaatactgagacaaatgatttatcaaacaaatcactggaaccatcattgaccgatggaaatgatgctgaagaccttgatgctgaggactcaccagcacaagatgatgttgaatccttgctgaaaaagcttggtatcgatgtagatgcagagtccaatagtgaagttaaagacgcagaaacctggaatagatgggcctcaatggagctgtcacgggacaatcagcaatggatgcctcttcatgaaaattatggtaattggagtttgtcccaattattactaggtttttgtttgtttgaagttaacttaatgctaacactggatttttttttcttggtaaaagtaggatcaattcattgtggtgatgctccatctggggaagacaatgaccagctttccagagtaattttgtttgaggatgtaactgagttcttgttttctctatcttcagaggaggcccgcttttctctgatgtgc

SEQ ID NO: 1131 - DNA, 2878 bp, Zea mays
  misc_feature (1)..(100): optimal_loci_208855_G1, chr6:6544648..6547525, Cluster 7
gattatatgcaagcagagcgagtaggcgtccaatgtggcttcattccgcatctttccgacaattttctcatgaaaacaaaatctagtttcataaaataaaaatgttctatgtttcacaaaataaatgatccgacttcactagaaaattggtctatgtgtttaaaagaaaatttattcaacgctgaacagaagaatgtccaaaaatctagagaaacgttgcttcgtcaaaaggaaaatgctctggattcgtgaaaagagctccaacacaaagccatgttcaagggacatttggaacatgagtggcgaaaattaaatttagaaaagaaagaaataaatatattctaagataagagtaaaatttatgtttggtccttaaactttagaggcatttttatgtggtcttcaatagaaaataattatctactactctaatctagggatttactggtgatggcctaaaggtagaaatgagaaaaccagtgcaattaagagcaccactttaaaagactgtttctacgcccaaccttggattgtcctttgtcaggtagctgtgtagattgagcaaagacgtattccgtcttaatttataatttatttgactttttaagctaattttaactagcttgtcttatctaaaaaaattatatttattactaacttttactgtgatattatttagcatataattaatatactttaagtataactttgatttttttcatttttctcgaaaaatttaaataaaacaagccggtcaaatttgacatataaaagttaaacgaattataatttcggacagatagagtattatttctcaggctttcaataaaaatatacagctgtagcctgtacctcggcgagaacgtccattatcttggagatgatcatccgattttgtccgagtcgatcttcatcatttaaggtacgacgagtcgcacttggcatttccagcaataatttccacagcagccatctggcctgcttgctgcagcgatggatgggcaagttcgcggcacggtgatcgtcgaggtcgccggcaaggtcgcctccaaggtgatcgacacgattggcaagcggcagagcgtagacgagaagctgcagcggctggagatgctcgtgatcaagctccgcggcacggtggaggtgtcggagaggctcggcgctgagaccgcgtcgctgctccagtggcgggacaagctcacggaggccgcctccgaggggagccaggtgctcctcggctttcaacaacggcgagctgccgacggcgacacggctgcggctgcggctgcggctcaagggaccgatgaggagcaccaggacggtggaggcagaccagtcgtgctagtgaagaacatcctgttggccttggacagaggcgtccggaaagccgcagcagcgctgctctcctacagcgggtgtgcggcgtcctacacaaggcacacgctggtaggcatggcacggggcgtccggagcgccaccgcggcgttgctctcctgcagcgagggcgtggtgaagctaaacagcacggtggacaggctcgagcaggcgtgcgcagacattggacagttcataagtttgcaccatgcagcagaggcccagacctcgcgggcaaataatggagtagtctccacaagaacaccagagtccatggaacgtgtggtcgtcgatggaaatgggaagaaggacgagaacaacacgaaaaagatcaaccagcgacgtggagagcctgcacctgcggtgatgcgcaaaggctcattggaggaaccggcggcggcgaagtcagcggctgcgcagaggctccaagacgcgttggtggaaatttctaggacagtggctgtggcagaccgccaaggcctcaaaaacctagaatggctatcagatctggcagacgtcctccgggaggacaggagagcaggaggcgagatccttggcaccggtagagagatcatcgccgcgacacaagaatcagctcagcagcttcgcgccagtgatgcaactggctcggaagaagagatagagcccggcgtcaacgagaagctgcagcggctggagatgctggtggtcaagctccgcagcacggtggaggtgtccatgcggcatggcgccaacaaggccacgtcgttgctccggtggcgggataagctcagtgaggctgcgtccagggggcaccgtgttctactcaacttcaaacgacgagtcatgagagctggcacggccgctaccgacgcgacgaccgacgagggcaaatcaggttgcaccgtgttcttcgtgaggaaggcactgcagggcatggcaagaggggtccagaagagctccactgccaccacaacgttgctcttggccgccgatgagggcggtgctgtcgagcttaataactcggtgagcaggcttgagaaggtgtgtgcggaagacgtagatgacttcataaggctgctccaagctgagacctcgtcgcaggttcaggtaatgcacatgcctatgaaaaggaagaagctggaattaaaaacgagactagatctagatcgctccgaaaacatggatattattgctgaaaacgtactacttcaagacacttctgcttcaagagaagacagtaccaggggtagaagaagacttgttatgtcatcatcgtcaggagaagaagacaacgtcggcgatttctggaagaacagaagaacaagaagaaggttagttggttcgtattcttcttcgtcttcatcatcaattaaagaaggcgatgaagcaggagtagatgaagatggttctaggagcagaagcaccaccggtttaatatcatcctcatcgtcatcatcaaaaggaggaaaagaagattctcagagtacatggacaagaataagattaaccggcctattttcat

SEQ ID NO: 1132 - DNA, 1599 bp, Zea mays
  misc_feature (1)..(100): optimal_loci_209704_G1, chr6:13116147..13117745, Cluster 7
ttgctgcgcacgtaggcattatccttcaccatgctaccatctccactgaaccaagcaaaatagagttgaaccactctgtagcaagcatcgattagtaaagcgaatttgcgttggcctcattaatattttctagtaagctaatgaaatgataagatggtatttttactattacactgcatcattaggtgtcacaagaaccaagagcaccaaaagaatgttggtgaggaagaaaaaatatttcatgagaaatatatacctcatcaaaagaactgtgctacgtcggcgagctcattgatcccaccagtgatctcggtgatgagctcagcgaggtaggctctgtggtcacagagatctggacagtccaacccaactccttaattaggtattggaacttggaagaacaagcacacaaacaaatatgtgggcactgaagcccatgatttaaatcagcacttcctcacgtaactcgaatagggaagggcttgttgccatcgcctccgccgccggtaaaaagaaaatgcctcatttttcaaaaaaaaaactaaaaaaactatgtacaaccatgaactgaaatccttgtaaaaaccactgtgattgtgaaacttcatgaggccaatgtggcattgctcgatgaatctgtactgctcggtcccgggtctcaagtcctcttccatgtgagcaatgcagaaggctaaacatgtcgtaatctgttgcgtacctgaagaaggatcaatgttcagtcagtaacaaagttagaaatggtgtctgaagaaattgctatgtccatacatactaagacactatagttaccagaactttgcacggttttcagttggagtgtagaacacagtttggacagggacaccacattctccaccgaagtcgaggttcccgtagaatgaaccagtgccaggccaatccctctcatggttaacactgcaaaagctcctcttcttgtaagcagcatacaagaatacatatacattggagggacataagaaagtatcgaactgagacactcaattgacctaccaatcatgtatggcacccttgaagcaatcggttcaatttgagaggcctgcaaacacggctaggataggtacctaaccatcagtatggatgttacaagaagcatgtttatactccacatcagataattataactcagtagtacacgaagagaaagtgattagttgacatacaacacgaccacttgatcattaattaggccaattcagagcaccagaactgctcacaaacgcagttgggcccactcttttcggtcgcaatttgtttatccagcagcgctgattcagcatgagaaaaaagtttgccctagcatgtgtgcgcaactgaaattggatacaacatctatcgaataagcaagaaacatgcacgggcaatagcatggctggacgaatctggtccagcatctatcaaagaagcaagaaacgggaatggaaaagctcgacggtataaacagacaagggagggaaatggacatggcttgactcacatcgggtcggtggtgtcggcgtggccgaacccggcgaagaagatgtctcagccttgcggttcacgccggcgaagaagatgtct

SEQ ID NO: 1133 - DNA, 1731 bp, Zea mays
  misc_feature (1)..(100): optimal_loci_223994_G1, chr6:103647410..103649140, Cluster 7
tttacagaacaccgtctgaatacacgcatcaaaccctaattactgtggaccaagccttccggcggcgggcctcctttccgctcgccatcacgacctccatatgcagaatttggatcacaaactcaacactttttgtgtctttgtccatatcatcggtggagcgatccaattgaatcgctcaaacattttagtttgagtaatcatctgactagccttgtagagcttttttaatatctctttctacgtatatatggactcactgctacttattgttgggttctttctcttttgttaaagcagcatcactgtcactacttaaaggcactattgtgcttgcaagaaggcaaaatggaggacatgcaccatatgaataagaagtatctaatgggggagaaaacagaggaggagcatcatatggatatccatatgggtacaaaggagggtttggattggagaatggtggtggaggaggagcattagtgcaggaggaggactatcagtggtaagatcatcatttaaaggagaaggagcatccatatgagatcgatagggatacaaaggagcatgagtgggtatggaaacaaaggttatggtgtgtgggaacaaggacaaatagaagtatcctcccgatgatgatgcacaagagaaaggtcatcgaagaagacctaccccacattggttggggtattaggatgttgtagatattggccattggtcaagtccataaggtttaaaagttcagactccagctaggatatatatataaagagtgggagactataatataaagaaaggcgagtgttttggaaagtgatgggtgtgaataaacctgaacatcccatctttttatatgctagattccaagttttttaaagaagttgagtttttctagattttttagactttaaatggtataaaatatggactagtcaaaacatgccacatccctaaaggtggtcggtaccaacaaattcaaattggtataggtcgacaacttaaataaaagacattaggtctaaccgatatgtcagtacttgtagtatcatatgacgctagaataagcaattagagggggcgaatgattgtggaaggctaaaaataactataccacttcctcttaatcacaagaccaaaataatctacttttataaatctagacagatttttgatatgttagtaaaaacattgctagccaaaatcggtaacttagatctatttcaaagtttaatgattaaactagatacaattatgaaacaaacccaattataattatgttgatcacacttttgggtttaaagttagctacaaaacaagattgctactctagagagtaacggaaataaatctagatctaattcataattaaacaataataaaaaagattaatatttcaaactttgttgataagtaaataaatggcttagtaatgatctagatgaatcaaaatgataggaacaattgaaatcaaaggttcgacattagagtcttttcccactctgactagactcttgaaccatcgcatgggcctcatctggcctgctgccctcttggtatacccacgaccgcccgttgagcctatgcccctctttggccttccgtgtcgctctaccgaccaggctagctaccgcgtgggccaagttcctccctaaacctacttttgtatatcagttcctccctaatcattgtaccaaaaactagttctgtcaccaatgatgaccatgtttcacctcg

SEQ ID NO: 1134 - DNA, 2290 bp, Zea mays
  misc_feature (1)..(100): optimal_loci_225804_G1, chr6:112600704..112602993, Cluster 7
catatgctagtagctagtatgatccgttgagctagcatataccatatgcctcctggcactgattagcaggcagccatcccaatcggaaaaaaggccctagatcgactggcccggtggcaacatcaacgtgcacacgcgcaccggcatgggcacatgattagctgcaatttgagggggtgtgtggaaaaaggagagctcgccaccaagcagctggctgcaggatatgatgaggccaataacgtgctctggagctgtcggttgttctctgcgccgtcacatgtcgacccggttggcgcctcagctgcatggttgcattgcatcgctatcgcatcgagtatggcagggctgccggcagcagctcagctgcttgctgctgctccctcatccattatcctccttcacctgcgtccgtatgacgaccacactttgaccgaacatgcagggtgaatctgtactacaaggacttaacatgagctaattggtagttagaacgaaattagttcgtgactaaactatattttgtctagctattattacctcacggcggaggagctgtgagctttgggcgccctcgactggcgcgcgcgccattcctctttccaaaagataggcagggcctgctgtgtgtgctggcagtggcagcgggcggcagggcaagcacatgtgtgcgtggccaccgaggcgagcccgtccgcccgtccgcccgggcggcaataggcaggggcatcaatcctttcgttcctagggatcgatcgatctcatgagtgcaataaagagcggcagcgaccatttgctcgcctcacccggcctcacattcgcccgcgcacagaaacacacgcgcacaaagcatcagctgcagtgtggcagcaggcagcagcagcagcaatgcaaggcgtcgccgtcgcgtcactttcctcgcatttccccccggcctgcaccatttcctcccagagcgagccgagccagcagggaatctgcagtgtccggccggccacggttgcaacgcacaagaacggcggagaaggcagcacgctacagactatacatctacagtacataggagggagggccatgcatggctatatatgggggttggctggatcgtcggtgatatttaggggatatttggttcctttagtcatcctctttaaattttaggggttacacttaagtttctagaatttctgtttaggagaccttatttagttatacagtttggtagtttatagactaaaagtgattaaaatttagtcaactaaattaaagcttaggagatggaaaccaaacagaaacagctccttattattgcttttgtggttcgggacgacaacacagagtatggctggccgccaatgcctcggtcctcgccgtcgccggtcgccgccggcagccgaacagctctttcatacgtctctctctctccttcctttacattacattacactacaggaacgtgccttaggtccgttcattggcaatgttactcggatctgggccgtggaagcccgttcgctcctctcctagttggcccagattcagctttttgttcccgtcccgtcagttctcggtttgcattgttcctggtatgcgctgctcgctcgcaactgccgtaggctgctggagcttcagtgagtgaaagtaggggatgcatggcaatggtttgtcacgcacatacaagatacaactcctttgcatatgtaccgctgctgcaggctttggggggcggcggcgccggcgccggcggcagcagctttgtacgcggtggcgctgcgcaggccgcgacgcccgacgcagctggcgcgtgtgcgcggtgaatcggtcggtgatgatggcgacgcgtagcagaactagcagtaccacgcccacccaattggccattgttcatcagcccgcccctagtactactactctctctttctctctctctctatcccttttccgcagcgcatgcgaatgcgatgcgatgagctgatgaataattcctgccctagcttctgccctgctgcggttgccgcgccggagccttttcagaaaagggctcagctttcgtcgctctgaaacgctgcgcctgccgcgcgctgcccgctcctctacctctccctcctttctgcagcctcggccagtcggccctcggccggaggcgcgcgccatgccatcccgcgccatgatttgcgcttgatgcgccgatgatggtgcatgcatgggcatggccgctactgtctgtcgtccaataaccaaccaaggcaacggagctgcatgcatgccgtccggcactaccgcgtggttcatc

SEQ ID NO: 1135 - DNA, 1883 bp, Zea mays
  misc_feature (1)..(100): optimal_loci_226614_G1, chr6:117605253..117607135, Cluster 7
ccaacaccataaaacacactaacagaaaaaggaagacataatgctctaaagtgctacagctattgcagtttgcatcaacaagtggaccatacttttaaaaggcagaataatctcagtatttactttcggaataagaggatgttcaattgaatatagcgacttagttggctatttgcattttaaaactaaactgtgatgtgatgcctccagataaatgtacgcctgtagatggtgtcaacattgaagtcctcacaggggtgattatgaaggtatgattctaggtttgacagtatcttcatggtttgggtattgaaagattctgcatatgcaatgttgtagtactgttgtcatgagaaacttaacacgatgtgcatgcatatcacactccagtttcttgccttgaggtcagaagcacactacactgcttcgattgcacaatttagaggaagctgatttgactattacaagcttaatgaaattggataatgcatctttgacatcaatgccaaccaaagtctcagacatgtcaggtgattcttgtatccatattgtccaagccttggtcaacatggcatttgaaatgtacaaataccgagccttgagaatcgtggtccgttgtctttctttcattggttctagtgacaaaatgattgaaacctttttctgcaggtttgattcagttgttgcattggctgaaaaggctaagcttataaatcatgtgaactcagaactgaagtgatcctaaataacttgagattagcgatggctcgagcccaagagaatgactaaagcaggcaagtttgctgatgcatagcctacggtgaatggctgaaatatgagccctcaaatcaactgcaaccggtcatcatatcatgcttgccaaagctgggtcgatgtgcaaaagctgctgaggactgtgatatgtgtgatgttaattagttatgtcatatgaatttgtgtttatatgtattgttagttgaaataatattggattgtctaactctgtatcaaaattatcaaactgcctgtctaaaaatagggataaaaacacaatgatcataatacaacaggggcaaaaatatatggcaaaattgtccagttattcaaaacatcgttaggtgcatttcatacagtagcagtaaagtgtcctttcgttttaaaatcacagaggtaaaatcaccaaactcaaagaagtatgggcaaaattaccgtttcacttaaaaataggggtagaaatgccaaaaggcacaatgtatacatgtgaatactttaaaaagaacccataaataaaatattatgggacatctaatgatttctacggaaataatgcataatacatcataaaacatctcattaattagagagaaaaaaataaaaaataaaaattgaataaataaagtaaattcaaaaattaaaagggaaactaaaagaaataaatccacataaaaaaacaaagagaaagggaaaagaaagaaaaagggaaaaaagaagaatagttcttgtaataggcctaaaacatgcgagatgggcttctgtatgtgactatggagtaactaaaagcctttttttaatctgtgagttgggttaagaaccaattgatgggccgaaaaaacagtagagaatagagcagagagataaaggacgtggacgtgattggtcggcgccgcttccgtcctgaacagaaaggcaatggaaactcctctctcagaaaacaagcaagaaactggctgtcccaccgtgctgaccatggccgtagccgggttcaatgtcggagtgtgtacttttacgatcaagtctggtcggaatcaagtttctgaaacttgtagctgggagaaaaaaaacgtgtcgatgttctttgagtattcgctgattcatcatcatca

SEQ ID NO: 1136 - DNA, 1574 bp, Zea mays
  misc_feature (1)..(100): optimal_loci_232704_G1, chr6:147031681..147033254, Cluster 7
ttcctttgtgggtggaataccaacgcttaggcaaaacggtggttgaaaaaaaggcttagtccgataggaagatatattagaataaaccatgcgactactgtaattcgtttctctgaccgcgtaacagattataccttcacgggcatgttggcaaaccaatttttttttaaaaaaagaacagatttttttgtccacttttttcagttttctttacagaaagttgttatctgatcctcggcgtatagatttcctacttattcgcatcgcgcacggggaatatgcaaataagtgaacggacggacagggccacgcttgaaacgttgttgcttgggcaggttggctagctagcgttcgagctttctgaggaagtcgggagccacttgaacacctacctgatgggtcgacgaccgggacgtcgagggacacatggacgattcgcagtcgcagacacgcggcgggataagggtggtgcgtgatagcgagagcattggcgctgccacactgtgcctgtgcgcatcaattaagagagacgacgccacacccgcatccgcttatgatgggtctgaaccgtctgtcggtatctgctctgttcgtccctgttaccaattgcggtgttaatttatcagagatctcacgtgtggtttgtgattaaaaaaaaggagacgttattgctagaattgctagagtaaatcctaccaacagtttgcacaaagtgagagtagcagattatttgtagaaagaatagattaaaggagcggattttcggccgaaagaatcaatatagtcaaagcgatccaacaacaggttcgttcggccgggagtgtcattcattgagagtttgagacagagagagagagagagaaaaaaacagttagcctcaaaatcgagcgatgattggcaaattaagtatctttccactcagcatttgtgggttggcacatcatgccctaaaaaacaattttggtccacggcgaatctttatcccctcgattaaacaaccccagcaataaataaaaaaaaagagttgttctttttattctttctctttcaccaaagtcactgatccttttgttcctccttatctccatcacctaatgcagcagcatcagtaggcaggcaggcaggcacgcatccatcaaaccgagacctgtttttttgttattctaagcctctaggtacggcggcggtgctcatctcatgcacaccagcagcagcaataaacaaagccgggagctggggaggtttggagacatcaactggccggccggggttgagagatttgcttggcgacagcgacgcctgtccggcggcgacagtgaccttcggatgcttgggttgggttgggttggcgccacaggatcgttcgtttggctgctcgtacaaggtattgatgtggcgccactggatcctctcactaccctgtcttccaaaccatttggtcgcttctctgtttgtttgtctgaatatgttccaggttaaagagctttcggacaggataattaacattcttttgtccagcttttagcagtggctaacgacctcggattctttccatttggattttgactgagggc

SEQ ID NO: 1137 - DNA, 2306 bp, Zea mays
  misc_feature (1)..(100): optimal_loci_233813_G1, chr6:152057142..152059447, Cluster 7
agcacagcgtgagtcttcaagatcgatactttgtgtctttatacgaaaggcaatagcctaataagctaatagtaacatcatttccggctgaattgggccataccctggaaacggttagggcccatgcccctgcgatttggaatggaacgcgttatgctgcgccaacgtacaaagaccgaacaaacaggtgggactgccactgtcactgccgaaactgtcctaatgaacatcgatccttctcttcccggctatgttttacagtggcatgcgattgcctcgaaatcacaaacgagagactttgagagaacttgccattcattagcttctcgtccttatttttagaggaaaatagagctgagatgcacttggatgcctgccactacccaggtaggtaatctcgccagtctctacctcacggaaagcacatgcatataaacaaccctataaaatcttcgccgaattgcgagtaccagagatgccggggcggcataaaagaaagggaaacctcgtttccactccacgatcgacggtcagagtggcagacccaccattgggcattggctaaacctaaatccgcttgcctttgcctttaaccctgcttcacgtctgatcggcaagggcgcgcgcgcgcgtgctctccgcttctaatctctaataaagattattcgccactgcaaatttctttacgagattcccgcgtaaaagcgacgggatgggcctctctctctctcttgggctcgagtgggatcattctgatccggtttaggacagggctagatgcagacaggcagagttgtttatggggaaaccaagccattattgttctggtacttccttacagaattacctcggtatagtttcgccatcaccatcatgtgagggtgaggcggattagtgaaggatatatagaaactgggtgtgcagtcctgcagactttaaaatggttttctgctgtctggtaactgtgatgtaggctaagctgatctcgtctgctggctgttgcgttgcagctttcatggccaccaaactggaagcagactatggaatctcttccctgttttcagctttggacttcgtgctcttaaactactagtagggagtactggattcctttgttttatactatcaaatttaccaggctcttggttagctgttaggtacaccagaattgccaaatgttccaggcactaagcaagagacgcctgtgctgatgccagggcccaggagtcggtggaacctgccccattgacacatgcatgttcgcggcttcttgagaagccgaccttttcacaatttttctgttattacccaaaaccaaaaaaaagatttgctttcgctgctcattaatgtttgaagtctcgcattctcagatgcacagaagaaaaaggtgatcaatgggacaaaagtagccctcttaaatctactcgaccagcatggaaaaaaaagttgctaatccaatttgtggagccgtatcattcagatatgctagtttatgcgccatgcgcggatgcgcctgcgatgtgtaccaggagatgcatggtgacctagacagccattgatgggagcaaaaagttgctgcatccattggtttccccccacattgccttgttcccctctcgctctctctctctctctatatattttggtgtgagaaatttgtccctcgacagaccaattcttgcattttttctgatcatccgtagcttcaaaggcgaacatgatgccggtagtgtgaagcaattagcaatacatgcatcaatgtgtggtatagttgaaaactgcacccattttagattccaacttttgtgtgtcggccattaatttagggcgttccctgaaaatcaagttttgtgtgaaaaagggactactaggggcaacattttagatgagctactatgtttttcaaagacgtatatgttaggatgatatctcatgcacctttgatccttcatcgccctgcgttggcgctactttgagttgccaatgttcataaaccagagccaagcaacgcggacggggcggactgaaaaacgtcgtttctaggagtacacctttgtggatgaatctacatagggttctaagctgtttcctttagtttaaacatatgcagacaagtagaacagcaattaatcccttcagcaaatcatgactccgacttagtgacttccgacttcaagcatcttttcttattactgccacttatccataggcgctggaaagaataatcaacaactcaaacgtagatttgcgtttgttgtatgttaatctgttggagaaacaacacttcgtggtggcatccgtaccat

SEQ ID NO: 1138 - DNA, 1750 bp, Zea mays
  misc_feature (1)..(100): optimal_loci_234175_G1, chr6:153615952..153617701, Cluster 7
  modified_base (215)..(215): a, c, g, or t
  misc_feature (215)..(314): n is a, c, g, or t
  modified_base (216)..(216): a, c, g, or t
  modified_base (217)..(217): a, c, g, or t
  modified_base (218)..(218): a, c, g, or t
  modified_base (219)..(219): a, c, g, or t
  modified_base (220)..(220): a, c, g, or t
  modified_base (221)..(221): a, c, g, or t
  modified_base (222)..(222): a, c, g, or t
  modified_base (223)..(223): a, c, g, or t
  modified_base (224)..(224): a, c, g, or t
  modified_base (225)..(225): a, c, g, or t
  modified_base (226)..(226): a, c, g, or t
  modified_base (227)..(227): a, c, g, or t
  modified_base (228)..(228): a, c, g, or t
  modified_base (229)..(229): a, c, g, or t
  modified_base (230)..(230): a, c, g, or t
  modified_base (231)..(231): a, c, g, or t
  modified_base (232)..(232): a, c, g, or t
  modified_base (233)..(233): a, c, g, or t
  modified_base (234)..(234): a, c, g, or t
  modified_base (235)..(235): a, c, g, or t
  modified_base (236)..(236): a, c, g, or t
  modified_base (237)..(237): a, c, g, or t
  modified_base (238)..(238): a, c, g, or t
  modified_base (239)..(239): a, c, g, or t
  modified_base (240)..(240): a, c, g, or t
  modified_base (241)..(241): a, c, g, or t
  modified_base (242)..(242): a, c, g, or t
  modified_base (243)..(243): a, c, g, or t
  modified_base (244)..(244): a, c, g, or t
  modified_base (245)..(245): a, c, g, or t
  modified_base (246)..(246): a, c, g, or t
  modified_base (247)..(247): a, c, g, or t
  modified_base (248)..(248): a, c, g, or t
  modified_base (249)..(249): a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
tcttccctacaattcatgagctatatgcttccaagcgttccaattgtatatagtataaggtagtggccactaggtacatcaaaatccaaatgatcagtagtaactacttttagctaactaaaacactatgatgcataggaacaacattcaaagcatgctccgaggtcatcagatatttcaaacaaaacgaattcaagcttgaattcatccaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaactaggaggattcgtcgcttttttattattataggtggtggatggcaagggcatcaaatcccaggccttgttccctgccagttccagaagagtttctaaatcaagaacggtgagtgattcacaaagagttgattaattctcctgaatagaactggctttatgactactttgagcctctgtgcctgttctaaatccgtagggagtttcatgtttgtgaatgccatcggaagggatcaggctctggaatcagggagcaagattgtgtatgttgtctcgcaaatcctcttccatgaacaagttcaggctctggagaagtctggtgattgttaagtttctgggttctctgatgcaatcaggctagataatatcagctactcacagctctggcttaacagttgaatcgaagattaggatacgttggtaggagtactaggaagccttagattctagcattgggtaacatgtctattatcccatattatctaagtttaacaagatactcatattttatgaaaaaaaactatactgaaaaatcacgtccaacagtagctatgtgtgtgttattccatgtattattatcaacaatgatagttctgttacccatacttgtaatttggtatccatagtccaaccaagacataatcttagcatcaggaggagtgttctgacgaagccaatagtatgcctcacgataatcatcaaagataactcttccaccattatgaccccttgcggccaaaactatagatggaaaagagtaagcctcacatcatcaaagataactcttccaccattatgaccccttgcaaccatgaatagtacagattgcttttccaggtgtgtggagagacatgcgtattcctcctatgacaaattcctcaggctccatgaaggtaagcctgtcttaatgggcttgattgttgaacctgacttagtacttttatccatgtcacggcattgaaccagacagtcactcatgtccttaggatattaacggtatacatcaacaattcattctattttaattgcttgcaaaacttttttgggccttcagatgagttccaggcatcaagaagtcaagattccaggaggcctaaaataggtaaacttgttgttctataaacacatgttctccagattttatgttttctttgagcaatgtagactttgttatgccactatttatttcctactattttttatgtgtggcaccaaaattgtagtacccttctctgcaaaacctgattgctaggcattgttactactcttccttaccttttctcaagatccatgtattgtaccacaaaattcacacccacctatggaagaggtctcttatggtgcttcagctccacatgctcttcagttccctcaagtaaaagaggttatggtcaatggcgttcgtgtgaaagatgaaatactgtgagacttgc

SEQ ID NO: 1139 - DNA, 1952 bp, Zea mays
  misc_feature (1)..(100): optimal_loci_234187_G1, chr6:153654750..153656701, Cluster 7
caagccaccaagcttctgtgatacgattcttcgttagtgtgcaatcaaagcgatcaagtcgcacgtgacacgcccacacctggaagatggaagacagaagacggaaggccggatgttgccgttcagcacttaccattcgccctaaaataagttgggtagatagcgcaaatctaccactatagatgggttcaggtattggtgctgcgcatgagtacaggtattaaagtggtaagtttgtagtctaacggggctaggtcagagatagagcaacccgaccatcttcacatattgtcatccctagtcaggccggtgtgtatacgcgaaggaccgtgtcgacgacaacagtgacagacaacaacgaccagacagtataaattccttggcagactcgatggactagccagacgaccggcctattgaggcagccgcgcggctctcgacgtggttgagtgagcctccgtcgtgccatgcccagaccgctagagattttcgctggccagtagtagtagcagtagcagatcacatcacaatcacatccgtaaggcgtaagcccgtggtccatttgcagcgcgtgcgtgcgtgcggtgcaagtgcaagtgataaaagaaaaggtcaaggaaaggagaaagcagtaaagcgaagcgcccgttacgttgacagcagcccacttattatcgcgcgtaaataaaccaagcttgtctttactccaaagcactataggacgatcgacgacatgcacatccatgccactttctgtaggaccattttgattttttttttttttggtacggtctacctagtcggcccgcccggccggaaatgctccgccccacgcactaatgcatgttggtttcaacatcaccagctagctaggaacattgtggcaccgactggtagtccctgcatgcgtatacagtcctagctacgtgcgtgctagtagcggtcgaacttgcaccggccggaatccggaacgcaggccgaccgcagcgcacacgacaagagacgcgcatgcgcgcgtggacggcgagttggcgacgacgacggaagactgcgaagcgatccatctcagacgacaatcgaagcgaaaggtgaagaaaagcacgcgtgtagcatactagcatccatgacacggtcgatcgatcatcactacgtaggtgaccgggaaaaaaatcaaaaggagaagaagaggcaactagcgggttcatttggacgtgcacgtcgcggccggccgcgtacgtgcgcatgcgtttatttcgccgccggcgtgcgacgcgaccggccggcgcaccgcactgtggaaaataaaagcaagtagcagacgcctccccccttaatgacacgaaaacaaaacaacttctatgatatgagattattatatacaggcatgtcttgcacccgtctaagtagtcttatcatacttgctcttagcagttcaagcatgacgacagtaatggcgctgtatgtatgagctcgcatcctcttgtatgagttgcggacttgcgggtagtaactgaatggttcaccttgcaagttgcgggtagtaatacatcaaagatatattgtcatcaagtctcttgcagtgtcgttgctgtgagatagagttcgttctcttgtatgagctgatgatccctgcaactgcagtgtctgttttatggacgtgtgtctgtgatgaaggttattacatacgcatgcatgtgcttacgtgtatgtgatgaaaagtcggtacagactacagacgcacgtttacacgtctgtgatctgtgatgtcttttttttttctttttacataacgccgttaaaccttcggcttcggtttccaccgccggtcgtggttttcgcgagactggatccaagtcttgtacacacagtcctagagcagccgccgcacggcgaaaatgcttgtacgttgcaccggcggtcgagttacatatatattcagagagtgcgcgctt

SEQ ID NO: 1140 - DNA, 1532 bp, Zea mays
  misc_feature (1)..(100): optimal_loci_234881_G1, chr6:156686894..156688425, Cluster 7
aattcggtcagtaagaacttagcgatatgtttacttcttttgtttatataatttttttttattttaacttgtatcgtgtattgatacgaaacttggattctatataatactagctagtttttaggttgtgcttgatcttatcacctagttttcttaccccataaattcccgttatgcgtcccccactcctgccaacacttgttgagagctagtagctgttgagaacgtctcggccggggtctcgatcactcttcttttctacgtcaaggcgaaggcaacttacagattatattagtttatgcgagatcggtagagtcccatggatcttcctacgccaacaactcacctgctccccacgtcacacaacagtcgctcactgattgcagaaaaaaaaactagcaacgcccatccatgatggttgcgcaagagagatgtgtttctcctagctatagcatttgtttgggctttggcagctctcttcaatccattcaccacctaattttccatcttaatcacgtggattgggcatttttcacgtggattgagaatgggctaggtagctagggtgcaaccaaataagcccgtaggtgcttattttaatacacaaagcaagcatccaaacgcaagtgtttgactacagattgcttctgctgtgtccagtcggaaacaagaatggactaaggctaatcgctatttttttagtaacaagtgacgaaagcagcacaagctcatttttctctcttccagttcttcctcctttctctcctatctcccacttctttctctaatgaagtgggggtttattttcccttttcttcttcctcctccttccttaacaaccctcaatctctttcttcaatgtaatttcatggatgggggctggagcctcaacccctcttcagatccgcccctggctatgtccaatctttggtcatataagctcaaatcaaatttaaccaatataaacggcggattctactcgtttgtttccatattttttccaaaaatactgataagtatcggtttcagagttctaaaagcagctccaaaaaaccactaaaacataccctaaaatccgttttagacttaaaaacaaaaaatctcctctccaacggttccccaaactttccccaaaatttccagcatcccgtatctaggccccctcctccctcaaaatttcgtgacacgattcctccccaatccatgggcgtgtgcgcttcgccggtcgtttcccgtgtccattttgtcatgcgctcggtgagaaagtaacagaggcattggaatctacatgtcatattgagaaaaggcagaggaaggtgatgttttcttcatcccggcatacactcggtacctatactgcattaccataacttatgtgaggcctttagatgtttatttggtcaactcattttttactaggagcggcaaaacttgtggcttcgcaggacatagaaatttccctagattttgtagcgtagcatgatcagcataaatgcccatgtactgtcgtcaacacgtaggagcaaagagct

SEQ ID NO: 1141 - DNA, 1840 bp, Zea mays
  misc_feature (1)..(100): optimal_loci_236953_G1, chr6:167638080..167639919, Cluster 7
cgttgtataaagttgttgagcacaagagacatgaggatccggtcgctatcattatcatcataccagcccatgcctctcagtctcagcttgcaatgaattgaaggaggtgagttgctaactgatgcttcgtaaaacattggtaagcaaacaaacaaccttaaaacgggtcaatgagaccgaaaccaccgggtattaaaatcaacacatgctgataatgctagtaggtcgccaaattctgctgcaatgtccaacgaagaaagatttctgcgaaattaagtacagatcataatactgtttgacactgtatttgagcaatgggtatcactatccactcactccagtacctttgactttgagcaatggttatcggtagatcgctgagctaacagtccatcaagctggtcaacaagcaagtcgtccaagcaaacagctagcgtatgttcgtatgcactaaacagctagtgtcttggttaataatgctaaatatattttttattgtcttttcccttcgaattaaagtcagctgtttggtctactgcaactgcaatttatagcgacaaaaacaatatagaataagtacgaattaaagtcaagcgaatagattgttggttaatgctagacagacatatttgtccttggattcttaaaaggattcaaaaaaaaaagcaagggattaaatgttaaaaagaaattgctagagaagagcgctaggctgctggcgtgtttcagcgcgccggcggacacccatggtgctcgccggcgttcacatgctgacgctaccacagtagcacactactactccgacgatccgacaactgctactggtgcacggaacacacggccgtgaatgtgacgggtgtccgcgtcacggtcggggccgtgtctgccggccggcgatgccaacacgccgacgtgaggtgggcatgggcagcaactagcacgtgcggcggcaatcacgtcggtgttgcctggccggccgccggcgaaggatggacgactggagtggactggaggagcaatgcaaatacccaccggacacggacacggacacgcagcagcgttgccgctcgtcccatttgtcaacgaaagctatcggaagccaagccatcgacatcgacattgcacaggccgcttgcttgggctgaatgtcttgtctgatgggctcacggactcagacctgcctctgctctgcaaggagaagcaaggaagacgagacaggacacccggtctcctctcaagaaggaagaagccactgtccgctcctgcgtcatgccacacgcccacacccagcagcaattcccagacttgccttggcccttggacaggattggagacccaacccataaacttgcacgtgacttttacaactttggtctctattcatgtatacggtatagcttgtttggttgttatgcaaccaaagaagccattgttctagtagtgttaagttacacatgttgttggaagccaccattcctgcctagcttatatgaatgtccacatcgaagctattttctgcgagcgttggatttttagatgcaagaacgttgtgttgtgttggatacgagaatacagttaagcttattatggataatttggtcttaaacataattagtatgtatgtcctctaaatatgatacgatgaagtgctaagggatttttatggaaagacttagatgacatgtttacaactatatccgttacttagaagttctattatttaaaagtgctaagggaattttatggaccccctgtcagactgttctggtatgtgactgtcccgaaggtttgcagtcttgtcaggtgcaccggactggatccatgtgccactgtaccatcg

SEQ ID NO: 1142 - DNA, 1704 bp, Zea mays
  misc_feature (1)..(100): optimal_loci_240014_G1, chr7:15678897..15680600, Cluster 7
tagccgcaagttcatttctaatctccttcgatcataaaagaatttaagtttctaaatttttggtcgaagagatcccaccacttacatattcgtaaactcgtaaattttgcagtacgtagctgtgcgcaaaagaactcgttattatatatgtaaatctagctagttttgaccacataaaataatattacatatatgataggtcttttaatttattattcttcccctggtccagatattacgcatacacaactggcaagtaataatcggggaaactattccattacgtttaataatagagatacatgtattccattacgtttgtagtatatataattttggtcagttagttatatatactacgtactgtaccttttgtccttcttacagatttgttgtgactactattaatattgccgaaattaagtccactaggatgtaataattgacccaatattatattatactaaatgcagtgaagcaatatttagacgaacaactttgtctttatcttgtagttttaatttttccaatattattgttgttatgacatcagagcacacaaatcataggaggcgcgtcgttctgtaccgctctgtacctgctttatagtccttgtgagtatattatttgtatgaacgtatgtatacatgcatgtattcatgcgtgtatgtaattgataatacagaagggcgactgtgtacagtacggaaggacgcatgagactgtgatgacgtccacgtagtttgtcgtatcccgccgccctacgtcagtcacatcatgtgcaagtgcaaagttgagtacgctcgtaattagtacttaattattattagtaaactctaatccatctgtctttactactattctttttgtatcggtactgcactacgcctctagctactttaattaatactgtgtcttctctatcgtctggctgatgcatgcatatctattattgtcgatcgatctatggatatataggctggaaatgatcgaaaacgaggctccaccacttttattttcatatattattttaacgaaaatcataacttatgatattatcagaaacgaaaacatgattggtgcttcaatagtacgtatcgaaagctaacgaaagtatacgattacttcgataatgatcggaaaataaatactaaaataattatttttaaacgacaaccaatgctaaccagataatatgatagccatatatgttataagtatgacttgatccatatcatacaactgctacgtaaaaacaaaatagacatagatgtggtattaatctaaccgtgtattatgcatgtaagtcgcatacgacatatacttgccatgtcacacagaacaatagaaataataaaacatgagaccataacaaagttcattgtctccattttgacattgatatacaatcaaaccggcaataatatagcacgatgggtaggacacaaattttagtacgtacttattaatagttgacagcatgagacaagtccacaaccacaaccaaattctatgagacactcagcataatggcatgcatactgctagtctgctagactgctagtcatattccatatagaattttagatgttggtaggctactacgtaacccatgaacccaacatccatttgatctcaccatctcagttctcacactcacacgctcgcagattcaccttgggcatgtcgtcctcatccttccac

SEQ ID NO: 1143 - DNA, 1658 bp, Zea mays
  misc_feature (1)..(100): optimal_loci_243300_G1, chr7:34452240..34453897, Cluster 7
tatgttatatatactatataagaataatggcctattttaagtcctagacctccaatttgtcaggacgaccagcaccgacaaaaatgaaggtgaaactcttctagctaaactgcttaataagtcctagctttagctttactagtgaaactgatctaccgtagatcaaagtaaatgcaagatttaaattcacctttttaatatctacgaaactattccaaacatgctcctagtaagagcactagctagcaccgcgcccgatgtggtatgggccggggcgagcgcgcgtacgtgaccgctggcacatcgtattttataattggacgaccgccgccgcagggagacaaatcatgaatgaatgaataatactccactccgtcctaccttcaccgagaggagagaaaaagctcgcccaagggcggcggctccgccgtcgacgtcgtcgtctgcgactgtatatatggccgtacaagccggcgggcggaggcgacgcatcgtcgcggaaccttcttgtcgtggatcggccggccggcggggcgaggcgacgcacgcatcgcggaaccttcttgccgtctgcgtgtgctccaggtccaggaggagagatcgacctgtctctgtctttgtttcatatttatatattttagtatatagttttatatgttatctgtctgctgctgcgtacgtgctgcagccagtagtgacttggttttgtatatgcgtattactgatgacggaaatagatatgcaggttcgtctctgatgctcactgcgtaatcttcttctcattattgtgtttgctgctgatactactactgctagtatggttaggttgtttatatactccgtctgaagaagactaattccgatcgaggatttcgctacgcatgcagtgaacaactgaacataatcatcgatcgcataacttattattatatgatgctagctaataataataacggttactcctcgtaagtagatagcgacagcggcagcagagaggttgatccggatagccgggatgatgaaagagacaactcagtcgcaagtggaagtgcctagctttgtcttgtgtgcgactaaagacaagtggcagggtctctccttcagatttttttctataaataaacaccgaggatagattggtcatttccaacagggggttttactttcacacatgtagtatccttcatgtagtagtttccaatgttggtgaagaaatagaagtaatcacatacgtctagaaaaaacccttaataatatatatactttttattttatatactttaatttgggagcttgaaaataccggtgaataaaggtacatgttgcaaactggtttcaacccaaaaaaaactacatatctcactagttcatatttgctgctatatgtatagatctcccgtagatttctatatataaagtgctcaaaaattattaagtgttgtggctttttaggctgcgtttggtagcgctttttcagctccgctccaaagtagaatcaattctcggatgccaaacggtcaaaaaaccagacgcttcaccgaaggagcggatcgaatcgcgtccaataattgtactggcacatgggagcgaaaaaaacatgctctaccggctctctcacccgctcgggaatccagccacaagcctaacctgccttttgt

SEQ ID NO: 1144 - DNA, 1430 bp, Zea mays
  misc_feature (1)..(100): optimal_loci_255779_G1, chr7:117302854..117304283, Cluster 7
aattccctagatgtcatcgaaaattatatccattctttaatgtgctcatatgttatacaaacaaaaattatctactagatgtcattcagtgacaaacaagggatgaatataaaatccgatagcttacatgggatcccttgtgcaattcggtcgcccaacaccatcgcccgttcggcgtgcgcgtgcgtgacgacagcaaagctaaccgatcctcttgcacgtctaaattttcctctatctcccagctccatcagggtcccgtctcctactcctctttttacgcagtggcagtggcactgttcatcatcagatcaagaagatttttcatcttcatctttttgacgtacgtagtggcactgtaatcacccatctaataacacactctaaacacccctgcactgcatgtgccgtcgccacctgtgcgatcgagccgtcgtcggggagtcactctcgcgagaagggacgggacggcaatgtggcattcgaattttcaacaaagtgagaaggctgcaacgactgcgagccggccggtcaccggtgtgaccgtgtgaggccaataaatccatcttccatcaggcaccgcccgcccgcccatagtcttcacttgcccatctagtcagcactcagcagcagctatgcctcctatatatgcaggaagcgaagagtaataccctttttttttgaatcacggtacactcgtttggggtgtttggggtgaagtattttttttataatttttagacaatattatgttttctacaggagtattttatgccatgagatatttgcatgctttcctaaagactatgttttcaaaactatgatattattctggataccatgttatttttgtagtattagaaactacactctaactcaaaattttcatgatatggctagcttttgcctaagtaccataatttgtaatattgtatccaaacaacagataatattcttgaagcggaccaaaactatggtaaatatcatgataattgcaaaatataagtactattcattctgttatgacttctttttattagggatatttttaaatagtttgtttatcttattgtttataaaaaaactgaataaaattaattgccattgatatctaaaagtaaaattgtttcaggatggagagagagtgagggagtaggtgcaacaacctttttatttggttgatgtggtagtgatgtttctgtccggccaagtctaggagagaagctgattggttgaattgatggggctcctcaccccgcagccgcaccggcgcaccctgctctcttgtcttatgcaggatggctgtccttagcgcatggagcaggcctggctcaagaaattgatgttgcatctcgagaacctgactcatgcaaaaccaaaacacttggctaacactgtttacaaatttacgtttgatatagaaggtaagt

SEQ ID NO: 1145 - DNA, 1762 bp, Zea mays
  misc_feature (1)..(100): optimal_loci_257063_G1, chr7:123588284..123590045, Cluster 7
ggggtgtgccatacgctctcggctcggggcacataaattgtctaaagctatcctcagcggtaacttcgtagcactttttccaacgctgccacaccgtcgaaactgctatgaaacaaaaaatgaaacaatgtctctcaacacaaaaaatttcacttcactatttcatacactaacatatcgattaaatgatgcaactagatgaccaatagaaattaataaaatatgtgaagatagaataaatcattctcgatggaagtttcacacggtttacaagaacttggaaattagctagcatggttttgtcccccactcccccatgaaaaccaatttcatccaatgaaactcaatcctcataaatattatgacatgccatcaaaaaaaaagtttgatgttgcacactaataaatacgcatgaaagaaatcaccgttgtgaatagcataacaaagaatccattgctaataacgttaggtgtttttagcgcactctctctctctctctcttctctgtcagcgagaatgcatcgtcggccagctccgacatatatcgttggggccgtcctaaatataatatctctaatgacattgagatttccaaacaattccaaaattatatctattttgagacgaaagcgagtacggggtatttattaacaagagtatatgcgatcattttcgccatgcggtcgatttcacgcgacaccgctgaatccgaatcgatcgtggacttgtggcgactccgagtaccactcgaccgggacgagggaatatagtagaagctagcgggttcccatcgtggcccggccggtgtgtgaacacggcacatattcgtcgaaaaggcacaaaccttcacgcatttctctactgtactccgatatcgccctaccctactactactattctgctttttttctctctagaaaagcttttgccatctctattcaatgacgacgcgcacgtacgaactcctgattcctttttctatttatcgttataattgccgacggtccttcgtcgcgaggataataaaacaatgatctcgtacgttgacaataacaccatatatatatatatatacaaacacacaaaaatgtcgtgtgtgcttcgcagatcgcgagaccatgcatgcatcatccgtccgtcctggaaggtttcgtccagaagcaaagaatccccgtgcatatctttgctcgtttttttattgctttttgcgagaacgtacacacacatatctgatcctgatcctcctttttttttttgcgtgcaaggatatgatcgaatgccctttgtcgttgtcgcgttgacaaacagtttccaaacagcgtgatgcaagctgctgcacggctgcccataccagtagtatacacacactcgcatctacggtgtactgtgcgctgcttacgtgatggaacggcacgctgtcagcgtacgtacgtacgtagctacagctgctcgagctggacgcgacgctcgatgctacgttacgtactcctaaatctcgggtcgattggattttcggatcaccctgctatgacgactttttttctccttggcgcagcgcggtataccagtaaagagccagaccggcgcgcagcctttgcatgattgatcgatgcgcaacagaagagaggccgggcatgcatggctctgccgcctgccgccacgcgcatgcagacgccatggtcgtgcaagggagccccggcttgcacggtggacaaccaagagtcggccttgagctccccctctgacagccaggcaggggccc

SEQ ID NO: 1146 - DNA, 3259 bp, Zea mays
  misc_feature (1)..(100): optimal_loci_257067_G1, chr7:123593006..123596264, Cluster 7
atctcttttgaaaagccgtaactttaaaatccacgacttattagctcaacatctactatcctatacaattagctgcagagggtggactcctagaatttggggaactagggcggccgctgtggtggcactatgcccggagccggctctggcacagaggcactgcttggacctggccggctggcctggcccgatcatcgcagcggcagcgcacgcacgggccccggccgaccgggtcgcgcgaggccaagcgcatggcgccgctgcatggctgccaccgccatggcgcgcgcgcgggcgtgggtcccccccccccccccccccccccaccggcgacggagggcgatggacgctctgcgccgaggcgcacggcaacggcatggcctgcctgccagcctgcctggagtggtcagggcgaattattgggagcgggagcggccgagcgggcatgggattgggataggaaaacgacgtgtgcagtgcgtggcacggccgcatgcacgcgccatggcgggcgatcccacccacccatccactggccgctgcgccctcgtcttgtccctgtggttctctggttccccagcacagcggccgatcccacccacccatccactcgccttgtccgtgtgcggtgcggcatcgatagctagcttgttgttgccggacgtttgtgcttgtctcttgtccgcatcggatgcgtttgcgacccgcagcgcacaggaccaaagctcggtcggtcgtactcgtactaccaacactgttgcctcgctccccccccccccccccccccctcaatcgccatgcgctgcttccgcggggacggctcacggaacaggtgcggccatgctcattgcagggggcctgatggcaacacgcgcgcacgctagaaccacttatactgtaccttggcttggctccatgatgcacgcaaacagcgggaacggcatgatgcatggacgactcatggtttcagcacgtgagtgtcgctgtcagcaggcaggcaggcaggcaggatggtggcccctgcaggaagtaaaatatttcggttacgtttggtttgaacatgctgcgctgttactactgttattaatcacggattcatggacacgtcgttttcctatccacatgctcgctctagcagaattgttgtacacaagctactcctatccacatgccatatagtagtcctactactgttctagtagtagcttgtgtacaacaattgtcagggaagaacacagtcgcgccttgaaaaatctcatatgaaatcacgaggcgggcaagcgcgcaagcaagcattactcaaccacttgcatcacgagtcaggacacacggctgttaaaaaccgtactattactgtaacccgcgaggcttcgatgccagatctatcgaaaccgttgagctgtaaacataacaactgtagagacggaaaataccagacgacgaccctctatttctttatttaccataacaaccatgatcatgacatcctactacccccgcgcgtggctgctgcttaattagcttgctccgcgcgtcaggcaactttgaagggggaaaaaaaagaactacgggagaggatacaccgatacatgactactgtagactgaagactgtacagtgctacatgctcgatcgctctagcagaggggaactgcagcaccattgattatggccctaatgatgccgggacggaccgggggcagcgaaaagcctggcgatgcggatcggtggccgggggcgggcatgcaacgcgcgacgagccgacgacgacgacgtgcatccaagcacgaggctgctgcggccacgacgcaatgatgactggctacgtacttaggcacacgcactagcagagtagcagcacgcgacgcgccagaccgaggtggttaggtcgtcctggtacggcgacggactgacggttttgcggtacgcatgttcgtagcgaagcgagcggtcggccttcggtccatctggctggcttaacttggcttgtcttactgcagatacagctgcttctatctcgctggctaatacagcatacagatacagcagcgccaattgacatgcaagactacatcgtgggcgtcgtgacagctagctgctgctttcgagatactgtaaagcaaagacaatgacgaacaaatgattgcacaagtcaaagccgaggagtggggtgcgggtgcgggtgcagggcgagcgtgcagctggaccatcatctgcaacagatagctctgctctggctaggaaaaagggaaagcgaggcctacctagacgcagcagaacacatctacgctacgtccgtgcatgggccatgggcccccttctcagctttgaccagagcggcaggcaaagctccccaacgtgcagtggagcaggagcaccgtcgtcgaagctcagccactggccaaaagcagatcgagcaattaagagaaaccagcagccacactgacccgcatcatttgcaccagccgcctctcggcaaacgttgcgctgtgcgcatacatgtgctagtaatagtagcacacgtcttcctcctcctccggcccggcccggccgcctgaggcagtataggcaggtagtagcaggctaactagtggctagcctgttgcgatctattagcgcgcgtccctctccagtcaccacgacaacttttccccccacgcgacgcgagacaaacgggggacggacgggagaaggctttatctggacacgcacgcctttgcattgcacccacctaacgccgccgctgacgatgactttgttaatacacggacgatcgatcgatcgcgcatccagggggggtttagtccaacatgcttagccaagtaatcatggcgattgcgctagcgcccgcgcttttgtggacttgggccacataccgcatgtttggttcactgctgagatggtgcagctgcatccgtggaactttaaagcacattttgtttggttattgaatgagctgatacaggcgcccggtatgcagaaaagacaggcgagccaggctccgcagagacgctcgttggctgcgtacgcgcgcgtgcaagcacgcctcatacaaccttatgttcatgcacgcaaaaccaaaaacattttttggtttgttttttttgttatatttctaactaaaagatttaatcactgaactgattttatatttatgtttttggtattttatgaataaaactagaccacacatgctgtataatacttgaagatttatttgtacactttttctaatacacgttctgatacagataaccaa

SEQ ID NO: 1147 - DNA, 2004 bp, Zea mays
  misc_feature (1)..(100): optimal_loci_262784_G1, chr7:155767046..155769049, Cluster 7
taacgtcgagacatgttacctggttgccctctatagataaaaataaaaataagacatctagaaattttaaaaaaatataagaaattagacgagcggactaggagactatgtgggctggcaaggatgtttggcggccagttagatagcccacgtgcacaaaggccaacttcggcccacgaaacgtcagttacaactggagcccaggcccaacgtccagcccgtggtcctgcattgatctgttgcagttgcagttgctgctgagagtagcagccgtggtatatagaagaggtggagcagagctcgccgccgaatgacttgtcctacacggctacacggcgctggtggtggcgtccggccgacggggatgaggtgggccttggcgtacgtcttcgtctgccatgctactggctactgctccttactttgcatcgcatcctaccccggaggacgccgtcgctgtttgtcgatctctctgcactcctcgatgatggcccaagccccgcttacaccgatgcaggggtacacacgttaacagcgaccgtaaataatctcatcccacgactaattcgactctctgaaagagagcggcccaactaccattaactgaacgtggcctaaaatcttgcgatttcaagcacctgaaatgtcggcgcccgtgattaagatacgaacgaatgagagagtaaacatgaacagttgtgattagttttcagctagccaaggcgcacaaattactagcccgcgtcacactgcagttgcgtgccatcggtcaaccgaacattcaacgagccatatgcaagttttctacccaatgcggtgccccaggctttgctcacaacacaagcaagaagcggcggcgagcgttaaacaaatcgaggtgattccaaagcattgcttgatgctatgtgcatgcccccatggccctgtgccatttgacccagacagtgttggagtttattagacttggtctaattgtttagcaataaattcagaataaatctcaaacgcttactcatgaaatctgacattgtcttacacaacgagcttagaactgaatctatcagatcataaagatcttattcgactcagcttttgactttgtcgacaagttcggaactgaattcgttagatcatggagatcttagtcgacccagttttttactcaatcttgtgcgacaagttcggaactgaattcattatgtcgtggacattgtaacaaagttagtttcagaacctattcttttgtgtgtggttattctaagtctagtcctcatatataacagagagggtgttctgcctgaaaggtacgagaaacaactaatccactacgatttagtattttaggcaagagactcggcgctgcggggatcatacctgatgattttaatctattatgtggacgtgcttttatttactatatatgattcatccatagtttatgtattgattgttttaaaaaaataatttaatcttaaaagtacctaacaacgagcacaaagtacagacactgagacagatgtgtgtttgatctcagttcagacacaccgacacccacaggcaggagtgcaagtgcaggagaggccagcattaattagtgcctataatcgttactgtaagaatcccccggtcagcggtttgggggcacgaattccgatgtcaacctgcatgggcggccatgcacggataggctagagtttacgacagccgcaagctttgtgtgcggggtcagccggacagggcagagtgtcctctgctgctgcatgctacgtatgcgtgtgccttctctgctgctaataagaaccggccaagcaatgaagcaagtttactatattttttttgttcctttgccattttgacacgcaatattattggtctcttacactttggagtttagtgtgcaattgatttggagcagccatggaaaattagggtgtgggggcaaattcgcaattctgtactgtgctgtgcaactgatttttttttgtttctttatattgtgttatt

SEQ ID NO: 1148 - DNA, 2262 bp, Zea mays
  misc_feature (1)..(100): optimal_loci_262990_G1, chr7:156676884..156679145, Cluster 7
ttcacaatagacattgaagaccatttctatagtagtgcaagatcacttgctgcttttctcgcgtggacaggcctgtttcgtttttttgctttgccgaatgatgctctctcatctcatctctcccgccgctgctctcggcagtcgtctacctacctacgcgcacctttgcatgggtgcgagagaaagaaagccctcctagctgcctgcgcaaagcaccgtgtggagcagaagttagagaagagaacacacaacacccccatcaaggatcgcgggccgctagctctcatcaaggatcggacaaacgcacggcgagagggcgacgcgcgccgatgcaccatgcatgcagatctgctgctcgatccgcatgcagcccactggccgccaacctggccattggccagaagcaaaagcttttgcttttgcatgcccctgcagcctgcgcctgcagacgctagcttttccccccggcctcttcctcttcctcttcctcctcctccctctgtgagtccaccatccccatgtcgtccccccgctccgctggaagactgggacatgcatgcatgcatgcatgggatcagtcctcagtcggccactcgctcgttcactcatcgctttgcatgcgctgccgtgtgttcagttaatcagctcatcagtcgcgtgtgctcagtgatcagggcgagacgaccctacaaccataaccacaattgcagcagtcaccgctgcagggaagcctgcgcaggtcggatcagaaccagatcgcttgcaagttgctaataagtaagtgatcagatcgggcccaactcccaagcctacggatctcggtgattgattagccgcgccgtgaccgtacgtgtggtggttacagtaccagtgtctgcgttgcacgtacgggtttgcacttggcgtacgtgccactactcatgcaagtacgcggaacgcagtaatataatggcagcttaactatgaacatctgaaacagacgatggtcccatctcctaaggctataaggggggtctccacgtacgtactgtacagccatgtcgagtaacactcctgtcccaaagatgagatgccagctgatgcatgcacactcactactacgtacactgggagttacgcagcagcagcttagcattatattaacccttggactggtagtaatacgagatcttcttaacctttggagggactgactgaccatgcacgtatgaccagcaagattgcaagaattgacgagtcgactggcaactgcacgggcaggtccgctagctgtacgtggggctgccagcaaatccgccgagatccaggcatgcatcatgcatgcgtggcaaaggtccgcgtcgcggacgtctcacagtgatccatcgatcagtaaattcattccgtgttcatgatgcacgtcaacctgataaggatgtatcgaacgtcgtttctagcagctagctatatggaacgaagtatcggccctctgctggccaatgtagtgcgtacgtgtcgtgtgtgtcactctctcctttcgatgactccttgctcaagctcaactagcagaccagcaccctcggatccgatactatatatagatcggtcgcgtatatacgtacgtacgttcggtgggtagtgcaggtcggccgcatatacatcgggcaatatgttctagtagtgtggccgattcgatgcatattggatcaagatttgtgttgtcgtttggaagagagagacacatgtgtcattctaagagggccggtgacctgaccgggatatggaagaagcgctgcatgcatgcaaaccataaatgaagctacctagcaagctctggatcggagccaaacttttcttcacctgcgtacttagctcttgctagggtttatagatcggaatggacaaaggaagcttttttgtgttggtgaatgtctgactgctagcgactgtatgagctagctatagtcattcatatatgcatgcatgccacgcaaaagcatacaatcatgaccaaacgcttgcagttcaatcctaattatatgaataccagctacgcagccagccagccttgcttttggtggtcttgagatgtgctagtgtgtatattggtgtaatgttggtaaaagatcgagtaaaataaaagttgtctctatataagaccagtggttaacacattctttttatggtgtattaattggtatcttgaaattgttaaaggtcgtagtttcgttactgccgtaatgaaatttgttattacagtggtggggaaaaaacgctaacaca

SEQ ID NO: 1149 - DNA, 1786 bp, Zea mays
  misc_feature (1)..(100): optimal_loci_263130_G1, chr7:157159272..157161057, Cluster 7
tcaacaggaacatttgctgactaatcttcttcgttcctcaatcatgtgtccagtagttagtgctatgattgcattactattatttttagtaatggaaaatgaacaccataaccaacctctgtatacgtacccagataaagccggtagtcgtactactcatgcattctttcaatagtatgttattgttatttagtcaattagtctctacacactccactactgtgtgtcaatccctttctctttttttagagcgccaagaaaaggcggatcaaactcaaaaggcatgacggagaggaaacctgttcgcaccaagtgctacaaaaccacaccattcgttaaagggagaggcaagccttttctaagattcccactcaggaactgaccaagtatatatagtaaccagagtgcaggtctcttggtgtagtagaaaactggagtagcttgtcgctccaagaagaccaatgagaccacgtggcaaaaactgtagcgcagcagcctacgcagtcaaaaacgaacactgtctgcatacgtacacgagctagctagcactagtaccgtcatgcttacagtagcgtgaggcatttgtcggtacgtaggttgcatgggtataaatgcgatattgccgtgttcttgcatgcatgccttatgtctacggccgccggccaaccggccggccgtcctatcctaaatcatggacggagtatctctcttcgaccaccgtacgtacgctatcaagacggatcgcctgagcgagtacgtgtcgcatacatgtacgtacctctccttggtttccataccaaaaagaggatatgtcgcatactttcacacacatgcatgcatgattggatgaacgccgcacacggtcctgatcgccgccgtcgccatcagccggcggggaaggtgaagaagagcacgcagcagtagtgattccgtatagcaccactaccacctggacctggacacgattccaaacacctgtaactggggtagcttaattagcacgcggtacattttaccttttgcctagcggaataacgcccacagatcaaactgcgccgcgggcggcgaagaaaaccgagcaatcgatgagatgatgatgtgaggaggcgtcccggcgcccgtacgtcgtccatccgtgtcgacccgcgggggtgaagtcaaccgggtttatgattggggccagggcgaagcgacagcgacggccgcggccgcgcgaggaggtggcagcccacgcgtccccgccgagacgcgccgggcggcggccgcgaccgcgagcccgcgacgacgcgacgaaatcggccaaccaaagccaccgagaacacggagccgcgcgggcgcgcggggatgtatggactatggagcgtgtcgcgatcgcgatcgcgacgctcgcgcgggcccctacgaacgtacagtacagacggcggcggcccctgtgtgcatcgatgcgcgcgcacggacattgccggctacgaaaccgccgcgtccatagctagtttttggttcgacaggtacagactgtagtaagagtaagtactatatcatagaggaacgctgatttgttctcgcgcgaccgtgcaccgtgtggctcgctgcagggtgcaccgtgtggctctccctgctggctgctgcgccatcctttcctaatttctacacgtgagtgacggccggccggtccccgtcgagcggtcaacaactatatatactccatgtgtataaactacgtacgcacatgtacgccttttgttctaacttcaatgttccagcaacggctagtaatgccatccac

SEQ ID NO: 1150 - DNA, 2041 bp, Zea mays
  misc_feature (1)..(100): optimal_loci_263619_G1, chr7:159745763..159747803, Cluster 7
gctaatatttctatccatgcagtttcctacacgtgcattttcataattatcggtccacgatgagagagattctctctcacgcccacaaatttctcctccatgattgcagccaggggtaaccagcggaaaaaacaaaactacgctaattttcgtgtaaagcctttagacgtcttgtttcatatgaaggagggagtgtgtatctaccgatgccgctggatagcgaaacaaatcttctgcagtccttagttcctcttgtgaagaggccagagcaccacagctctgagaaatgggatgccctgctgtaaagaaaccacatggacggagatggtcaggtacagatacggtctttggtagtttctcatgttgagtgtggcagtcttaccaaacaacaacacacgctgatccaatgcttattcaggttgacgtacgcgatgctcgacaagacgatctgtgcactgtcaaacgtgttcataggatcatcagggtacaccttcacgcactcttccggctggggggggggggggggggggggggctggggaccagcgtcgcgctgtgacgagtacctctgccagggtgagctgcctaacttcatagcagagccagattgagaaggcgacttcccaggaggatcgatcgatcgatcgatagctgcaatttcccccgtcgtgtccatatgttctattcactaaaaaaaaagctggcggtgtgtacatctagtagtgtgatctgtggtaggggccagaggggtctctgtatcggtgtgatagtgatacaaagagcttcgagagagagaacttctctttgccgctgtttcttgtttgtgcagtaactaacctttgttagatgatgacgctggcgctctggttcggtgccgattcttcacttgcactgttttctaaacctttgctgtcattggtgtactgaaactcgcatagtgtcatgcgattcagtattccaaatcttcagactgttgttactcgagaatagcctttgaatcgcgtgaaagatatacatatactgttagatagtataaatatgtgtaatatttttttactcaaacgattgcttaaataagtactttagagaatactaggttttaaaaaaaggctattgcttgctgggaccggaatttgtaatagactaatagctagcaaaagtagtcgggtcgggggttgaacgttctagagaagagagatggagatgtcgtgccactgccgccttcgcccttggggagcagaaatgcggccgttggcagtcgctagctgcgcctgcgcgccgtcgtcaacgatcagaagtggcgtgcgatgcgctgcctgcggcggcggcctgtgactgcccgttgtcggtcgcgctgcacaaaagccgttcagagctcagattatccgaaaccgaaacgtactagcacctgcagtacttctaaaaaaatgccgaagcatctttgactccttgttgttgttacacacttgaaatcgtcatcgccgcctactggaaagcatgaagagtacggtacactctgtaggactgtagagaagtaagtactagtactgttccaattccatggagacttgccggcaggcggcaggagagttggcgcgcgcgtgcagcggtcggcgaccagaccacaacgtcaggccaggccagtacgtagactgacatgctggaggtgctggggatatcgtacgtgcgtgcgtcctgctgatgatcgatttgtccctcttttttgtagtcaaacatgctggagcgctagctggggatatcatacatgcacgtccatgagtccatccaaccaatcggctgctatatctcgtaatagatcaatacaacagtttggttttagtgtcactaccgttgctttttttttcttcccccaccattgggatcttcaattccgtgttcagttcagtatactgctcgattctgtccctctttttttagtcaaacatgtacaaatatcctcggtatcctccgcttgctctcgcccttttcatggcacgggaatcaaatctgaatcaaacacgggtcgatcccaccgccaaaca

SEQ ID NO: 1151 - DNA, 1566 bp, Zea mays
  misc_feature (1)..(100): optimal_loci_26395_G1, chr1:160709153..160710718, Cluster 7
actatatttgggtaccctagtactcaacccaatacatatgagttgatgaggattgggtgtaaattagtttaatttacaccccaatactccttaactcatatgaattgtggtgaatactatggtatccaaacaagccattaggagaccgggtgaaaatactccccgcggtgaaagatataggcaaaaaccaatctcgatggggcagggtacgttccatcaacccacccaccccccgcccaatcctcgcaacccgtcggggcccaatatgacaggtggaaccctacctcagcgtccgtattccaaattccctgatcctcatccattccaattcaacggaccgactaaccctagcttctgttaggctggcgcctagtgactgttttcgtgcgctccttcggcgttccatgttcttgcagcgcggcggtggcctgctgccctgccggcctctcacctccagcactccatcctcctgctcagctgctcctgttcgttggccccgttgctgcgttgttgcccttgggccagccagccagcacgccaaggagcaacagccacggaatcacggagatctactgaatccagaaattcaggtgagtctttgctttaattgtatcccctactttaacccttttgaattatttccaaacggctgaagtcaacttctctttgaaccaacaccaccttcctggtcttcatcatcagaaacttcaatctcttccacttccgcatttcctctaactgctttggagtcattaacagatggtaaagaaccctattgtgactgcgattcattgacattattatcatgattgtggttgctcgatgacactatcttaagaccaactacaaattagcaagaaataaatatatggtcagtgatgttaagcattcagtgaatgatgctaacaaaaaaaacacaactacacaatgttctgtaggttttaacaaaaaaaaagcaattctatttgagcaactgcacgtactgcacaatgttttgactattgacacaatagaaaccaaatagatagtacaactattttagcaaaaaaaaactcaactgcacgtactttaaaatattttagcaacgaacaagtcattctattcggccatacactatttattccattaaaattgtaagtgaataactgaaaatcaagacttagttagcaggatgcagactaaggtagcagatttaggtagcaagattcagactgaaggtttaggtagcaggatttggactgcaaatcaataaccacgcacaaactgcagatctgtggcgagactactaaacttatttgctacttaagttgctcacctaaatttatagaatcagtaaatctccgtgatccgtggttgttgctccttggcttgctggctggctggccctagggcgacgacgcagcaacgaggccgatgagcaggaccagccgagctggacgatggaggctggaggtgagaggacgacagggtggcaggccgctgtcgtgctgtaggaacgtggaacgccgaaggagcccacggaaacagccaccaggcgccagccaaacagaagctaagactagggtt

SEQ ID NO: 1152 - DNA, 1596 bp, Zea mays
  misc_feature (1)..(100): optimal_loci_264962_G1, chr7:166950792..166952387, Cluster 7
cgcgttttaattcatgcaatggtcatagatacattttacttttgtgtataatttagatttagattgaatggttactttacacaaattttcataaatttagagttggtaatttatatacgaatttggtgggttattttaaagtatctttcatagagagtatttgacaatttacatacaaattttaagcgtcattttaaattattttttattataccagtagtgggtaatttatatgcaaagttaagggggttatcctatttattttttataatggttggcgtagttatttttttataaaacataaaagatccaatacctgttactggcgatgataattagagtctactaaactaccatatttgttttgacaaaacaatctcacaattagtcttagaggctctaaaagattaaactttcaaggcattaagattctacacgaaaccactggaatacacatgattacatatatatagttggagaggaatatataggcatcaaacaaagactttagagggttcgtgcttattgtacagtcctcagtgcgagacacggagcatagaaacctagtccttgggttaagaaacactacgcgcatgcacgcattttgtccttctgtccggccgaataaaaaggcgtgtacccgttcttgtcttgtagaaattcgtggcctgaggcctgtgtgcttcctgtttgagatttctaaaaagtgggcctagtgtacattacttacaaagcaagtgcattgttctgtcacttggaaccgctgggttgttgcgcgcgcatagcattagttagaagagtcttctcctgcaccaaacgtcaagaacaaaacgggccggccggccggccggaaggggatctatccagcgctagcaggtactgcctaacaaatggcttgtcaactcagttgtcatgttacatgtgtactctctactgggtaccaaattgggtctggaatagtgcttttgccgctttgctatgaaaagacctgctgttgatgtagtagtactactagtgttacctattgatgccttcttgatcgacgacccatgatggggcagggccccaattgtactagttcatgcgtatacgacaaaggttcaaaccggttgataaatccgacaaacaggccaaacggtttgaccgtatcatggatttacccctttgaatttaggttattttataaattttgaacaaatttgataccaagtttcctatcaatactatggattgttttaagacttttcactaaaaccaaatttgaaaacacgctatagatttcgaaacaaaaattaaacaagtttcgaaaaaaataaaaacccatcggttttgccgattagatagccgcccctgctagccgattaatcgttcctaggtagagataaactggtggcctctagtagctaggttttaaggattttcttccttttaatttcaaatcttgataacatttgtgccatcttttgttcaaattttgtgacctcaatatactttattggccaaatgacaagtggttcggtttcttcacacgtactgccaatttatcaattcaatgaccgatagtggcaagcgatgatgagaccgataatggttata

SEQ ID NO: 1153 - DNA, 2343 bp, Zea mays
  misc_feature (1)..(100): optimal_loci_265074_G1, chr7:167601265..167603607, Cluster 7
tttcttttccttcttcttttctctgtacgtcctatcttttcccacgttgggccacgggtgttgtggcgcgagttcggtcccgttcgctgcctagctcaccggcattttctgccccgtatcacgggcagttaaccccgtgtgtgtgactgtgtgatcacagacgcaaaatgcagttggggttgtccggagcacgtaacctacgtgtgtgacacggtagcatactagtaacatgcatgcatgcatgctatcgtcggtcgtctgagccgcctctcatgcatgcacagtcatcctgttcctgtctgtaaattaagaactagagcgcgtgcggtgcgacgacaacaataccacaagtccagcgttattaagccactgtttaggtcagctaaatgcactaatgatctgcactcgaccggcgatcatcacacagatgcaagcacgctgcttacagtgctgggacaagatgaccacatgtcgccactggagcgaattgaaggaccgtgttcattacacggagtaattagcgcgccgggtgccgtattaggcgggttttgattttgtgtgtgccctgttgaggtggcggccggccatgcatggtcagttgcactagctacttgacgaggccaatgtgaaagctggaacgaacagcatgacttatctcagatgtgttaattattagtggtcacgagcgcagggcatggggcgttatattttgcggcatgtgtcactgtcgagagaggggggaaaacagtgctaccactataactagtatgtaaggtagtaaggacacgtataacggtattgaatacgctgtttctaagtagcaacgtaagtagcaattaaatagtaaaaacctatgtggacgttaattaagtaggagagagaggcatcggtcatcctttcgtgaggagatggggtttagcccgtgttccaatgccatgagacggtaatgcaacgactcattcggtccgtgttccacacatgaattaaattttttatagaatataacccatttgtatgacttattatttatattgtctgtacgtgtttttttgtcaatacatatataaataacgggtatctgtgtgggctgtatatgccctaccagtgtacacacctcttccagggagaagggagaaaaggaaacaaaatctcgcattgtagtctgaatccagaggccggccggcattggggccaccagctggctttgaatacgtgctccatgttctccgaaatcctcatcagagcattcaatccatcaaggccccccgatgcagaagccttcttgccagggcgaccgggtcacagaggctcagagcccctccaggctctctccagcaagaaacgagagagctgcgacctgcgagcctgcgaatttggcaatttgggtgcagtgcgcaggggtgcggggcgcccacgcacacggagcacgtatggatgccaatttcgtgcccctttcacagattttacagctcgggaatgtcacgaaaaggagctatgcatgcatgcgctagtgcatatgattgagcggtcgttggggtgcatgggctggcgacgacgagctaggctgcgtcccggtgtcgtcgtcgtcgccgtcgctgggactgggagtcgtcaagcccatcacacatgtcggactgctattattaatcctgtaatttttttaagaaaaataaaataaaatttagaagacacgctatatatatatatacacacacacagacatttattgcatggactttagtagcacttgtacagctcagtttttaagagcgaaatccatccagcaaaccgtgtgcaccagcagcgctagctagtacactgcatgcgcgcgctacttcgggctgtgttatcttcgtttatgattggatcatgcaatgatgcatggtaccagacaacacgtacgctaatctccaagaatcaacgccttaaacatgctcatgcatgcgctcttttgcacataatctgcgaaatggcgatatatcagctgggtttctgaccgtcggcaacaaattatggtacgcaaattattagttgtgctaagccgcaactaaacacgctgggaatttgattctacttctctgttttctatttattttttcacacggtaaacctggctctggaaactatttaagtttcggttgtggtaatgcatagtttaccttatcttagagcatctttgtttcatcttatatattatatagtctagattataatctatatgtagctgtttagatgatcagattatataaatgaagattattgatcattgaaacacaaaggcaaagataacagtatcctacgcgcgtgtgtgatttggggtagagaagaaaaatgtcagaaatt

SEQ ID NO: 1154 - DNA, 1494 bp, Zea mays
  misc_feature (1)..(100): optimal_loci_265989_G1, chr7:172441135..172442628, Cluster 7
cgccatggattggaaacatatctgttgcactggcaatctgtaagcagtttcatggatcggaaacgctggaggaaaccagtattagaacagtttcagagagagagagatagagagagagagagagagagagaacagtttcagagagagagagagagagagagagtaatccgtgagcaccctgatctgatcttgagacgctatctcctgtccttgccagttgcgatgcgcagggcaggtagcacccaccacaccagacctaaaaagctcgagccgacgctgaccgtgaccggaccggccgtcatgcgccgcacgcgtgtgcgggcgctggccagccgccgccaccgccacgccccgaagcggaaagccggtgaccaaccaccattcggtcgcgggcagcaagttgcggcggcaggcggcacgggccacgtgacggccccgacgcgcgcgtccacggctccacgtgacggccatcgtgcgacagcgccgtccagggcccatgtctgtgctgtgccccaagccccgcagcctttgcgccctggatattctgccgtgggccctcggcccgtctggatgattattgttgcggcgacggtttggatctgaaaaattgatcgacgcacctgccttttcttttcctttttttttgcctctctttggcaggataaatataaatagtgttttctctcttggtcctaaaataaagtatgcatctgattaattatttttaaattttaactattaatatagaaaacaaatcaaaatgcaatgcaaccgtggacttagcgaacctccttgaatttttcgatgctttgtgtgcactttttattccttttatcttctaatcactctgtctaaaaatttacaattctacctataggaaaaatggcatacatatttatcttaagccaacatatgcaagacttactcaagtatgtacaaaagggcatacgtatttatgacttaaaatatacttatttgatataaaaaatatggacgatttttaatatggatttgatcgaatttaatttagttcgactccaataatacgataattacattgttttgaggcagaggtgatatctattagcaaaacataatctagtcatttaaaagtatttctcatgtcgttttattatacgtgacaaacatcagtaccttttttgtgtgcaaagggagccaaatgatgaccttatgcattgatgagatcacacaagtctaaaaagggataaattagtctcattaaaacaatcttgatgcaacagttagaaatataagtggcactgtcgtactcgcgtgcaaaattgtcgtgccatgtaaacctacaccactaccacacaatatagtagctcgtgtatacagttttaaaaccatccaaagaaaatcgactaatttaccaaggtttcttaggggtaatgttgagcctatttcaccatttgaacatagtcaaaagcttaagcacaatatctagagcaaaccaagaacaacacaagcaca

SEQ ID NO: 1155 - DNA, 1623 bp, Zea mays
  misc_feature (1)..(100): optimal_loci_268075_G1, chr8:7026746..7028368, Cluster 7
acacagacatccactctgacgtttgcatcaggcaccaagtacgtgcgtgatcctctccagcctagccacgccacgggcgtacacaagtgcgcaagtagtagcttgcgaattgctgctactagtggtgactctgccgatcgatggtcaccccctcgatcgggcaggtaggatcgctgttgctggtcctgccactatactcactactagcgcactacagttgatggtaataattaacaggagataagcacgtactactagtgcatggatggcgactgcacgctcgtagtagttgagtctcggtgcagtgcttctccttctccctgtggcggctaggctgctgtggacgacggttccgaggtggacgccgccgccgccgccgcgccgccagctgccgaatgcacctgcggtgaagtaaaattaaaaccacggtccttgcacgtttcaccatcttccagttccacgggcgtttttttcccccacttggcgcgtgatgagcgtttcagagagccagagtcgacctgtcttgtccacttggtcggtttttaccctttttttcctcctttttcttacagcagaatcaggagtcaggaccgaccgacccatgaggccatgaccatttgaagtgagcttctttttttccccaaaaaaataagtagtcaattgtgcgactgtggaattttgttgcagctagctgctccaaagaaaaactggaggaggaggatcgaatccaattgacctcacatcatcatcgtcctgcagcagacgcaagcaagcaggaaccatgcatgtgtgcagtgcagccagcgccgctagagcagactcggaccggactttcgccggcttccctttttacagtgcacatccggctgatgacagccgtgcgtgcgtacgtgcgtgagctctgatcgaatcgaataaagtttattttccagactactagctgctagctcattcacagatctctttcaacgcacgtgtggtcttttctttgaaatggaatcgtcatcactcctatatatgcaataataatgggatcattatcacacatgcttaaagaaaccgagagagatagagtagtatgctgatgcctcgatcgctttagcccccccgggggtagattctgaattgttcacgtgttgacacccgtacgtgcgatactagctagctgttgatgacttgatgcctcgctttagcctgaatgcgatgtggcggtgagaagcctccatacatctgtaagtcctagcatacatatcgccaaaccgtagtacaccaggcaggcacgttacactcgctagctggtccttttgactgtgccatgcatcatgcatgcatgcgggcattcggtgttgcttgcttgccacggcgtccaactcatgcattctataccgtccacggtttaaatttttttccatttagggcgggacagctctcgaatcacttccacgtacgcagggccggccctggggtgggcggccgccctgagcccccgaagttatggggcccctaaatatgtattaagtataagtatatgttgtgtgctataaatatttagtaattggttttaatcaaacactatttgatagtctgttcgctagatgtagcttgttgaaaacataagaaacg

SEQ ID NO: 1156 - DNA, 1696 bp, Zea mays
  misc_feature (1)..(100): optimal_loci_269226_G1, chr8:12602981..12604676, Cluster 7
caatactgattccatgcatatgcatgcatgtgagttattatcaatcgtgtctacaagtgtagctgttgattttcctataacgctgtgccatacacatataataacctatcctatagatagatttttaggggtatagatagatgtcaaaatcagatgaaaggcggcttcgtcgcagtgacacggcgctgtcagcaggttacctgatccaaagcacccacgcaagcctgtaatggttctttgacccttgatttgttgagaaaggcacgtagtatttgatcaacttagctaaccattaaattagcacatacaaatccccatgatctaagcactactagttcaaaatcacacagggggtaaaaaaaaatgcaccggagtaaagtcatcgtacgtagatgacagctatatatataattaaccacgtctcctctctaaaagcaaataacaaacggtaacagatcactgaagatatcatatgatatttatactacaggaggaatagatggcctatataattaaccaagcttagggggacaggggtgggccttgtttggaagctggggaagaaagagtgacttgagaaagagcgaggagaggagggaattctgggtgaaagacgtacgtaaagacgctttcgtcgtgggtggtgtggcgatgacatttatattgcgtttggaaaagctgcgagaaattccagctttcgctggggttagtaggatttggggcagatttctttccaaccgggtcgaagcagaaagtctaaactaaccggaaagcttttgctgatctgaactcgtatacattccagagcttgtttagccaccatctgagaacgcacaagagagggtgatctttgcgcactagctatagttacagctgagatctgtaaaggcaggcagaggcagggcacgcgcaccactgatcttgctggacaatatcaaagctagctgcagctgcacgaactgaagtacttggtggttgcattcattcaccttttaataactacaagtcaaacatgatatttcttctgagatgatatacttcagctagctagtgccagtggttcactcaaaccaaagcagtgtgacggcaagtacaacgacaagaagaccatcgcactgcgttgccctgcccaggttctaaatcaacacgcatgctgctgctatgctactacttcttcttttttttttctgggaagtcacgactgatatacagactcgagttgcacagcaacaatatcaggcgatggctctgtcgtcgtctgttctagcttctttaatttgacctatgtatatatataacgatctcatttaggtgtgctgctcggtgctcactaactagcactagctgatgttctactcaagtacagaagaaagtcataaaacatgattgaggaaattggctctccaactatttttgtcagtccgcacagtttccgctccttccgtactatggaccgatttcttaacctgtagctttctgtgagcagctgttatgtttagatctttcaacattgatcccagtcccacctattgctgttgattaattcccacttctggtagcagcaaactcttttcacatgagtagactgttgggaacggtaacacgcttaataaagggcgagacaatctaatttatctttctctaaaatttagatctcaatttttttctagtcaaaatctatgcaataaataaatat

SEQ ID NO: 1157 - DNA, 1666 bp, Zea mays
  misc_feature (1)..(100): optimal_loci_285772_G1, chr8:119255045..119256710, Cluster 7
tacgggtgtacccagccactttggacaagtagttgaaaaaaaaaacttaatatcatcaaaacagcagcctgaataataagagcgtgtctcctatccttgagggccatgagagaaaaataacaaaatgacaaccttaaggtaggcaatctgcagcatgcaatgcatcaaataagttcttaatcaatattgttaacagtatatattaaatatctccggattgacgttgttgctaaattcaccactaatataacccccgatatttctcgcattcacgccattctgtaatcggtttgaccaatcatcattcctcctcgaaaccgaccaatagggggcgagtcgtcgtggcacgaggtggaggctgtggggcggccgagatgtactccgcgctcgtcagcatccggcgtggtcggctggagattacaataaaaacgattcattagtggcagctgcgaggtgatgaggccagcacagatctttatctccaaccataagcaagaacgccaagcttatggcttttacaattgctgtacgagatgtcgttattatagttcaagattactctacatggacaatctagtggttacggagtgattgtcgttggactttcagtaaccaaccagccgtgcacactcggtgttgatatttctctagtggcataagtgatggaggagatgatatcatgtccattaacaaattttcttttatacaaatacattgaagtccctcaatttcttttttttttacttttctccgcgatagtcagaacagacatggaaactcatgcatatgcatgtacatgtatgtatgctcagtcttagaaacacacatagacgtgttttaccctactttttcgaaagactaaaggccagttcatttctggcggtttggtctgtttcagacctcgttcagggtggaacgaactgctccggtttcgaatttggtgtggcacattttatgtgttcgttttgatctgaattggtacgaaaactggcctggtttgatttttttccttcgctccacaggccggcaccgatccctacctcatcccctccaaatcgcatccggccacgacgcgaagaatcggcggcgtggcgatgcgaagtgtcggagtggcggcgtgcagccccgatgacgacgctcctcgtcgccttctcaccggtaaggagctgctatctcttccttcccttctcccatttgtgttcttgatgttgccgagctccacacccctgagctcgtagcccaatcttctctgtcgaatcccctccttgctagggattagaagtcaaaagatgtttggttggtatagataaaacatagttttaaatatcatggtttactcaaaactatgatatttttggagttttgtaaactccacttaggacctcagttttctatttttctctctacaaacactttgatttttttcccaatgtaaccaacatatctcaattctaaataaaactgtgattttactatggtaaaataataccgtattatttttatcatcggcacagccagcttgcgattctactgtagacggcttgtgagctttctgtatggatctctatctctttccctagttcaacagtgcagagcgcccagccgtgcatggaccactgggtgacagacacctcagcaacctacgaacagccaagcccatgcatgc

SEQ ID NO: 1158 - DNA, 1805 bp, Zea mays
  misc_feature (1)..(100): optimal_loci_289919_G1, chr8:142376792..142378596, Cluster 7
caggccatctaatcaactcagctatagaggccacggtttagccaagcactccattccaccaacactacttgtgcgcacaagttgtgggagagcaggtatccaaaacaagagtgggtggttcgttagttatttttttcatacgatattaactgtttactgcactgagtatttaatacggactttttaaaaattttcaataagttggaaatacgttggagcaaatccacttgaatttaacaaagacaactattttattggtaaggagtatataagtatatatagagagagaacatcataacaagttctattctacgtacgcccatttataaacatagacaatgtaattaatatgtgagtgataaataaataagcttcgtctagcttaacttttgcttgcaatttgagttcaatcgctcacctgctagttaagtcatcttatgatcgctttcgttttagaagaaaaaaaagcctgcgtgaccagctggactgttttctcaccgtgtctatatattcatatctcagcgaaggttgcggtccagttcgagtactagattagaagtcacatacgttctctcgcccagtttctcgctctcccccgttgctaattaacttgttttttaatgcccttgctggacgatatgcatggatcgatcaagctctctcctgtgtcgtcgcttgcaccaaagtcctagtgtcccgcgcgtcaccacatcactctcgccgtccgcacatgtaatagaacaccttatatatctcagcaaatcacccgttgaaattttatgggaggatggagtaatagtagtatagcagacaattgcacttaattacataaagatcatctctcttgcttggcgatgaacaacgccgcgcagccagtttttttttcttcaaagtctacactgttaaatatagtttcagcgcatttgattattattgcctgcattggcttttcggttctactacctaccagtccttttaattaacgccctttcataattatattggtcctccatctttctcaatcagctctcatgttgtttaattctatccgggctagagctagcgctagctaggattgttccatgggagtaggtgttgacagtttcagggcctcgatagatctcattttcgagtctacttcttcttccctacgtacagctaggtaggtaaaaaagaattatgaatctgagtcaaatgtttgattttcttggatgatgaccggggaagtgattactccttaccttcgatggagcttctccccattcacattttcagtctgtatctttgtttgtttgattattcaaatcggttatttgattgattcattccggttactcgatttcaaccgctgtatatcctgcccctcatgcatgtttgactctgattttattatcatactacgtagttcataacagcatggccggtgttgtgctacgactgggaaaataaggccctccctccatctggttcgtttgaggaactcaccgtttccatcttacgtgcgtgcttgacagaaatgccttgactacattctaggtgatctaataaagcaccttatgtttgcaagttaaatagatccggttgtgtgattaataaaaggacaacaatataatagtagtaacaattcaaatatggaattttgtaaggctgattccaaccatgcattccccctcgcatctccctctatttgtacttttatgatttatttttaaataccccagctctttcatttaccccctatttatacactccctattcatttttaaatatctccctctctttcatttctcctactctttctcctc

SEQ ID NO: 1159 - DNA, 1938 bp, Zea mays
  misc_feature (1)..(100): optimal_loci_291724_G1, chr8:151219312..151221249, Cluster 7
aatttttgtttctctatgtaattctattttagttcctaaattattgaatacagaatctaaatagttttcatatttaacgaactaaaataaaataaaatagaaaaactaaaaaagtcgctagaaacaaacactcccttattatttgtctattgagggatgcctacgaaagaatcttttgacctgaactataaaatcagtagacggttacagttttgtgtactactctgcagtctgcgttaacatcagtgcgggcccacggccagatcagaagcgacggggacttgtgttgtccatagtctccgacgggcacctccacggctccaccaaacaccccccttagtcatcagccgcccgttgtgcgtggggcccgagatccgacggtcgcggacgccgtcgatgcggagagccacagccgctttggagatcaccattcaccacgccccttgtttgtcgccgttatcttgttgtatacttgtactacgtattaatttatttgccactatatctgcatttaattcaacgcccgtgcaaaagcaaaactccgaaccctcttgttttatctgacgcgacgctagtggcctactactacgtccctgtcacgagtgcaggagcgagagagagagagagagaagggggaaggaggagcaggcggaagcggcgcatgcaccggaggcagaaagcgggcggggggctccatggggcccacgtgtcggggaaggtaggcgctttttggggagagcttcttctgcacgtgttcttcctcgcgtcctcgccgtggcgagccgtgatgagcacggtactagattccagatacctactacctctacctgaccaaaaatactaggcgcacatgggagctccaattctccaaagccccaaaaccgggcggttctccggctgctagcctccagttgtgcctttgcatcatgataattacacttagcacaacatagtacgtaatgaaaccctgtcctagctgaataattcccccaggactaaacgtttagaataaaaggagtaggatagtcaaagttgtctatctttttttattaagtttgcatgttacttttaagaagctaataccaattctcaattctcatatcgtaaaacaaacatacataggtgtgggggggttgaccctgatggctgatgtatcaagtttgctaaagcatggtacaatcaacatacgatttgctctgttcgtataaaaactgttgtaactaacgctcacatgactaccagtgctcttgtttattcaagtagcaacacatcattgctttttattcttttttttcaaaaaaaaagtagaggaaaacatcatctctgcacatcaatccctgctggttcaacttgctatggtccgccaatccttatttacatagtttaaatttaaaactcggaagagaagtcaaccaaactatctcaaggaatattattttcaaatcgaggaaacatattctacctaggctacttgctcttgttgtatgatgattatacctactagaccacttgcggcaggcactataataagtaggacatcaatgcgacaacatttaacttttcatctctaataactgttttagtggaatccatatttgtatgttggacctaggctagtgtcagtggggtttcgtgagttttatttgcgttcaatacgctgtcacataaacatgttcgtgatgtgacaacatttttaagaagagagaagaaacgagttttatgaggataaaactctcctatcataattactaattatttataagtagtaacattaaatataataaaaccgtggaacgtaacttttttattgagaatatatgttgtgtccatatttttatttaactatatatgattcctctatcttagaaacaacgctacaaaactcatcagacattgcctccctaaaaattaactagcttaattcatccctagaaacta

SEQ ID NO: 1160 - DNA, 2139 bp, Zea mays
  misc_feature (1)..(100): optimal_loci_29179_G1, chr1:178419168..178421306, Cluster 7
ttggccggtggccaacttaaatacaacatctttttttagtgggcatgtacaaccccgtttaataccccgtctcttgaggggtctctagggtgttaaatgcaaaaaaatacaagggacgaattcttctctgcacgactctctatacgtaacatttatgatgtgactgattttaaagaaagctcattgtatgatgcggtttattactaggtgtctcttatgcatagaaaaccaatcaagaggcttttatgtgtcgcgtggtgttattatttcacagcttgtttatttacgcatgcatgcatcatcgcactctatatatgctccactttcctttactcaacatgtatgtacaacagacatgcatggataaacatatataatgccagcgagttcatctgatcccgttctgcataaaaagtctgagttgtagctcactcctataccaggatggtgataacatgtttatcaatgcctagtttgtattaggactgggatgtatcaagaaatcatcaacatcaagattctctcagctgttgttggacttggcacgtctacggccaagaagctgcattctggtgcctaggaaacccaccgcatggattctgaggagacaatctgctggaagagagatgcattctagttttgttacatcacagttgctctctaatcatcatagtagcctgggtttgtaccatgtgctagctcctagttaaactgctctgtcagcttgtttctcatgacaaacacaaagcttcctcctcctccattttggaacattttgtattgattgccaatgacatgtctagagattttagaattttgttcaaattaatcacgcgctgatgagtttccaccttcttcagaataaaaatacattctggcgggctctacttttcatatctgctaaatgttctcatgttgcgttattttgaagatggaggatgtttccctcctgaggcgacccaattgtcgagcaaaaggtgtggctccaggcttcaaagtcatgatcttgggtgcagccacttgcactattgatgaagatggaccccttgtttcagtgctccatctatatgatgtcgtcaacgcacctggtgtcatagctaagtggctgacatcagccacatgaacactggtgctgtggtatgctcaactttatctgagatcactttacgatatctttgaatgttgattccgaagaattggatggtagattactgttgtagctagttgatggtacatgcacctctattgcagttggatatcttaggtcgtattagactattagctatttcctagtgtacttaatactcatcctgaaatactataaatttttccactaaaacgcttgggaaacaaattgaagtttccctgtggaatatagtcacaatcgttttacctggatttcttcaaaccattgaagaattatatttttagtgtcttacagctcactgctaattgtggacaaagctccaaacagaaatatctttgacctacttggtggttactttcagttttctgatataagagtttagtttttgttggtttccggttatgtactccactactccctggatacccttgaccagcctgtgttgtgttatagaaacacataataattcatcttgttcaccattatgtctatttttgtatcttttggtttagttatgctaatctctaaattctgtaggtatgtggcttcttgggccagccacagttggaaaatgctctgactagaatggatcttgtaataattcatgttgggtgtccctcagaaacctgggatgacaattgactagggatgatttgttcaacataaatgctagaaacctagaatagtctgtatcctgtgtgaaggaattgcaaaatgcttccctaatgcaattgtgaaaatggtttcatggtcaatctttgttttaaattgctcctgctctaacaaatcatgtttccaagagaaataggaggagcagatcagtccaaggagccttaatagccaatggatgggtaaatggtctctctgggagccttccggcgcaggtgttgtttgagtttctgttggtctgggatttactccaaaaggtgcaactgtagctgtagcctaatgttgaggaccagcaccggtggctgccgtcttccttggggctg

SEQ ID NO: 1161 - DNA, 1970 bp, Zea mays
  misc_feature (1)..(100): optimal_loci_29180_G1, chr1:178422012..178423981, Cluster 7
tcctgtcaactctaccatttcctccaattgctcctgaatttttcaagaaagctggaacttatgaccctaagcatcttttggatgtgaccacacttgatgtagtgagaacaattacttttgtgtatgtatatcaataaggtttgccgtgatatgttaccctattgtattccttcatgggctaaaaatattttctttttacagggagaggttcttggacatgacccaagggaggtaaatgttccagttattggtgggcatgcaggattacgatactaccactcctttcacaggtcaggagtattttcaaacttcaactgctaccaaatacctcacttcgcacatacagaatggtgggacaaaagtagtcgaggtatactgtttgttacagtctacgaatactcctatgctgcatctcttatgcacaatgaaggaaaaaaagtcagttccacatatcctctgacctcttttcagtttctctgctatgtatattgattcaattctgtgtccaattaactgtatgcacgctggtttcatatgtttggctgaattgagcacagaaagagtccaatgtgcttaattttgagaataagaagtagatcactagtgccagtttatgcacaatcactgcgctatatgagacacactaggcacatttttgcataatggttacatcttgatcctgacaacaagagtctactactatgtgcctgtttatgtgtaacataaccttatcgttttcataccaatgtgaaatactaggttcttggtatttgttatttacatatgttaaggtattgctcttgttattttttttcccgaattctggattgctgtgctaaataaaaaaaacatgtttttttttttgctcattattggtatgtttcaggctaaagctggagcaagatcagcaactctttcaatggttgggtatcttgtatgcacatcaatgcccataacgtgtaagttccaaatgttgattcagtgaacaccaatactacacctttgcaggcatatgcatatgcttgcctgtgaggattgcgtggtgatgctgggatagcagagtgctcttatgtagcttctcaggtttattttctttcctgtatacagttcaaaaccatatttcaggttatgctttgattgaccttttagttgacccgaattattgatttgtgagttgtgtttctctcgtcttgtggttgaaggccacagagttgcatttctttgcatccaaagtgcggttaggttagggcgatgtgttaaacgagtttgagaggtcaggttcttgttatgaattgaagttgccttgcatggtctgcagcatgattcatcagccattcacacatgctttccgcttaagtatatcccagtaagattagtttgtttgttcttgcctttcatctagaactacaggttcatcttgcttggccactcatgtcttccctatgacttcttttctcatgcgcatggacatattggtcacaagtgtttcatagaccagaatacagttcccaggagaaagcatggatgcgtcatgtatgcagccatgcgtgctcaaccctgaacgaacatagatgtggcgtgttctggcttcctgagagctctcatcttgttatccctctgtaaaactgtgtacacggctgtgctaaaaaactataaatatgtggcctccaaaggaggaaatagaagaagaaaaaaaaattgcttctgaagtctgaatgtttggtccccaatgtacgggatcagatggtattagataatacgtttgcagtgtatggaactgtgtgcgaatcacaactgagactgtccttcgcgctacgttgtttagtcacgtaaatccatggcgggatttgtgcatgatgggttaacttgtacagccttcagctatatgtacttctctattgctgggtacctggtaccgagagagaggagaaattttggctgtggtggtggtggggatatgaatatgatac

SEQ ID NO: 1162 - DNA, 1578 bp, Zea mays
  misc_feature (1)..(100): optimal_loci_292667_G1, chr8:156265822..156267399, Cluster 7
ctcgtcccttattttttgaggaatagcctcatccaccatttttgaacaatattgtttgaccctgactctggaccttcaaaccaaacgcaggtcaaattaaaatgatctcatcctatccctcttcatcctttctcgtcgacacgtatacggcgccgctgcagcagctagccgttgtagtccatgtgcgggcagtgcagatccgcttaattcccggacgagacgtacgacagcaccggcggccggctaggagcctaggacccgacgacgcaacacaaaaggagtggacgacatgcagccgagatggagacgcgagatggaggggcgcgccaccgatcgaattgcaaaagggagtgggaagctagctagactagagcacatgccgagcaaattgcaaaagtgtccctgccgggcggatcccaaggacccggcacatgcgcgcgtgcgtgctggcagcctgcaggcacggctgtggtctatcggcggccggccatagccatacccttctcctcctcttctccgatcccatgccatctatctagggaagggatccctcttttgcccttttggcacgacgagagagtgaccaccgcccgccgcccgcgcgcactctagtgtaaggtagctagtagcgcctcgccactcgatcgcatgcacgcactgggtgggcggcactgcatatgcaacctcccaggtccttggaacgaaacccgacccatgctctacctcctgcatgcatgctttccgagcatggctctggcctctggcagggccggcctcgctcgcgctctctcgctggactggccgccggccgccggggctggtgccatactgccatgcatatggtacgacgtgcgtgagaggtagacgaagaacggtgtgcactgtgcagtgctggcccggcaccggcacgtacataaagctgctgggtgcgcgcgcgcgcgcgctatctatcatatctatatcttccagagtatctcctgaatgacaaggcctccctcctgatcctgcatgcatgctgatgatgatgatgatcactgacgacgacgaccgaccgaccttccgcggaacactagcgcgctagcctaggcgcgcgccacttgtgccgtacctcctgtcgtcagggcatatgcaccggagattctctcgtagccatagccatgtcacgcgagcgaggcgcagagcagtgagctgacagctgagtgcgcgctgcagcctggcctgctgcaggccggttactatatacgttggttggttggtctaccatatcatgcgtgagggctttttgtcgccggccggcctgccaggtctgccacgcgcgagagctagctaaccgatcgcgcatgcagatgcagccttgaaaagtcaatcaatgctgaccaatcaaagcctgtacgtacgtctgtgtttaatcgcagcttttatttcgcttctcgaccacctctcttagctgcttgatgatcctttggtctagctacatggagtggcgcgcggccgctagctagtgcgcgctcggacggtgaccagtctgctcgacctgtgctctctcagtgtgcaaatgcatgcttgcctgctcctgtg

SEQ ID NO: 1163 - DNA, 1626 bp, Zea mays
  misc_feature (1)..(100): optimal_loci_292888_G1, chr8:157729270..157730895, Cluster 7
cattatttggatataacattgtaaaccattgtattaagcaaaatctaatcatgttataaaaactttaaattggagtagagttttgaatacaccaaagatatcatggtatctagaatatcatagttttgaaaacatagatttaaaaaatgccatcaaacgtctcatgacataaaatactatatggtattagtattacatagaaactgtaagaatactcccaaatggacccgaagtgtactgattccagcttagaatgtttattttcaacacccatctcattctctatctcataaaacaatatttacacaatcataaatacgatttgctggacatagccttatgcaaatgcaaaatgccacgttcgtctggctttagagacaattaacacccccaataattgtacagtgctacttacaaccccacatccatctatgcttagaagctaactggcgaatattttttttgttcaagttagcttacataatcaacttcgtgttagataaaatagtaaaatgaaaaagaaaggagaataaataaatctactcagattcatgcaggcttttcgtcaacaaacagaggcaatatacgtgaatcttcatattacgaagcaccaggggccagggcacacgccaagcttagactttgtgcgaggtcacatgaccgacgaaacctcaacagagggagttgcgttgcgtccacgtgcaaccaagcgcagatgtcaaagaatctttggtacaagtatgaatatgtccgtaaagactgatcatcaatgagactcgatggctgataaagacgtactattatgaaccaaattatctttgcacggacaagaaatcgtaagtagacgtccacatttttgtgtttggatcaatttactcctcctccattgcaaattatatcgaaccagtgccaattgcagttgcagcgcaccagtgcatgccaattgcagttgcagcgcaggcgagtgcactcgaagccagagggtccaaaggagaagcacagctcgagcgcttcatgcttgagtggatggacgtgtgtgtgtgtgacaaaaacgctttgtgacatgtacagcaacccccctgcatgtctggggcatacatcttacatgagatctatgcatatatccatgccgaccaatgcaggttttccgtagtatatattcacatatgaaagcctgaactccgcagctgttctgttgcagcgccatcaccgatggggggcatatggcagtggcagcaccgagtaatagcttcccctcgttaatcgaaacgggcaaaagtcgtcacatgcacgaaagcgggcgcgacgacctcgatagcaagatgcagtagtgcagatgccacaaccttcttcctccagggacagcgcagcgctacgcttgcccacacccacacacatctcgagtacctttccccggatcagcgacacttggacagaccttcttttggtcaggcgacgccgaccgccacggaaaaagggcggcgggctggcaggcttcccgacgcccatcgcccaagaggcaagagcggcgtttggaacctggcagtggcagcgacagcacgccgaccggaaaggatgggcttcgccgctcggcgcggcaatttcccggtttattttcaccgggaa

SEQ ID NO: 1164 - DNA, 2436 bp, Zea mays
  misc_feature (1)..(100): optimal_loci_294390_G1, chr8:164958335..164960770, Cluster 7
catgggccttttttacttcatcacctactgcaagagcttcttttcagatcattcgccagggggttattagctaaggaatgatgccaggtttggcgagccatttaacaaggttatgagatcttttgggcggatgtgatcaaccaacaattatcagattaattctattatgtgtacgcaaacaaaacaaacgaacaaaataaatgtcgacgcatctaattgcaacaaaagctgagctcggcgactgctggttccaggttcctatcgatccaatccgtggcggcatcacatgcattattatcgtctgttcactcttgtcttgatttcaggaaacagcgtacacatcaacagcttttcaatgaacagtctggactactactgcaggatctaactaaccactagctaattgagatcttagcttagattggctcgtggtacagttagatctaaccaaaaactggtgagtgagtgggtgaattagtggtggattagcgtgtgggccggggtctctccaatcgttatgcgtactcggcgggtcaccggggcacctgtgatcgcaatctggaatccctggagctggaggtgccactgccggctggctagcaggatcggaggtgcccatgctgacatgcatgctgtgctgatgctgctagctctctatcacaatgtatccttgtattctcttgtactagtaacaagcaagctccaataatcctgcttaattggaatgaataaaaaaagcatattttgtctcgaaatgcacgaattttatattactatttaccggaacaatatagtttattgcatcgtcagctgcttgtcctcttccttcgtcccttgtccactatttgattgaggctggggacaagctaagggctagcttggggaacgagacgagcagggtatatttctggagatccggcctggacgctagggtacaataatgcaaagattgtttaccaccagcatctgcttgcacacgggtacgcactccatgcatgaattgttggcatttttaaaatttttttttgatccacatgaactgacgacgaaggacagtccaggacgcagctagcagggctagctagctgagatggatagatgaattgattggttccagtttgtcagcatcatcacatcggctggtaacgtatatatgtatgggcaggcagatccaggacagtacagagaataagagtttagtagatgcatggatgggtttagcatgcaacaatgcatgctgatgtgccatgcatgtttcatgtttgtgtcctccccaggccccagccatgagggtacagtacttgctaagctctctgatgcgtgattataatattgttgctgagggcaaacaatcaggcatggagcggcattgacatgcttgttggatcgacgtacgtgcaatgcaacacaacatgcttgttggatgcatggtcgctgaccttgaagacaaagcgatccatcatgtacatggcttggtggtggtggtccgggccatgcatctgactctgtctctcatcgctgcgacgtacatggcttgttgtgcaccgtggagggatcgaaaaggacgaactttcacgagctgtccgtgtgattgatgtgccctgtcctacaggctacaactgctatatgggacgacgcaaaccctgtcgtcctgcacgtacctacgtgccggccgggccgggaaattaaagcacccgtatcggactgtaggttgtactgtttgttagataaccgtgcactttgaaagtttaaattagttcataaagcaattgtacaatttgttagatgtaattgtgtacttttaacattaaattaattcctaaaaacaatcataatatgaaccataatcatgtatagcaaataaaaatatacatatataacagattaaatctatcttgaacgtatctaataactcaaacacaagcgaagaactcagcattactcgtagcatggatctcttcggcctggtcaaagattagttcgtggtgtcgttagatgtcgaagcacgggtcaacttggctagccgtcgcgtgatcacggtccaaaaacatgattcgtctcaacacatgcaggttcttcaatgaagtaaggtattaaagacactgctctctccatcatcgtcacaccaacgccaagaatggaggagcttcacgcagcatcaggggctctctcgtctaaaaccctaacccctagtagattgattgttctcataacttttgagggaaataccctctattatataaagggattgtgctcaaggtaaccacacataaagaggtatgaaattgactatgttactatctccatgatctaatggattcagtttggaacttgtcgcgcaaagcataatcagattattatagaaaatggaaaacatagaagtggaattagagtcggttgccacgttccaagtcccaagtcacgtgaaaaaacaca

SEQ ID NO: 1165 - DNA, 2791 bp, Zea mays
  misc_feature (1)..(100): optimal_loci_295573_G1, chr8:170216005..170218795, Cluster 7
ttttgcactaatcacaattcacaagttcacaactgaaaaacagaagaagaaaaaggaaatatacttgagcgttgggttcgtgacccaatagcaatattctacggcggcccaacaacaacattttttttaaaaaaaaagtagcgggtgtttgtctggttagcggacgactcgaatccgaccagtcgaacacatatgggccacccaaagcaccctaaagaagggagggaatatgggcgaaggctgaagattcgccaaaatatttgggcctttagctgccttcttttgtcttactcgcaggcctttctagcccacaagcttctgccacatccaaatccgaaacccaaaatccggcgactcgtcttttgtttctcaacttgtcaacgccacaggccagcctccgcagctgatcggtgcatgcatgagtgcggtgttgtatctgcgcacctgttcatctcatcggttaccagacgcccccggctgcttgtgcttgcattgatcggtcgtggatggagatggaagaccctgccggccgcagctgcgtccagaactccagatgcgagggcacggaccgggtgtgctgccgaaaggccgaaatgcacacaccgtcagtttcaatcaaagaagaagaagaacttgtgctttggctttgattggttgtttggctgcatattggtgaagcagacccagcaggtgttctataggtgtgccttcttgggtgtcccagcattactactcccttgttctcactgaagatttggatgtcttcgtggcgcagattcatcatggtgagtagtaggtcggtcagagtgtcggtggtagtcaatttcaggtcttgggacgatgtggtgggttccttgatccttggccaagttgtgcagtgccatgtgggggtgatgatggaggtgtatggacctagctagaacgtatgaagtaattgacatgaattctatcttctcaaaacgtactcctgctattatatccttttgctctgtagaaacctcttatgtgaacacacatagaatcatctctcttcttctgcttcgagttgcatctgagtcttttggtcccctctacgcatgcagtttggagacaaaatgaggagtgcctcctaacgtggtgcatgcgaggttggtggcacgtcgccggccggaggggaatgctccaaatttgtctccggcccctcgacctcagccagccagtcgctccgggcccatccctagttttcttttcgcaatcggctattttagaccgtgtccgtgcttggagtgcgctagctagaaaagcaaccggaccgtcgttggcctttcgcaatcggctattttggaccgggccgggatgggccgtggcccccctctctcttattatttggagcgccatttataggcctaccaaggacaggaaccccaccaccacggcaccaccctgccctcccgctcatcgcatccatttggagggccttctaggcttctagagatggctgatgtgatgcagcaggttgctgatgtgatcgaccgagctttgttcatgctcgatctgctaagtagtgctatcgtttcttgtacgtgtgctagccaaaaacggggaaagagtaggaaatgcaggccactttgcaactactccgatccgggcggccggagaaattgtcttgatggggtcagccatttttctagggtacaggggccagtacaggtacatgcacgcatgatgcatgcacgccaagccgtcccctccgattgctctacctaaaaggtgtgtccactccatgcatccatgataccctggagattgatacggggggtggctaccacaagtccacaaccacaatgcaatgcaagcgtcgtgcaagcaagctttcatgtacccgacgtccgacgagccccgattattctcccgtccatacatctgtcccctctcaaccattggaagttgtttatcttggtaggtactaggtactagctaggggtacgtatcagctgatcctggaactttccttcatgcggtgatgcctgaattcgtacagcaaaaacgatgggcaaacatctactgtgactgtatttttttttcagcagcagagatattcgttagtgtctacaacttgatgacagtatgctagaaaccaacctttatccggtagctagtgtctacttgatgacagtatgcaagtactgatcggggggacaaaggtacagatatataggtattgatggcatcagaaagatgaggaaatgcatgcaagctcacaccatcatgattagtaggtgccctgattattgtctccactaacaaaatattaatgtggtggattaggtgcaacatcaggatccccccctggtactatatatacatttataccacaaaacagggcaatcattcgtatgacggataacacgtatgtactacaacaacttgacaattaacatatggcaatttgtaggataaacaaagagtgttttcaatatctgccccgcgtaaaacgcaggaaccaccgcaaaacaaagaaaggagaaatacatgtggaacaaatagagggacatcttacaaattaaggcctcgttccaaacatctaaatctagtaatagttaggagctaatgttagttgagaggtttagaacggatcaggtaatagactagctaatggtaacttatacctttcgaataactattagttgttagctgctccaacccgactaaaatcagctgataacatattagatgactaagaattatctctagatgtttggaacatggcataagtcaatagacgtatgcaaaatattaatatatataacaa

SEQ ID NO: 1166 - DNA, 1624 bp, Zea mays
  misc_feature (1)..(100): optimal_loci_295587_G1, chr8:170243956..170245579, Cluster 7
ggtctaaaatagcaaatttcccgcctcaggagcaggtgtcaggtccgcatcacgagcctagccgagcctagcctagccggtacgctactaaacgagacggacatcatgcatgggtgcaccttccgtctacgtacgttcctaatcgctcggtgacgaataaataatcgaccaggagtccaggaggagcttatactaatggcgtatcgcagctatactcaccgcaacgcccgacaggccgattaaaaataatcccgcggggaggcctgccccccaccccacggccacggccggcgacggcggggtgcatgatctcggtgattgatcttcctaggcgacgcatgttttatatctcaactataataacaacacaggtacatatttagagaacgagggttgaaggatcgccgaggcttccaagttccaaccttggtgttatggtctacggatcgaatctattattacctcagcgtcacgagtcacgtcatcaatattctgactataaaaatacaattaaaatctgttcacttttgattaaaatcagttgtttaaactggtgtaactacaattcataaagacaaaaatattttaaaaataatagaaatcgataccgatttagacaggtaacaaattgtttgtataggcctcgcacgtgtgttgtcacatcaggtcaaagtctacttagacaggaattgagttgtcttctatctccgtctacgagtctactaccaccagtccagcagtacatttttgtgtacacgagtacgggtgctatcatcgtagtagtaggataggaggagtacgcagtacgtggcatcaggtgttcctccattcactttatttgacaagggctcgtgtgttttgctgccgctgggatgccgcatatatgcaatggtacttgtgtggatcgatcgataaaatctgtaacgacatctacctctatcattggttcgatctcggcacattttaaggacacaaaccacccagaaattaaagcgattgcaacacgtacgggtgtaaattcttctctgcaagctgttagttagaatggtgcaaggtcaagccatacatttggtcgtgccttttttatttctttatggctatgaaggtatttcttcatttattgctatagtgggtgaaaaacttcgcatttctgttctaatattttcttcttgcctaacaggatgttgctgaaaaaataatgacgttctcactgcaagaccttgaacatcaggctacagattgaagaaaagaagctcaaactcctagaacatcatgctcgtttaagggatgaagttgagcatgaacaacaagaaatcatggcaatgccagataggatttacagaaagtcttgtcaaacaatgcgaacgccaacttgtggagcttctaaggcaagttcaacagttgcagagagcttcaagggagaaacatcagaaatccattttcctgtggcgcaaaatgcatagagcttcaagagcgaaacagttcattgtgtttctaatttttctaaatattttctatttttcttttattttttctgatttttaagtattttgccgggttttagcatcttggttgccaaacagtggcagagaattacacccgagtgaggaaaatccgtttgttt

SEQ ID NO: 1167 - DNA, 1982 bp, Zea mays
  misc_feature (1)..(100): optimal_loci_295746_G1, chr8:170994895..170996876, Cluster 7
tgttatacacacatcattgttgtattattacactactattttgctttcaccataaaattatactatcttatttgagttcgaataaacttttaaatttgaaaggcttcatttatccatctcagctatgttaaacctgtaaattccccaaattttatttaaaaatgaaactgtacatttagactattagcttccttctacgtatacccttttttcactatttctttttttataaaataaggtaactaagtgtctgagttgtttgctttgtactgcatacaacctaaccctatagattgtattttcttttcaagccaaaatttttaatacctatatgttgggttggaggacagctactttttctaaaaaggaactataaaaaattattaggtgaacctttatatacttcagcgttgtacactttagcgtctatcaaagccggtgtatcatcttcgtcaatattaaacaaatatagttgttgcatctcagttgcccatcttgcccatctgttcttcagaaaccctggaagacctgtaaatgtttacactaatgctccaaacaaacatattttcttttccttgatgctccaaaccaacttatgttcttttcatcctcaggatccggcatggctccctaggccgaggtcggagagatcaaagacggtgaacgggtcacagtcacagcccaggccgagggtcgacagcagggcaagcggaggccgactggatagacgacgcgccattcatgaagagcattaatctcagtcaatgaagactaaaggagggatattactattcgagcaaagcacgagggagtttagtttccattttaacataacgtgccgcacgtaacgtacgatttccattttggaaagcccactccactcggctactttctttaataacaaaaatctcgtcaccttatttttctgtccgatatatgaaaatctcgtacgtctctatgctttgtgcatgctatagaaaattgcaacttgtgtgtgagggaggggctttctctttgtaaagttgatttttagggcggcgagacgcgacaattgtacgtcgtaccaattggttaatacaccatcgggtcaaacttatggcgcgctgcactgctaagggaagatacatttctatttatttcttaggcatcgttgcgtagtaggtgcaacaacaatatttaacatattattaaaaaaacaatttctcgataagtgacgagtgtaattaaagtccataaatttaattaagagtagtaaaagatatttttctcttaattattcactaattccttttaaactcgctagaaatccgttctttcgtcagaaagggagtaatatatatgaaactccaaatgccacgtgacatccaccgcgttctcatagcaatccagcctactgttccttcctgtacgtgtacggccctccaatccggccacacccgcacgtgtatcagtattagtagtagataaacgaaaggggagcacctcaagaaaacgacttgtacaatctgatcacatcacatcacaacgactttgcagccttcataggattggaacgcgtagtaaagtaaacgacgggattggacgaatggtatgctacagaaaacaggagagggctgaacctgaacgctgacggtgacggcgactgacgtcaaccaaataaaggtagcctgcgtaagtaaactagtgtttactacataaacaatagataaactacatgtaatgagtaatataacatgttcatatagcaaattaaatatgttttgaacacatataacacaaagatgagtgagttactcataattactcaacgaggatcactccaacatgatggaaaatgagtttgtggtgtcattgattctgtaggttttcatagtgcagatgagcagtcgtacatgatcactgccaaaaaaaactcatttgttccaacccatataggttctttagcaaagcgatgttttagagacagtgttgtctctgccacc

SEQ ID NO: 1168 - DNA, 1491 bp, Zea mays
  misc_feature (1)..(100): optimal_loci_2976_G1, chr1:15176287..15177777, Cluster 7
cacatcggcgcttctgctcggcacggcatgtgaaactgtcagggcacaggggtaggtttactgacaaggtttgatttcttttccagctgctgagcacggtccgcgactgggagcaaattcaatgcccttgctttctcccgtcccggcccattcaaaccgggccgtcgttttagttttttttatgttttacttggttttagcggcgaggcgatgcaacgaagaccacagcagcaaactactattgtttcagggtcatttctaatactctctccgtcctaaaatattaggtggcgcttggcagagtttgcacagcttcgctcagagcgagaatcactcttactaagccaaatgataaaaatcggaactgcttcatattgagagtggagtgaatctagtctacactatgtattagaaagtgagaaaaaaaaaacatgcttcccactactcccaacatgctccccactctttaacccctcatgaatcatttcacagcctatttgccaaacaattttcgtcaaatatattcacttctagtagagaatcactcagaatcaccaatcagctctcggaactagagaattgatcaaagacaaactctattaccttcaatgatatgtggttatgattcatgttggcaagctgtgatcctgttgctgctgttcccctggtacttttttttttgtgtgccggttgagtttttatagtttatgttgtgctgcatatgaatgagttttggtagttaccgtggttgccgttcacagcggcgttgcctgctgttcatatgttggcaatccgtgaatttgcatgcttctatatatgagtttggtgttcaattgtacttatatactaccaaaaaataccatagtttcagtgggctgaagaaattaaaacccatgcatgctagtaatgtcatagctaggtgtataccatggttttccaataccaaacttagctaccaaacacatactactgcatctgtatatataatgcactggtgtgcagccgtcagccgtgtgccttctgaagcgtgaaacctggtaaaaaaaaaaaaaaacgggggaggcaagaagcatcagggcaggcaggaggatcctagtacatatcctacttactggcttgcagcaaggctagctgatggctgcgtgcgtgcttacatgatgatgatcatgcgtgtcgttcgtactcgtacgaggatcgaggaaagacaccataactcaccttcaacagacacccttcgttaggagcatgcacggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctac

SEQ ID NO: 1169 - DNA, 3702 bp, Zea mays
  misc_feature (1)..(100): optimal_loci_299907_G1, chr9:12810342..12814043, Cluster 7
agattgattttagaagtcaatttgcgagaacttttggagatgctctactatttatttctcttttggccctgtttgtgatagcttcagcttaaaaaaatttagtagaattgttagagcaggtcattagatgctataaaaaactatataaccgaaggtgtaagactttaaaagatatttaaataagtcattttatttattatttagaataaaaatatttttaaaactatttaaattgatattataaactattgctttacatggagctaggaactggagcatcccaaagacctcgaacgtatctcgaggactcgcggaactactggagcacagagcagtttggaagcgaacatcgcaaccagcagagcgggccggcccatcggggaggaggagaccagcaaaatccgctagtcggcgaggtgcatggtccgaccggtcagaccttaagcggccccttgttggacgagttggtggtctgtttgttgtggggatgtcgtgtgttctcgcagtcggcccaatatatcattgtgttcagttattcggcctggtgagtggtgacggcttgggagctcggccgtcgtacagcgcagactccgcggagggatcgcctatcgttttctgatctccccgctcctcctatgtgcgagccacgtgactgaacagaaatgacaaaggatcccaaaggccgaagaccaaagcccaaaagcaaaaagccgagcccactcgcgcaaagtggagatccgcatgcgcgacgcgcgctactttcagagctgagacgaagcaggggaccctcaagttaaaccatcactgacagtgggtccgtcgttgcacttggaccctcatgccgtctcagcggcgctgcgctcacgccgtcgttcggcactccggcggttctgcccctctccactcgatcgctggccgcgcgcagcgcgctacgggctacggtgctagtgcgatcgccggttatgccgaaagcggcgctgctctttgttactgcatgtgctaatcacctttaggatgtgataacggaaaaagcgaagccacactttggtgacctttctgtacgagaagtcgagaacaaacgaacggtggatcacacgcgtggcaccactccacgactgccgacgggacggggacggggacggcgcgacgtacgcactactctccaccggtctccactccgctcgccacccgcccgcctgcctcggaatcgaggccggccggtgctcgtgattccagtcctccgtcgggcgcggcggcgtcagcgttcctccgccgtgtgccgcctccctctccatggatttcgtctgccccggcgaccccgcggtgcgattcctaaaccccgccaaaaccctacttgtttttatttttaccccgggcgccggacgtacgctggggtttttgaattaccgatcgcgacgtggtcctaacccgtgactgttttggggcggcgatctctcggtgcaggtatgggacgtcgacgggaggcgtttcgggccgtgcttcgcggatttatatccttgccttttgattttgatctcgagtgggttgcagttgcagttctgtggtttgttgtcctcgagtgtggtttgccgttggtgttgttctgaggtctctccttaacacttttgtcgtggttgcacggtgctgggattcgctgggaatgcgatcgccgcggttgctgcacttgggctcttcctcgccaagaggaacacaaacagagctcaggtacttgattttgctctgcatcatctactacttctccgtttaataaagtaatcgatcatttttgcgatcatttcgaggagcatttcgctgtcaacattcaggctatgttgactatttggaattcgtaggaaagttagttgctaaccatcgtctcttccagattctgcttttgcatgacatattggcattcaaaaactgtaagggattagacagccgagatactcctatcctaaaatagttgttgttcttgttttcgagaaatcaattctttttaactttagtcaaatatattttatagtatataaccagtattattagataggccattgaatctatctgtataataaatttatttagagatgtaaatgcatgttgataatattttctataaatctagttaaatttgagaaattctaaccaatgtaaatattatagcggcaactattttggaatagcttttcttgttcctatttgcattttacttgtttctatctgcatattttgacctgatgtgacacattaatgacggagatagttgcctcctgctgtagtactaattgtatgggactactgttcagacgtactttatgtaagtgcgttgtgctcatagagggggtaaaaataagggtgccaagtgccatctactatacttactgctgctcagtttgaattctgattattcattgttatgtttacattctatgcctacaaagcaataccttgctgtccgttgtcaatgtattaggccttatatcgcattatatatttcacatgtttgtttacggtagaccatttggagtattcaagtaaagcttgcatgttgcattaccgatttcgtcataaggctatccctagtaggtgccatatgcgaatatgcattttgagcggtcacggtacatatgcgagcacgcaaatgagaggacgcttcgaatagaccgggcatgtagacgctcaaataaacccacggaggagagagaaaccatagatttggtgtatgtggagggtgagcgcacattttccgcgtcctcatctgcgctctgctggaaggggctattgtggctcgcgagcacacaaaatgcacatacgcacccgtttaggggctctactggagatagctatgtaattgtagaattagcaccttcagttactcatgaataagtcgataattgaaactggatcaagatttcagaaatttggtggtcatactaatactaggaggattcaagcagctggcagcataatataccatccagatccagtactacataataatattatatgttcttgcattaaagcacttaatgaaacaagaaaacttgacacaaggcaaaccgtaaaaacaacaaattacattttaacaccatatagaagcaatgcccaaggagagtggctctgtttacatttaatgcctgttacctgacaattatcttatttaatttatgttcttcattatttgtaccttgttatgtataataatagttctactgttgtagaacgtcacaagaagtttatcggagaagttgcttgcattcggtgtgcctggttttgcagcctgcctttctttgcttggattgactatgctagctaagaagaaatttgaagggaaggatgttaaaaattatgaactattcttcacatgctcccagtttattgcatgggtaagaactctgttatcataatgatcttgtttctctttcgagtcatataaatgtttgaacaaatgtgcttatggttggtgctaaacattccttttgatagatgtctctaagtcttgtccgtgtcagtggggcttggtttgaaatcctctataacccaataatgtgcttcttctggatattgaaggttattctagagatacctcatttgcaatacaagcttatcttactgaaggtatcccattattttacaaaacgatttcctttatcttcaacatgttaataaagctgtggaaggcttctacatttcttctgttttatt

SEQ ID NO: 1170 - DNA, 2242 bp, Zea mays
  misc_feature (1)..(100): optimal_loci_300082_G1, chr9:13942358..13944599, Cluster 7
attcctcatagttagttagttagtactaacatgagtaatgaaataataccaccaaatttatggaatagactaatgatgcaccaattcatcttgaacggagtgattacttaaaccaaacactcccttaattatccttgtgtcatcattattggagaaaagtcaacgccaacgattaattggcgtgggttgtcaacagccgacaaacgccacctaatatgtatatatattttttaaaaaatctttcagagcttcggagttccgagtggtttcaaaagccaagggaatttcgaaagcacgcgcatggtaaaaattgaaattcacgcaaacttcgtcgggaccggatctgcgagaagcaaaacaagcccttcccacggaattgtgtaaaagctgtataaaatggcagcatcgatggcatctgcagcctgccccaatcgcatgcgccgccaccactgaagtctgtgtgccattggttgtgaatgtgaggtcaaccaatgaatctaacatcgatcgtcataatttgaagtcaataaaaaatccttcacacgaactacaaacattgtaccagtacagtgctgttgcatcggcagctcagcagcctgccagtaggtgcatatgcagtgcagtataatacaactagcgtgcttagcagcagattggtctcatcagcttagcatccagttcgattgatgacaagccttgggaacccctcgcatccatcggaaaatcgtctatatatatgagacatgagttgaagagtttggacacacgcacttcgaaagtccaaactccagaaaccattcctcggcgagcgctgcgctagcagtacgtagaagccggccgccatgatgaatcgcagaatcctagcttgtctgctcatggtcgtcgtcgtcttcatgggttcgtctttcgcccgccgcggggcagctcccgtgcaagaggacgggaggagtgtctgggccgcccgccggcggcgtcgtgacggcggcggccggcaaccacggcagggcggccgcctacggctaccgcggcggaaaggtggtctggaacaacaggcgctccttgggggcgaggatcgtgcgtccgccagcgccggtgtcgaacaggatgaaggccgcggcgatgcctgggccaccgtcgccgacgacgagagtgtgatgcctggcctggttggctggctagcagctagctgcttctctcctgatgtgtgtctccagtgtccaccttgggcatgcgcgtaccggtgactagtgtgaacgtttgtgtatcttcggctgcgtcaaactgctactagcagtttaccctaatctgtgctttggagtttgggaattctgtatacatacatacattatcttttatctctatgtaaagtttgcctcgttagctagtgttctacaatgaaatctcaataggcacatcttattatatatactaggtatgtgcccgtgcgttgcaacaacatacaaaatattcaaattaaacgcatctgagtagccatgcagtgaaactattttggtacttttttcgcaatgatagaaatatctaaagttgggtaatctgatatgataggtaacatgacccataagaaaagatgaatagaaatatgccccccacaagccaagatgaacacaaatatgccctcccacaagccaaagcacgtgttccctctcattcaacacaagtagagtccatgccatctagatctagtcgagcctgatgacaccgtataattccatcggtgctgcagtgacatcctgcatagtgagcacaaacatgaagagtgagatcgacctaaatgcctcttatgatcatagaactccgaaccacctacaataaagtgtgtgaaaatatagaataagatgaaacaaaaacgggataaatgcatgtagttctttgtgtaaacacacacctcctttataaagttcggtgtatccatgatctctgcaaagcttggtcttagagcaggatattgctgctagcatctctgtagtagttcaacgagcataggatgtgtattggtgcaatagtaagcctaatattgtgcatgcagtggtattgtatatgccagattaggattcgaaacaaaaactccacaacacttttgaagagtattttactttcccaccaaacatcagaaaagatacaaatgagttacaactcaacattcgcattctatttggaaccttttccttgcagcaaaatatagtatgataatagcaagatgtgatactgttcttttttatga

SEQ ID NO: 1171 - DNA, 1623 bp, Zea mays
  misc_feature (1)..(100): optimal_loci_301283_G1, chr9:20901268..20902890, Cluster 7
gacaagggtacatatagttttgatttggttaacaaaaaatagcgataagcttgcttctttttgtttatatagttttcttctttgaacttgtatcgtatattgatatgaaacttgaattctatgtaataccagttttttactggctttcttaattttatcatatagttttttgcccccccccccccccccccggtaaattctcgccctgtgtccgccactggtcttcactcctcaacacctacgatggtccgatgtggattcaacgaaactaatcttgcgaccgtataagttaaaaggccatgtccaagtgacgcaaaatttgaactctaaaaggaaattagaacgaaacgtttctatgatccgctaatcctttcatatccgtatgagttagaggctagagcaccgagtcccaacacatagcaaccaggggcggacccaggacaaaacaagagtgagagcacacccgtgagaattactatcaaaataacagagcgagggcatccaagttaggttgagcacgggacataatgataaaaaattatactctactaattacgggataaaaacaagcgagagcatatgccctccctccaaccaacgtaggtccgcccttgatagcaacgtatatagtgcacgtttcttttcgaagacacgcaaacgcataatacgatagttgaacagatctttttcgagctgtgagtgatctagataatcacgcaacaagttgtacgtacattgcatatcattattgcaacacagaacaaacagcagctaatgatgatactagtattggaagcttgggaacaacaggaacgacgggacgaagaagccggcgagcgagtgagcttgtttgttgtacccatgtgctcgtcctagctcttgtaacgcatgcattaactgggtatatatgtcgttgcagacttgcagaagggcagcaatagctagcatgcaggtcgatgatgggcgccggccggcgtggcatgcacatgcgggcgccgggaaatcccgaggcacgccagcttggatggggtgtacggccgcgtcgcgcgcacgtgtcccctccgatccggctgcgcggcgggcccggcccgcacctccactccatccacatgcggcacgccccggtcgtcggtcaacgtcacgacggaaccatcacttgatatgacgatcatcagtagtagtactagtactataaagaaaaaaatagcagtcgtactataacagtgtatatcctagcttgctttatatattattagtcctttttaaaagtacgtttcttagcctcttttttttcaattatactactacgtcaaacaatttttaaatgtaacaaaaatctatatgcatgtttatgattgatataccggccgaatatacgagtacaataattattgtactctaacgtgcatggcaataaggtgcaacatattaacgacagttgtactcagcatcacgtactgctactgcaggtccagctatatagcctacctgtaaactgcctgtaccttgtacgacgttgcgcctctagcatgcagtccgttaaccgcatacctgaaagagtaggttggacgatgatgatgagtcgttacaagctgctagctagtggcaactaattaacacgcg

SEQ ID NO: 1172 - DNA, 1801 bp, Zea mays
  misc_feature (1)..(100): optimal_loci_302185_G1, chr9:27326416..27328216, Cluster 7
cttcctcgactagaagatctaccaatgctgccccgtctccaagcgggactcctatctaggacagtttgctgatcatgttcctgtagaactgaagtgaagagagttttattatttgttcgatgcaaaacttagctttgttcttattcttcatgccgatttatgttagtgtcgttagtgagtgaagttcagtcttgttgctcccgccattactaagtgaagttcagtcacaaacttggctttgttctttttcttcataccgatttatgttagtgtcgttactgagtgaagttcagtcttgctgctcccaccattactgagtaaagttcagtcacaaatggccactttatagtctgagttgttgattgtttctacactttatgttagtgctatttccttcattgagggtctggtttttgcatttagggggagaaaacactacatcacccaaaagacgcttgcttcatataggttttacatgtcacacctcatttctaatggaaaactattttttgcattttaagttgtcttatttccttagatggatttggaacacagaagaaaggaactttttattgagacagtggctaagccttgtacgctttgatttggagtaggattagagcaattcggtactacaggaacaggagcaatcccccttctctcatgtcccataattcatgtattccctgagttgttgattgtttctatcttctgcatatcaataatcaccgctactgatttttacactaatgttggatttgtatccgttgttgtgttgaaaaactgtgttttttgggcatcgaccatgtggactatggtttttttgcaatttattactaagaaatttgaccatccttgtggtagaagatagaaacaacagttaaccagttacagcgtgcaagccaggcttcggaggaaagaagattttatctacaccatgaactgttattgttgtttgaggtatatgaaaccaatcccccttttctcttgtctcataattcctgatgtttgcgatatgtatgctactcgtgctatggatttggaaaataggtttggtaattagtatggctacctactaagtcaatgatgtattcggtgataaaaattgcatgcatttgattttgatttttgtctaaggcattaatgcttgttcctaattttcctatgttgttatatgaggaatacaccattgtgttacatattttttctatttaaatcagtggcggtgccttggtaccttaaacaggtcgctacacccatgttggtagaagtatagtgatatgatcatcctttgttctgtctggtgctaaggtctgatgttatttagttcgtctgcttgggaattagctcaatttcaacataaataatctcctcaattggctacactagggaggattttccaggctaaaaaatcttgaacctaatttttcgaacaaacctaatttttgcatagttgagaaaaaaacgaatagaatacaaaaactcttcagccaaaaggacaaagtaatattattttcaatgatagaaataaggaaacgaatcagtagtagcaaaaaacacatttggttcatcgattccattattttcatttaaaaaaatcttgactattgtggaattgtgggtatagacttgttcaagcaggcgcatactctctctattgaccctcaccccttcctattttgttctgcttgcggagctattggtttttataagtgtgcaactaaagatcggtgactatatcttggtttcagacccatcaaatctgtttcgagttccagcaaggagcagcgaagcacacatt

SEQ ID NO: 1173 - DNA, 2985 bp, Zea mays
  misc_feature (1)..(100): optimal_loci_313588_G1, chr9:99021063..99024047, Cluster 7
attaattagggtcagtttagacgattgcttgtagaaaatgcagctgatgatatatggctgtccgtatagtgattctatgagagacggagcagctgccaaaaaaaaacatctgctgaacagctgatgtttttagctaggaaatagttcaggtattaattctatgacctaattaaccctgaccaccagccaaaattaaccacattttctaggcatagcgcgcataagtgagaacccccctattatctgatccgaaactaaatgatcgtcatttttctcattgtctgatcccattaaaaatttgcaaggatcaacaaaaaacaagcttgttgatagctctatatatacatacccaaaccacgcaagcagcaaattaaacaaggtgattgagtagagcatcgatctatcactgccagagagaagcagctagcacagccaacttcatccggccggatagataacgcacactctttttctattcctttccaagtggggtagaagggttaactggataagaattcgcggtctccgctgcaaaagaaaacgaaaaggaagtgcattcgcgacagaagatcgtaagcatcctgatgtatcgagtctacctactactcctcccccccgggccccgaaagcagctttatcctaaactagagcaacaggggggggggggggagagatagagagcttcaattcaactccgtagagcgaaaaactttatacatattattgcctagtgcaacagttcgttagacaagagagatatcaaggcaagattattttattgcttgctgcattattaatttgggtgagaacccggccgttggttaatcttttttgtttttttttggtttgctgtgattgtgcagtggtttgagaagcttttagataggatccgtagtcttggtatttaggatcagacaagtcttgagtccgaattgaatcctgcaggcagacgtatacgcaattgaacgagagacaattacagtcggctcctacttgtatgcttgattgagaccgacctggtgtagttttgtgtgccagactgtcaggagagaagtagtgtcgtcgaattccccacattttcctttgaacttaagtttttttttggttcaaacaaatcgagcaaatactgttgcacgtgcgatgtgatatgagtgcaatgcaatggtttgctgcatccttaatagcaagaaaaactacaggttagctggttaggtggtgttagaactaaatggtgttagaactaaatactgttgcaatcgatcacctcaacaaagataccaaatgtacaccacccgtggcctagctcaactatatatcttcaaggaaatggactacagcggggagaggtatcgctgtggacccattcaatttggctgcacacgtaccaacgcacccagattaaaagtgcgaatttaagtgcaatatttgagacatatccgtagaatgccatatccacagaaaataataatcagcaacaacaacaagaagaagaatagacttaccatgcaagttttccccaccatatcactctcgagaatttcttgcgatatccaaaaatttctcgagagaataaaccagctcaattcttgtcgagagagaaagagttggcaaccggggccaaaaatgtgatcgcgtcaaactgccgcgcgcccctttttgctcgatcgatcgatcgatcgagtgtgtcttgattagttaattagttcgtagctaatatatatggcttttgtgctatgagaaagacatcttgccagcagcagcacttattaatgtagtatcaaaatagcctttgtgctatatatgagaaggagtggcatgccgtagaatgtttttttcccttaattaattaggacccgatgcgtgtgcttgattaggctagctagagcttggcaggcaggcaatccgctctctagttgcctccacaattcccttctccgcttccgcggtaggattcgtctgctttccgatccgccccccttgttgcttggtggtggctagtggtggcgctggcccgtacccagcctcagacaaaaaatgcggccactatagctctcgtagagagagaaagagagagagggagaggggaacaaaaaaacaagaagaagaagaagaagaaatagatgagtaaacagaagaggaaccttgcatccgagggagcagaagcggaaaggagtccgggaggctccggcagcagatctggcaggtgttggtgacgcccttgccgggcctggcctgcgggcggccgttgaggaacacgatcttggcgctgttgatcacgtacgtctgcacgtgggagatgtcgatcagcttccccacctccgacacccggatcacgttgtggtacgacgaccgacgtatctgcatgccagcatgcgccgactagaactattatatacatgccaagccaagaatgaagaaggcaatcaatcgctcgccgccgcgctgacctggacgacgtggtggtctcggtgcgccggcaggcagtaggcgcagagggcgtcgcccgtgcagcagccgaggcagaagaggttgcactcgttcttgctcagctccgggtgcagccggcacggcacgaagaagctcgtgcccagcagcggccgcagccacgccgggcccaggtcctcctccgaccgcaccgccgggctcctcgggctcgccacgctcaccatcacctgccgcacgcacgtaccataccaccgaattataatccatcagtcaccaatcacacaccatcatatcatgcgccgtctcctccaaatcaagcatcgattgcaaaggcgatcgacgacgtacaccaagagaattctgctttaccatttgtacagcaggttcctccagagctacagcagcagctgacatatatatatatttccctcagtcgtctttgcaccgacgacgacgactcagccccgccctgcagaccaggctgcacaaggcatcctcgctccaaggggagactgaactgaagagagacgaagcaaggag

SEQ ID NO: 1174 - DNA, 1728 bp, Zea mays
  misc_feature (1)..(100): optimal_loci_313600_G1, chr9:99075789..99077516, Cluster 7
gaaaaatggagtaaaaacccactacatcctagtttagagaggagattgacttataagtactattttagagaagttagagttatggatgctagaagagagaagcccacttaaattagtgctataagtttgtgactaatcaaatatatggtcatacaaaacattgttttgtgtatatgttcgtaaataaaatatcgtttaaaaaattactgcattttaaaatttaaatttatgttaacattatatgtagtcgttaataagtagattaattataaaattaggtaaatttttcgatcgaccaacaaatattgatatcgttttcgatagtttctgtccctatctacgaccccaccttccgctccagacagatacacggcgcttcaaaactcgtcctactcctaccaaaggcattttacagcgcgcggctgtaggagccgcctgtattccatcccatccatccattcaccgtgcttcttccgccagtctcaaggccatggcggtggcggtggcggagcagcctttcgcgacgtctccctcctcaactcaacttgctctcccgccaccacactcttgccgcactgtcacatttccgctttcgtgatgtcctggcctccaccgacgccgtcctcccttcgtcgccgcactcctccgcagccgttgcgcgcgcggtcgcgtgcaagccgccacccgctcctctggctccaataatggcttcgtacgtctccactacgctcctcaatacgtactgcaagctgagaggtacttctgatgcgcagagggtgtttgatgagattccgtgtgttctaggctgcagggtaatggcaggcacacacgcaagtgttctgtaataagagaggcctttgagcccttccgacggatgttccaggagctggcctggcctggactgcatcttccagctccagatggaccgcgtcctaccatacttgttaatgcccgataggggggaatttgttggcactagaagtgtgccctgttctctggaatctgaaagtccttcggtcggagtcagtggtgcaacgctctgaggtggagacatgtttctgaacacagagacgaggaagcaaaagcaagcaagcacatgcagcgagtgagcatccttgccttcggatttggagctgacacagagacaagggaagaacatgcgagatccagagttcgccccgtacgtaggtccgaatccaatcgcctggtcaagtctgttgctgccggaggtagacggacgccttaccggcaacaggtagcaaaagcataagccagtacaggcgagtggctggcaatgcattgaccggcaaagccccaacgaacgatcgccgtccgtccgtccggggccggaatacgtgcatcatgcatggtcacttcattattagctacgctttggtcgttttggtgcacgggttaaagtgcgcctctttttaatttaccggcgaaagatagtgcatgtgcttctctttgacttccacgacgacgttcctacggatgtgtgctttgctttccagtgttacccttttttcttccttcatttttttttacttttttctaatacactagtgccctatttggcaccggtgggaaaaaaatatagggcaaagaagccgtgtccgataatgtggcaccgcaatcatttattacagtcacaagaaattatggtacaaaaaaaagctgcaatcacacaaattatgatgcgcgatgttacctcaaatttaaagaaca

SEQ ID NO: 1175 - DNA, 2532 bp, Zea mays
  misc_feature (1)..(100): optimal_loci_313790_G1, chr9:100092040..100094571, Cluster 7
acgtcaatgggaactaaacggttgacccgtttaaatagtcgatgacctgtataaacggtctaaatgacctaaatggaacaggtttaaacggatttaaacgttgtttagcctagttttgggtccttttcttgatagggccaaaatgcggtaggctcaactgcattgtcctgttactattagagtttcgtcaccttctctacctgagcttgccttctttcctttggtttttttacagtttctatatatgactatatcttcttctagcctgttttagttgttgttctataattagctcaactaggggtgggtttggatgtcttgaattggtcattttggttatatggatatgtaatgtgtaatgtcagagctgttgtccgtttatcacagttttgtatcactaaacaaatatatttgtggatttactcttcttttctaggtacatgtttaaatggagaggacatcaaaagctttgtgtttacttaaaaaaggttagtgaaaaactatttaatcttgctgaacacgtttaaacatgtctagaccctaaacagagctcgccgctcatctaccgtttatgtcaccattgataagaataggtccaaacattttttttgccataacctaagatatcatgtcgaagcaatatcttacttaagatacaatttttctctcttctattaaataccttgacgcatagaaaaaaaatcctatctacaatctcattaaagactggtttggtgacaagagaattacatgatctatagagagaaaatcatttactatttagaaatttcctccctatggatcgcctctaatttacaaccgacccctaataaggttgcaaacaatgactgaacgctaaagcaactttttttgaatttcaaaatagaacaggtgtacaaatatcatacttggtggaagtcagggggcggcagcttggagcccggagagacgtgcacgtagctaacgatggagaagatatgcacgctggtagaatagaagtcgatagcagttttagtaatttttaactatataacgtgattcttttaaaaaataatctaaaataaactactcttaagaaaatatgagattatcatatttagatattagattatgtaatctaaatctataatttagatgtttgtttagatatggattatataatctattagattgacctaaatataatactacctatcaggaatagcataactgcaccttatatgatccttgatccaccacgcacgtagcaaagctcaaatgcccgtggattaccaccacccaagggcaaacccgtgccgctccacagtatcctcggggccagccatccgccgttccggcttcctccgcattgtggtcttctgtcttcctgcctgcctgtaaacccactctccctcgccccgcctttgccgccggtaatcctgcccactctccacgttttgttccagtcttaactctgaagtgaccgcgcgactgcgccgttgatttcgggcttttctctttggcctctggggctcgtgggttccggcggcgcgcaacggtgttcggttacccttcgtctgggatatttgggcgtggcctgattgcggtgcgccggtgcctgctcgttgtcctgcttggggtggggttttgtgccgcagtggtggtgggggtttggtgctttcgcctcgacgtcacactacgttgtttgcgtaaatcggtgcgtaatcggtggtcatttcctctcttaactaatttcctttataaaagagttaactgatttgtttgtgaccgcgaaaatttgcattcaagtttcgaaaatggccgcagttctcgtgagggactccgctttgtaagagtttgtatgtattaatttctctgtatgtttacgtggtttagattggtgctcttgggtgcgtttattttcagttgaatgctgtgtttgctaggatctcggattcgaatggaatcaaacaagcgaccaatatttccttccgtggtcgtgatttcgagcgcttgccgcttggtgctgatcttgatgcgttattggtagaattggtgcaatgttgaaggtgtattaggggctcgtttggtggatcacggccttttggccttatttgtgaccatggattttgcattggacgcatacctcctgggtcgggtttgtattacttatttagtttgtgtagtactgagtatgcgattgtgatagtttggtgggaatgccaaaagttactattcgttctcttggtatatgttccattttgaggttactttgaagtttgaagcatttcctgggcacgtaatttggcacttagctgtaaatgatctgctggcaggtgtcagttttttttaatttcagtagaacttcccccatgggttatgaaaaggaaaaatcatcttgtagcctgctcacttgatctagtaggaagagtaattatgctatatcctaataatagctgtggacctctacatgcctcttggcttggactaggaatgtattatattttggcttcattttcttcttcaactttggataattgatcatacttatta

SEQ ID NO: 1176 - DNA, 1724 bp, Zea mays
  misc_feature (1)..(100): optimal_loci_314278_G1, chr9:102375008..102376731, Cluster 7
cgaaaacaaccaccaacccagtaatcaactctacattgtcattaatctacttttctgtctaaaacaaaagcataacaggctaacagcttactgttaccctcaaataaccagtaattttcttttcatttatttatacaaatgaaaaacatcctgctgttatcaactttaagcgacagttacattacagataatttgttaaacttaatttgttcaattctgttatcaacttttgattcctctgcccaacatctgcaaagcttacctggacaccattaccttccaactatcactttgaaattgttgaatttacgactacggcatcgtaaaatttctttttgttcctgaacagcatgcctaagaaagaaacaaaagattagcagcatgggatttccatgcgcacatgtcaagtctattcccaggttcatgtcccagccaccgtcactttctcaaaagaacaaaagctaggatacaagcaaacttttccgtaaaaaaggtgaaagcaaagtaaagcaagattgttttgaccctaatgagttcatggtcccctttgactacacagatgcaaaacagtgtactaatctacagaagccacagtccattggtatagatgccatgctctctctaactaactcagcttttgtaactggagatcaaaataaatcctcagatgccattcgaggaacgaccaaagaaaacccacccatgcgtggacggctggaccacattcctcaagtgcttggtccaagactctctaggcaaacttttgaccgcggttggaagaaaccaaaaactgaacgcaaccaatgcgagcgaaagcaatcgtgcactgaacattcagtgtttcacaactgccagtcccttcccccaagaggccatggctcgttttagctacaggctcgtcatggaatcgtgccagtttcagagaagggtcacgcacaatgcgacagggcacgaccagaacagttttgtcgcaggatccgacagactgtttcagattatgcctgaaaacagctagaggttcaaacactgcagaattcagacacgaagcagaactgaataccttactattggtcttgacacagatgtggaaaacaaaaaaaaggtgaacttttttcgttgtttgaggtggaaagtagagctggcttgttttttggactgatcagtttggtcagaataaaatgccaaaagcatctcataaccgctagaagaggtgaagagcacggcatgtttaaatactcgaggactggttgagatgctgctggtccgtaccgatggcgtagccgctggagatacttcctcgatcttccgtgtgcagcgcctctctggaatgatgccaaatccgccgtcggatcgcgactcggaactaccgccgccggcgacgcatctcgctacgaggacgcggcggggccgggctacgtggagagatgaacgacattcttcctgggcttgggaggctagttggtggactgggctcgatatcatagtaagtggttggcccaatctggaaagagagaaaaggagaacgaaattagaccagcaacttttattattaattttatatctatactacttgttaagaaggtaaaagtagtctgtcgttctgccgtcctccgcgcagaaaaaaaaaatcaaaccatggctgtctagagatcgaaccttggatctattgagcagaatacctagccttccaccctctagtcaacatgactcatgttaaattgtat

SEQ ID NO: 1177 - DNA, 1755 bp, Zea mays
  misc_feature (1)..(100): optimal_loci_3160_G1, chr1:16129908..16131662, Cluster 7
caagtcattgctagcggttaggagaaatgctttctcaggagtgaggagctacaaggccatcacacgctttcgacaggtccttggcgagcattagctaaaataaaatgtaatatttattattatcaatttaatatcttatatatagacaatatgctcactttaatattaaatgtatttattattagtatttgtttggtagagtctatatgattagtttactttagtcaaccattgattatagtgcgggtacgacatcgtccttctcgaccaataaataagattgtgtaccgtcgcaacacaaggatattatactcgtttacttatataatgcaccggcgtttgaattgctctcgcttttggaagcaaaactcacacacctgcctacaacaagaaggtcacaccgtacatgaacagctctactgactggtggctttttattacactggcgatgggcgatggaagggtgtagctgtatacagtatgtagagctaccacgcctccgtatgtatcctggagcgataagggtgacgtaagtagtactacggtctacggagcctctaggcagttgtggacaaagcgaggtgcgagtgcgaggagggcaccggtttatctccctcgggggacgtgccactaccacccagtcggcagtccagactctctctctctcttctgtacgttctactacgagagacaaagacgtttgtgatttgtgccgcccgtgcatgcagatgcagcctactccacggaatcacctccacacgtctcccgtgatcaccccggtctccgcctctccggcagacggcagtacgtgtacgtggctccctgccctgcggattccaaagtccaaaccaggctacaggctgcttcatacggttttaaagtgctccagggaagaaaacaaaaaaaaaaacacttcagatccaatatttttttagctgaacattacatttacagatttcctggagcacattactaagagatgctcaaacaaaatcagatctagactataaagttaaacataaattgctcatcataccgttaattaatgggaagcatccattcttcatctttctttctccttcccgcgtcgcgcatctccgcccttagccacgagcccacgaccagcctgccggccccagcgggccgccgcggcgagctccggacaagccacgacgagtcccccctgcccgctcttggcagcggctagccaaccctgcctccagccgcctcgcgcctgggccatgctggtctcgttccaggacgtaggataggaactagcaagtgagagcaagctggtgatgcgtcgatcgctcgctccgtttcgcctttgtttttgcgttgaagctatcgagcatagatgcacttgctgtacagaggagacccgaggtacgtagtacgtgaagtctaggagggtcacgacaacggaaccacgaaacgggagcggcgcggggcgattgttttgggaagatgatgatgcgtgcatgcttggcttggctgcctgcttcgcgacgtacgggcattgattgatttgattgaagggttgcttggtatccgtgaaactatggcttccggttcccgaggccgctgcatttgcgtcgcaagcagacaaagcagacagcgatggagaaattgcatgagtgtcccttcctccactgcctccgtacaccgctcgctctgcgttctgcgcggccggcgcgaataatttttttctctattggagatggggagatacatgctgtaaaaatctgcccaagc

SEQ ID NO: 1178 - DNA, 2079 bp, Zea mays
  misc_feature (1)..(100): optimal_loci_320664_G1, chr9:136492541..136494619, Cluster 7
aatgaaacgtcgtcactctcactctgaatgggcgtttcacgcgatttccagtcttccgagcggcagcgtttggcgcggagagtatttgggccagattcccgtgcttcttccatcagacagcccgtcacgatttgccatttgggctcttgcacatgtgcccgcagaattcctgactattttgcaacctgcctcagatttcagccccaagtttcgtagttgcgggcagcagatgttctgaatcttgtgttcctgtgaatttgtgcatctgatccatcgaccacaaatcatgttccatcctcctctgctaccgtgtcaggacgcacgcacgcacgtctgagcagacggaagcctcgtaccatgtcgccgaaaaccatgtgaaataataaaatcagaaatgttcttgagcgactcattactgaactggaaaagcccttcccttcagccttccagaccttggagagtgagctggaagccatttcctccatcccgcgcaatgatggcgtcgtcgcccccactgattcttgcatcaatgtttaattctgcattaggtcaaggctaagataacactgttcatcatagcctgctgcagcaatcagtgaagtaatctatcgaagaacactttgccctgcattttcatttggtttcccccgtgcctttgggacgcacataacccatgagcagaacagaacagaacagcgacgcgcgcgggcagctcctgcaatgattcagttcgattatttgtcttaaatcatatataactcttaaaacggtggaatagttttctaagtacaaaagataataaagaagttgtatggacttgagcccctaaatcataaatacagttaacagaccatgtttataaagaatcgtgtagagataaaaatagtttgtctcttgtaattttttagttaacctctaaagactactcaaaagaccctctattaaatagtattatatacacccttacgaaagattctcttgggatcagtgttacagcgttcatgtatggtcattgttttatctcgactctccagatgtttatgttatacttaagaataaaaaaggtccattcttctatcctgtaaagaaacgattgaaggggaaacttaagcgctcaatcatttgacggctaggatcagtatcacacggggggaaaactgggggtgctgtgctgaaacaacgacgaagctctatgcacgcaacgcagagactggattacagtgtcggcgaaaccgctcttgtgggcaccaaaccaaagccatttctgtgctcgtggcacgaaacagtcccagtccctcgctcgctcgcttggcgttggcgacagcacatcgctgcgtctttggagccgccgcttttgcagcgaactgtgtgtgtgagttgtccggctttcccatgcaattggatggatagtcacatgccaagctacatacagttcccggtgctcggtcggcaggcatgcatggtattggtgcccccaaaggctcggcgcctacctggccttcctctgattgcagagcagagaaatgttccatgggtcagggcgcaaggcagctagggaggcagacccgcccatcgtgtcagactggagaggagaaagcgagcaaaggcattggacatacgttcctttttcatcagtgttgtttgagccctgcgtcatgtgcttctgcgacgcagccagctctacacgcacagcgaaaaggagacactctggattctggaccatctcgtctcacctctctctctctctctctcccacttcatgtttttttaccactgaaattatggggagaaattcaactagtgtcaaagttaggtcgtgtttgcaacatctctagctttagaaaaacctggtgaagctaatggagcaagtcattatgtgttttagaaaatcgtggagctagacctataaacatttaaaagacatttaaataaatcagttttggtttattatctagattaaaaatatttttaaactatttaaattaatattataaactctcgaggtggaacttggaaccgacccaaacaccctcttagctacagtttcaactgttagatgtatatattgtgcagtatata

SEQ ID NO: 1179 - DNA, 2241 bp, Zea mays
  misc_feature (1)..(100): optimal_loci_321631_G1, chr9:141428149..141430389, Cluster 7
aaaggccgcctccacctcgcgcttggtgtcaggcctgcatctcaactcaggccgccacaaataaaccctgccggaaggaccttaattactaaaggacccgtacagtaacgtttttacaacctttaccactccgctcgcacccccagcaatcaaatacagtactactactactgctaatatatcgataatgcagtgtatatatgcaattatgcataaactgaaggcagcctcatgagcacatgccacggtggtccggctgtccatgaccttcaaatccatcgcgtgcggcttcgttgctctgcttgcaacaactacgtgtgttcctttcctagtaccatggagcagcaggcgtcgagggcgtctcgccggggcagccgcaccccgcagtatttcccgtacctcagcagcggcgggacttgcattttcagccgacagggaaggaaaaagcaagcgcatcatcagtgccttttgccggtgaggtgagtactcggctgaaactcggaaatggaactcggaaaagcgaccccgactgttcagttttgcttcccagaagaacagctgaactgttgaacttgaaccccccaaacagagcccaggaaaacggcagatttggcagtgacgatgtgattcgcacgtccggctacaaccctgtccatgcatggtggttggaacaagagcactcacagaagttcagactctgttcgtaccgaaggtgctgtcccgactcccgagcaggtcgccgacgttgagggcctgtgaggacgccgtcgccagcaggaggagaagcagcaacgggcactgagagagtggatgccatcctctggcgttcgtttgcgcgtctagctccgcgtgtaattggctgtggaagtttcggcccgcatcttaccgggacaggatcacaatcacacggacattgtggtcatttgggcaggtcttgaagcaaagctacagtagctgcctatataaaaaaaacgtttctcgtagtacattcctgcgccattgtgtgtggcaatgcaccgtagcaaattcatgtgaggcagtcgtgtaaatcttgtttcctgttccgtagcaagttgttaagtggctacaccctacacatgcacctctcaacggcagggccaccgccagtccgccactataccaagcttacttatatacacacacctccctgctgatgtgctaactagtgaggctttagttagctgttcgtgatggtgtggtgttggcccaaatgcttgttgttggtatggagcaagtgattttggaggttgataactgatgcaccctggtgactattatgctccggtcggaagagggaaggcggtgtgctattgcaggtttatttatggcaagaaattagggaacgaatcagggatttccggtcttttgatgtatcttttgttaataaggaacggaatgaggtagctcacctgttcggacagctaaatatatatagcggattccattaattacaagatagccccctgaattcggacatcacctgatccgtacatataacaccttccactctagtactctactacctaggtggtccacgcacgagactacaagaggcagtgtcacaccgcaggcacgagcgtactactacaggttgcgtcattcaacgtccgaaatagcacggcgcagtcttcggttccagaaatcagaaaaccgggcaaaaaacagccaaattaaagaagcgaatcatgaatcgattcagctacatttatgcttcctttctttaattttcagtggtatttttttagaaatactcttaggaataagatatgtgtgcatgtgctcatagctaggggcggtggggtgtgcaggtatgtgaccgtctatgtgtctgtgactaatagtataggtcttattaaatgaaatgttgtcattattttgtatgatgtggctatgttgagtttgtgatccaaaatctggataaggggctaagttggcgagcgaaactaaggagaccatgttgagtagaagtgttgtctttaatgaatctgaaatgtattatgctaaccattcatctaatgctcaacagtcaggtccacataaaataagtcttcaggtggagaacttagatatggatgaccatatatttcaggatgctgttattccggatccacaggttcatgatatttaacccatcatcgatgattctttgtctactgagcattcttctcctgttgtgcagcaaccacaacagtctgttgtagttgagagcgccaaaagaga

SEQ ID NO: 1180 - DNA, 1596 bp, Zea mays
  misc_feature (1)..(100): optimal_loci_322626_G1, chr9:146708798..146710393, Cluster 7
tatactgtgtgtgtactattgtcgttgagccgacactgttaattgggacgagggagatagctatctctacggcacaggcgaggcgaccaatagtgatcgtcgtaccgtacgtgctgggagctgggtgggagtgagaactctcagatcacaacaaagctaggctagctaggccttctttccccgcgcgcgagagaaagggacgcacatggacagatgtatcgagagagcgcgggacatcaaagagagcccgtcgtcgtcgtctaggtctgtgtccggtgggggttggcgactgatgcgaccccgcgtggtgatgtgatgcatcctcagtttcctctccaggaaaaaagcgcccttcgtccccagcttacccccgtggtataaggcgccgcagcagcagtcagcagaggcatccgatcccattccatccatccgatgcgtcacctttttactcgctccgccgatcatcccacgtttagctgcttaggccgctacggcggctagctaagttaagctaagccctctatcatctatctactgccggccggccggcgatggagcaaattacgtacaattacatgcataccctgcctcaaacacctcaaacaaagccattcatacatgcactactagctagctagagtcctagctagtatagtaggcatgcagcagctctaccccggccggtcatagcgagtgcactgaccatcatactacgcccccgcgcgcggccgccctatctatcagattcataatgcccagcagctcagctgctggccggccggccgggctttaaagctagctagcgatcgcatgcatgccggtttagggtaggaggagaggaggaagattctaggatatcttgtcacttcacatgtacaccacctttggtttggtcgctagctgcgtgctctggtgccccgccggccgcggccagggcatgttttttttcccgggatgtgtagccatccgcgcgcgtgtctgaaccaaactgcatgtccggcggacgcagcatgacctagaggctagcgcccccttactatagcctctgctgctgctgctgcgctgcggttgctcacgcagccggtactcgcccagcagtggcgacactgttgggggcggacgggcatgctcgtcgtcagcgctcagccgccccgccggccgcatgtgtccatgtgcgcagaccattgatttgatttggacgccggccgaggagatatcatcatatgatcgatctgtggtgcccggagacatttgtagcgtaatactatagtactactactacctgatcgacaatacggagcaggcggggctcatgcagagagctcatcgatcacacgcccttcctcggtcctcagtcacacatcacggtttattattgttctgggctctcaagtcctaaccacagcggctattgatccccacgctggacggtgcatatgtcagctgcaaaccgcgtgcatagtgatcgatcaatcgagtcccttggattcttggaacaatgccttcgaagtaggtcggcctgcatgcgttaatagctgtatgacggccaatatgtctaggtaaaaaaaatcagaataataaccatcttcatagcac

SEQ ID NO: 1181 - DNA, 1471 bp, Zea mays
  misc_feature (1)..(100): optimal_loci_323064_G1, chr9:148774567..148776037, Cluster 7
tgagacgagagggggaaaatcactctgtgtaataccgtttcttccactgatcgagcagcactttgagacgaggaaaatcgtagcgcatttgaacggtgctagccccccatttttttactcaaaagtctgctgctgaagcagagtgtgtactgtacgtacgtcctgtagatcatcctgtgcatgcatgcagatcgcagaagcatgtcatcaaacaggccgtgccaaaggccttaattagggaagcaagcaagtagcaagcctacaacggcgatcaatgcgaggcggccgtgtgcgctcggctcgacgcgcgtggtcacaagctccgggtcggtctccctggccacttccccctgttggtgttcgcgaccaagaagagctcgtgacgaggaacgaagaaccgtgcggttttatgcgtgcgtcgtcctgaacctctgaccccgccgcccgcgacatgagcatgcattactctggaaagctggcagaggcccaagctctctttgactccgagcttgacatggcacgaggcacgtacgggcatgcagcagcagcggctggccatgctactagccggccatgcatggagtaaaattcatcgcgctccgtttgtcaccgcgcgcacggcagtggcgccgcgtttacggggcgtcgcacgtgagggctgccgtggatgtggatggatgcatatgcatctaattaaatcaccctagggctttgcgtttgtgctgggaatctctcctctgttgctgtatgcctgcctgtatctgtatgcttccgcgacatatgcggccgccacagctgccgcctcgccagcgtgcgtgccgtgttgctaatttttttattcatcatcgccggcgtcatcggtttagcgtttggaaggattagcgcgcgccgaagagtcaactgattagcgcagtcccagcgcgacactgctatcagttttcatagcgctagcctgtttctagtgctgattttatttgagttccatcttatcgggtgtcataataattagggatacctactagattataattagggataccgttagcctgtttttgacgaacgccctttgtatatagtggttaggtacgtagattgagatactgatatatacatcctaccctagatctaggagtacatatataaatatattctgtgctgtgctgtgctgtactccctgacatattggctatatatgttgagctgacgacgacaattcaagttgtggagctcagtgtggatcagtgctatttgcgcgtaacaaaaataatatgtgtggctgcatctacttgtgtcgtacctgttgttgttcttgcatgcatgcatgcatgacatgcaactgcatcagagagcctgttcacggttaattagggtcggagcgaggagtgcacgtacattctggcctcccggaatggaggcatgcaacgtagcgtagtatgcaaaagctgctcacgctggcttgctttccctgcac

SEQ ID NO: 1182 - DNA, 2234 bp, Zea mays
  misc_feature (1)..(100): optimal_loci_323236_G1, chr9:149756206..149758439, Cluster 7
tttaaactgttttttcgctccaaaaaaaaacgttgttaaaccgctcgtatgaaccgtttttttattttacaagaaaataaattaaaaataacaggatttatatgcaatttgctcaattcacgttgcatagtaaatactaattcatccatacaatatgttttcaacaaaatgacatacaccatacatatgcaacgacaaacttcaattctcacgcaacatacattcatcggtcagcgctatactcaaatacaagttcttttagagttcttccacgaggccacgacacatatgtcaacttgtttcacattacttacatatttagctcgagttatagcgaaagcactcaagcatgttgaaaggatcgtgatatgagtccattccgtagacatagtcatatacaaaatatatgagatacgttagatagaaaaaaagaacgacaaataaatacttatcgacgaaccaaaaaataacacaccggtctgcttgtagttacatgtgcaggcacctggataacaacatagaatggttgaacatatgtgtcatgtggtactagtggatacatatttcacaatttcaatatgacgatggagacggaatttaatcatacacatacataatcgatggtggtatttcggctggtggtccccctgacccggttgccattaccatgcataagggttcaagattgggtcgtgttcagacagatagttagaacttgagctacttgagctacgaattccatcttggaaatgaaattgaacgacgtcgaccacttattgtctcgtgttgtgaatgaggtgcatcattgtaaggatcttgtgtgccatggatgaattgacttcctctagtgagcatacacatttaacaataactaatccataaactattgagcattcatatttaacaataactaaaccatgatatatttaacaataactaatctataaatcataagccatcaacttatgtaacgatactaacatataacatatataaatatgaaacatattgttgatactaaatctaaaaccctaaacaccacagaactaaacctgggcaataaataatattataaaactaaatgtgggtactaaacatggtttaccggaactaaaacatggtttacctgcttcaaacgtggtaaaccaccggcttctgaggataaatcaacaggattactgacgagttcatacatttcctattcttaataggctaaactgatttaaatttagatatcttgtatacaaaattactcactagaacatgtagattttttttttaaatccgagagagagagagaagagcatgtgaccctgatgctcgtgcagccccggccgggaaggaatcttccatctactgcatccaaatatcaaagctccgggtgagatgaaacgcagtgtcggtgccagcgcgtcttttgtcgaaacatcagcagacggaggatgcatttcgctttgctttatggacggaaaagagagagaggaaaaggaaagtggcttcgtatttgtgggagctagattgcgaagaacatattctgtaacaaccgagaccagtcaacggtggcttctggtgtctctgggcgagctgatttgattgtattgaaccgagctaaaaaaaaatttgcatggctcctgaacatgcatgcgtggtactcgagaattttcttccctgaatcttgctcatgttctcatgaatcaacaaatgccgcagatatttatttatttatttattttccctgaaaacaagcaggggagcgcgtcattgcctcatcagtgaagcactactgtacgttgctgatgagcagctcacccagcgcatctctttcaagtttttactaacaagcagtggagtgtttgcactgctcccgcctctcccggggtccgggacatgagcatgcacatgccatgccaatcccacgagttgcgagctgctcccgtctgttccagtccagcggccaatcgtcgggctcggaggagaggacaactcatgcaggggacatctggtccgccccgaccgaccaatccagtcgcggtctcctcggcgaacatgcacggcacagcagcactagccaggcagccgccatcgctgtcgtccaatcaaattaagcggcagaggttgccgaggcctggctccgttccgttccgtggcacggagcaatgcggccgtgctcgtgctcctgctcgcggttcaccaatcatggtgcatgtgtagtgtagacaagacagccaactagt

SEQ ID NO: 1183 - DNA, 2576 bp, Zea mays
  misc_feature (1)..(100): optimal_loci_323580_G1, chr9:151136784..151139359, Cluster 7
acgtgtgggagctcgtgtcaagactcaagaggcaagcgtgcaaacgaccggaaataggagtgaacggagaacgaaaaagaaaaggcgagagtgacctgaaaaggataggcttttaatgcctgcttagaccgagagctagctgctgaaatccggggagtgtagtgtgactgtgtgtgtgagaggagagagcgcttgcactgtggcagagagaggaagaagcaactttactagtagtaatttgctagtaggagtaggggcgactccgcgactgggttgtttgttccgaaagggatgggagggaacgcgtattaatacggagagggactgtcactgaggcgcgacgagagggcccaccgctgagtgaagttcggcccgcccaggacgaagaagtggacacgagctgccctggcccggcccatgggctccacgtacaaggcctaaaagggatgtgacagtggtaccgtaccagcagacacgtccacgtccttgtaacggccaacatgcaacgtcaatgttgattttgtccctatgtaaaatataagatttgtattgtagaatgacgctatttctttaaaatatatgcagtacatcgtgtaaaaaataaaatagatgataagaaataggataaggtagctgagggagacaccttagtaccttactacgggatagtcttagcatgactactgcccggcttcctacaaagccaacacaattaaccaaatattatgaaggcattgtacaactgattatttaggtatctacattaatcaggttagaatatctcatgcatctgtttagagcaactctaaaaacctagctaaaactaatagtattcgggtttgttggggcaacgagttgagctactctggctcgcgagctgcacaaaattaatgatggatataatgaggtgagcaagaaccgatcacaaagaaaaaaaaaacagtgcgacatcagaccgtgtatactaacctttgggctttggcgcaatgaaactgacggcaagtgttgactttggagcggcggatgcaagggccagaccagcttgcattgtgtgatgaacgcaacggacggcagcagtagtggcaccctctgaatctctgcagatggtgggcgaaggcgacgacgaagacggagtagctagcttttggcagttggtccggacagggagaaggacgtgcatgcgtcctgtgtagggacgggacctgagatcgcgtgatctctgggatcgccccgtttgagggcggtgcacgcggcgtggtcctaacttcatccacgagatcttttcttatgacaccggccgtataggggcccacgtacatttggtttgcgcaccgatcgatggggacgatgcatggagtacgtacgtacgttgtcatcatctcatgcatgcatgctgtatgaaaaagctgaccgcgcacagccgggcaggcagcaacgcaacgtcgtacactcgtactacgtgctcctgcctgattgcagtggccgccggggacgcatatgcacgtcgatcttcccatgcatgtcatatcagagcctagagcgggcctgctggtgctggctgctgctgcaaagtgggactgggaggtggtttaatcgctgtgtgcgatccctgcgccggcggccccgcgtgtctccggcctgcatgcaatgcatgcagccagcagcctggcgggcggggaccgtggtcggcggcaacaacacgaacacacggagccaagtcttgccctgccgaccgccgtgcgcgcgccggttcccctgtcagattcagatgcctccatggacatgtgacggatcggaggctgtgcaccacttgtggcatgtcctgtcgatcgaccgatatactagctagctagctactctctccatgcatgcagcatgctctcctaccgaccgaacggtgtgtctccgtgtctgatgaggctgtgggtgtgttttctgtggtattttcgtcgctgcaggcatcggtagtaggcaacggaaatgaaaaccaatccctgtcagtaaagtaaacctactgcccctgcgccctgacagcttcacatgcccagcagaaggcagaagcgccggcccatgggcgacgaaaaggctcggaggttcgtcaatgattgcgccatgatgatgctgatcgtgggtacagtacagggccgctgccagtccgtgtgtccgcgctctgccaagtgccaagtgcccagtgcccagcccatcatctctcagctcgcctgaagcgcgaggaggaggcaacggaacggaccggtctcatccgtgcttcttgactgtttggctgctcgccatccagctgtaccagcaccagcagcaggacagcgtcgaaggtactcgattcgcagtctgaccgatgcacagcgcatgtgcccatttttctacctcctggacaacaacattcataaagcgcggctcacgttcacggccggcaaccatagtttgtcttgtcttgaacaaggccgggtggcagtgcgatttgctcctgtcgtctgaaacaacaacgagccagaccctggaacttgcattgccggtggatgcaaagaccaagacctagaggctagaccctagcaactagc

SEQ ID NO: 1184 - DNA, 1462 bp, Zea mays
  misc_feature (1)..(100): optimal_loci_325196_G1, chr10:4000171..4001632, Cluster 7
gcacgaatatagacagccaatcaagagatggaacacataccactcatttgaaaaattcgtggacgcctacacgcgtatacctcatggatgaaccgacgacaagcaagccctagcagatttggtacctgcatgcaagaacagtaggtccatgaataaaacacttgcaccgcttttacaaaaagacaacttgtaccccagtgcactactatagaataggatgtgcacaaagtgacaccaagggtacagtaagtagatcctttccacgccattcggaatggacgagatagctaaaaccaaaaggtagtctagattattgctgcaaaacgtgtacaccctggtggaaaatagatgctttattatttccaggatgcactgaagcagaaaatggtcatccagtggctagtttcatactgccatccatgcatccacatcaaatagggaccggaccgtccattcaagtcaagttgatcaacaggagcagggcatccattcagttcggtttgatgctcataacatccttcacaaaagcagtggaagtattacaagaactagtggttcgggtgtttcatctttcaataactaattagtatgataaatgatttaaggacgaggtagagaatttaaaccaatctaaccgtttcatatgcaccatgtgaactatatccccaatccaaacaatgtaataagtaaagcctgcgcctgtacaagagttcgcaactccacccaggtatgtcaaaaaaaacaatagtactggccttgtcagaaaacaaccctttactagctcagcccatcctcaactgatttcccatgctcgcgacctccacagggcagcgcagtatgggcttcctcttgcaccatccttgggataccgtggaattagtctgaccaatatagcttaaataagtataatgcggcagtttgttcttgctgtccagcatgttcgtgcactccatattttgatattgatgtaaatcctgcaaagtagacagaacactcgaatcacagccaagtccttttcaagtccacagttgcatgtttaatgtagtgaagcagcaccaaggtttgatcaacagagtagagatgatcgttattcctatcaggtgttttgttaataaaatgggaaggagttgctttcaaaactcggtccggcagggtaaggccacccaggttccccgtgggggcaaggctccgcggggatccaacctgttcggagcgggttcggggacggtttctctgccccgaaaattaatggggcggagacggagaagaaactacccccacagggctgattggggaccaataagaaaccctaatgtgtatgtgtattatgtgatttgtgagagtgtcagataagttgaaataattgtgacttgtgagttatgatttgtaatataaggttgttacttgttagttgttttagacttttttattttgttgtattttgataattaatatatttgtt

SEQ ID NO: 1185 - DNA, 1515 bp, Zea mays
  misc_feature (1)..(100): optimal_loci_325313_G1, chr10:4435583..4437097, Cluster 7
cagagagaagcaaaaactaaacaaggacaaaaaaacaaggaataaatggcaaaaaagcaagacgatccataagtatatattttatatttttaatctccgtcgccattctatcgcgctaagtggtaagatattcacgttaacattcattagcacaatccactaccatatacaattatatttttacttaaactatttacaggactaagaaccattactcactaacagcgacaaacgaaaagacatactacagtgatagatctaaagctctttttgctgctgatcatctgcatgagtacatgttttaccagctgtctgtcgatgaccttgcacccttagcgtatcctcgcagttccaacccatacagatgaactttatgtcatcaatatcgagtaaactatttagaacagacagctttatgtcatcggatgagctttatgttagttaagtttccagttcagttttttcagttcggcagtcagagcatggctacgacccttcagtcagttttggtcatgcgcggcgttgtaagctctgatatgtgcacgttcgcatcctgagcaagttggtaaccggtaggaaggttcggatacctcgacgtgttgggtggcgaacgatttagacgggcgatcgaaactgctgctacgtattcgttttggttttcttcagcaatacagagtctgagaatggtgcccagtttttgcagcacaacctgacggacgttcagtcagtttttttttgtacggtatttcctaattagcacgattaaaattgctcgatgtaacaactgatttgagcaatgactaatctgctgctcgtcagccaacgcagcacactctccatcctcctaaattcagctgaccaccattctatatcacgtgcatagagcttttggatctagcgtctgaatttatttacaaaaccagctgggtagaatttaatggtgttggtgggtaatatggcggtagatgttacacgggggatcactatattgaagtaaatttgcaacattattcatgcgttgtgtaaaactggacgtgggtatactttggccatgagattcgggtccaagtgaaaactttgaatctagacccaccactgcagatatgaatctcttaaagcttagatccccattcaaaacctagctagaacacattactcaaacagtcgaattgcttaccagaacgagctgcacattacaagttggcattgcttcagatagccacacggtgacgacactagctaggtaactcacaagcgcaggaccacaagttgttgcatgattcatctttgcattatgtgtctgtatgcaagacatgcatcacagatgaatgaagccacagccttggatagatgaggagtggacgtcgtgcaaagtagatgtacatgtaccacatgcatcatgggatgaatcgtgccgccttttcggacaagattcattgtgctactgtattcgtgtgaaagaaacatgcatgattggatcataagcagatggaagaaaacatctccctgtagtca

SEQ ID NO: 1186 - DNA, 1574 bp, Zea mays
  misc_feature (1)..(100): optimal_loci_3279_G1, chr1:17002863..17004436, Cluster 7
actgattggctcccttgagttgtttgtcattttttaggtccgtaataaccaaataaataaaagtaatcatgtattgaaagtgaccaacaagggaaaagaaccttcctaaatacaacatgcttgaaatgattgtttactctagagcgacacaaaccacgcacatggccaaatgcatagaaatggacccaaaacacaattattacataaatggtaaaacatctataggaacatcccaaatctaatctacaacatgtatcatgttggtgaccctagaaacatccgttgttgtaagtcgatgatcatgaacgtgaatatggatcaggacctccaaaagaagaccatccagaataaataatgtgactaaacgtgtaaggtagggtgccagatgtgtatcgacctcctgagttgccacatgcacatcatgtagcttgcatgtcgtggagtgtagtaactaatcaataaatactcatctagcggtgtaaaatcaatctaataacataaacctcaatggcaaaaatagattgaaactacacaagataactaacagatcttgtcaacaacaacacttagtacaagatctactagggtaaggtgataacattgtactaccctgacacaacctaatagggatcatgtcagtgcagcatgccacttgaaaaccattatgaaaagggtggtgatgtgccaatgagatgagaagcatgcactgcttagatgaatgaatgccttctcattattatgatcataaattgttatattttaaaatctatggacttaaagtggtaatcaccttttaatctatcctaatgcatatctaagatacatgactcgtagggcctatccttctatctagactgaatacctcctaccattgaggccatcgactagaaaagtttgcaccaatcctattaggatttggtgtcaacacatgcccccttattttagtagaatatttttatttagaaactaaatctttgccttgtggaaaatttacaccttgttggcggtcaagcgtacttttgtgtcagccaactctgcattacacaagctctcctcaatacttggaccctggcacttccacttccaacagtccgctttctccaagtagtattagtgtgcatatgattctttctaggcagagcaaacccatcgcagatcatggtgtcctcttcttcttcttcttcctctgttgggagcagtttctcctcttcctccctcgatctctcctttggttcctcttcttcatgctccattcatctgactccacaccattgccttgtctcccccttgtcgaggacccctaggactatatctaggataccaaccccaacctatatgactatacttagatagtggttgacgagcgagtatgatgaggatatcactggtcgatggtctatcccccctcattcctcaagaatcggatgatgactagagttaggatgccatctacaaggcctccgaggacaaggtcatctcctcataagaggaggaggaggtgaagtggtggcgaagtagcaacaacaaggagtctgagaagtgtattttacatgtcattttatttttacatgtct

SEQ ID NO: 1187 - DNA, 1637 bp, Zea mays
  misc_feature (1)..(100): optimal_loci_33891_G1, chr1:206878484..206880120, Cluster 7
tcccctacgagtggggtcgttgctccatagataataagtcgtgaaaaccactcaagctcctattagggcttgtttggaagcaagtgtaatggagggattgaggaggctagaatccttactattcaaaattgaataaaaaggaattctagactcctcaatctcctccattccacttgctcccaaacaagtgcttagtgtattgttaccccatagatgggtcgtgcaaaccacgcgtaagcatggctttatgtatgacttcacaaaaatatgataaggttggggttgatgggtcttaggcactctactcacttgctatataaaagggagaaatatagtaacatgtgggggcgatgacattcctgctagaaaatctccccatagggtcaggatctagaaactctcatagatggttcattcaacataaagcgtaggcatagaggtggattaagaaaattaggctaaaactcttaggagaaccaaaaggtgagagggagttaggaggtcttgatgttcagttgtgtttgaacttataatcttattcgtatttgtgttcaccaatcgatgagtagcaggaggacaaaggacaatatacacactgtagcccaaacctctctaactgcccacatgctagctcccagtaatacctaggctcaacatacaagtaatctaagccccgctctctctcctttttagtacttttcatagcctagtgttgttttgcaacgacatttcacacgccagatagggaaggcaccttttctctttgaaattttcatgttttgttgtgtagtatgactgtggcaacactaacatgattgctggttacagaagctgcttctaacacctactctaacaacttagactatggaccacatcaccgtagtgttgaaatctcatgtagtcttctccactgtcgcctctagccaacagacatgccttagttgggttgcacgatgtggtccccataggctagggtttagtttgtgccctagctaggtgtgtaattcctaggttcattacatcatatgccccaatgggccctagaggagtctgaccactctacacatgtcactcctccaacctcacattaggactaaggcgaggcaatctccaagcatgaggatttctctttgcactagtcatctctatgggctcatctgtgcctcaactttagtgttagtgatgttatttgccctctcgatgttgcagaggaactcctttgcaacccactagcgtcagacatcggtgttgaaaacctattgaaattccaaaagaacaacaatagggcaacacagttaatttgttagttcccttctttggagggggattgaggaaggatattttacccttagcatatggtttgtaaacacgtttaatggttcttacttcatctcctctaaatattcttacatgaaacaatgacctttgagtcaaacggtagtatgaggacaaacaattgccataggacaaagtaaggattggaaatgcatgtgcgaacagagaagtccatacatgggtaggcatgagaactctatcaatatatttataccttttaaatctctcttttgactcaagcaaatggcatgcatgagttcccgaaatggttatgactctagagtatctaaggtaccagtaat

SEQ ID NO: 1188 - DNA, 2153 bp, Zea mays
  misc_feature (1)..(100): optimal_loci_338978_G1, chr10:87399947..87402099, Cluster 7
ctctaccccttaaacccaccagtctaaactaaactacgtacaccccacaaatcatcccacacactcatgtctctactaaagccagcaaacaatttaaccccagataaatcccaatataaaaaaccaacggtccagatcattttatttgtctattctctcttactcaaacacatctgacggacattctttaatgaatcatgcttcaacgctactcatcaaacatctacgtgcctccctccccacgaaatcctcttccccaaactacctccgctgctctccttaacttgatccccaattctctctccttgatccctgcacggcgacttgcttgggaggaaaatgaaacatgtgcgagcccggctgtgtctgccatcttgaattgcccttgctgcaaacaagctcacatgacaataagaggcacggcttaatgcaaccacatgggagcgagacgcccccatttccttcatcctaggtcgttgccaccatgaatgttgttcctgctctacagacagatctcccagcgcgtcgtccatccatcctctattcctcgtttcctgttcatgctttcgttcttggatgggtgccaacgccatgctcctctgccccctcattctctcgcggactccaaccgtgtcctcctgcccgctccccctgacagcatacgcggcgtgggcacccgaagcgcttcaatggctctccctcggaggcccggccgcggggagatcttccccattttattaatcagtgttttaactatgaaattaattcttttttatataattaatgcataaaatgtgtattacggtactacaaatacgatgatattttttaaaaactccaaaaactgattttttttgcaactaccactgctctgatccatccacccctgcgagctactagctctcgtcccctgcgcactcacaagagaggtcggccggtagaccagacggcaagcggtcagctcggcgaccgtcgtggagcgggaggatcaggcgctgctctcgacggagatcgtgaactgcggcgtggagccgtccggcggcccggacgctggctcgccgacctagctactcggtgcgcgtgctccaccgcctgccggacatcatgcagtcggtcaacctcaagtacgtacgtgtgccttgggtaccactacctcaccaggcacggcgtgtacctggccaccgtccctgtcgtcatgctcgtgtgcggcgccgaggtgggcagcctcagccacgacgagctgtggcgtaaggtcgatcgggactcgggagaggccacctgcgcgatcgacctcgccagtcgccaccgtgctcgccttcctcgccggcctcgccttgaccatctctgtctacatcatgtccaggcccaggcccgtctaccgcattgacttcacctgctacaagccgaccgacgagctcaaggtgcgtgcatgtgcatcatcagcacaaggtttatgtgaactcctactgctcaccacacatttgatagccatacaccatgcttcttagcgcatcatgtattcatgcatgtacaaggatcttgggatacatatttttattttcagcaaataattatatatggttagaaagtgtgattattcatcagaccaaaaagtgtttcattcgtgtgatcatcattttactaacaaaaagtagtctatatctaaatttggtcgagaccctcgccttcgtgcaaaagccagatatcaacatgttggcaaaattattagaatgttggtctgacatggagtacaatgtttcagattgcaaacaagtaagctatactccttcatcatttttgtaatcttgttttttctcttacttgaactatttgtttaacttgcatattctattgcccgattctttcatgggtcacttcaccttatatatacttaacatggacactacaatcatctatataatagacttcatgcctatactatcatggtttaagggtaatcatcccagcatgcattatatccataaaatacattatattgctaataatatgaatgctgtcatggaattggccaatcctacatggaaaaacgatatttatatgtggtgtcgtatagtaccaacatgggttccaagaacattaaactggtaattttttataacccgaacaacttattatttttgtctacatatatg

SEQ ID NO: 1189 - DNA, 1415 bp, Zea mays
  misc_feature (1)..(100): optimal_loci_344419_G1, chr10:117728239..117729653, Cluster 7
atctatgaattcttcctacgataaaaaaacgagccttcttatatatggcacatctagcaaacgtcccctttatggagaaaaaagcatcaacctagactatgcgtggattaagacatgtcatattctcacagtgattgttcttattttctttaaactctatttatttcttcttactgcgccacatctagcattctcaatgtctaagtgtgtgatgaactctcaaatctagtaggcatcttctgctaagacgatcatagaagccaagcagcgcataaaaatggtagaaatgagaggcatcaagaaacatctcactaaattctcactttctgccgatggactagcgaactcgtcttttcctaatactgccattcctatggctcaaacagattcttttctttctctttttgactctcgtcattagcgcctctgtctaaatatgtgcattgggatattatttgaaatcaatgaagcaaaaggaagaggaaggagcacctaagaaccataggaatgagaggcatcaggaacacgacagtgcacatgtcctccgtgcgagacgagaaattcagagcactcgcgttccttcatgttctcatccctactgcccttaggacctctctttcttcctcttccgtgctcacaaattctcaatggcgaggagctcttgccatggaaccaccctcatcatcaggtgtgcatatatatagcgacctttggagtgcctggctttgtgagtaatggaagcacgccaaacaatagggtggtgtactgtacgggcaatgaagaacatatgcaacgaatcatagtggggccctgtaaactatagcaattggttaatgtcctgtatggacaatgaagagttgatgcacggagcccagatgctaaacttcaggctgtgccatatctgatggcactatggcagacatgcatgttggccaattaaagtgagatttgtttttgataagttttgacctgagttgttgaattcacaaaaatggagtggggagaaaaaggagccttcaacttcaattgcatttacttggattcatcaataaagagagcatgaacgattccaacaaaaaaagatttttttttaaatatgtttaagatcttgcttcttgcttttccataaaaaatgttgttgcccagactcgtgagtctcgtgacggaaatttaaggtaccaaagtgaagaaattaaaacagcaggtaaagcaaaacttagtacttccttcgtcttaaataacaaattatttcaattctttaaacaattcaaaagcatcttaaatttaactaaattcatacaataaaataataataattgtgataacaaataaatgctattagattttttattaattatattttatagtatacctatttgatattataaatctatatatttaaaaatagtcaaatt

SEQ ID NO: 1190 - DNA, 2289 bp, Zea mays
  misc_feature (1)..(100): optimal_loci_344662_G1, chr10:119131667..119133955, Cluster 7
aaattcaacaacctcgacatcagaaaggaaccccgtctcagcttgcttcttgtggcacttgcttgctgcccctggccggtataaccctcgtgtgtctggtgaaacgtacgtgccatgaaaacttgtgtctacaggctccaggttctaggccccggcatccgttttaaacttgcccgtttggaagtgtcaatggatgcatgcttcaggtatccgttctgttagtcaagacaggaagctacccagagcctttttacggctgttatccccctccctctacaaatacaagggattataagagttgtatgatatataatattgtcgttgcgttgcgagttgcgacaccacagtagatcaaaagtacgcgagaaaatcagagaggaagagacgaacatagacctgccaccgtactggatcaggatattaacattactatgcatggggttgtttggtttgtagggacccctatacacacatgcgcgatgaggatttacagaggttcagttcgtttgagcctgagttcctacgtcctctgtatgagtgacatttagatgtaagtgtgtaggcatagttgacatatgtgcggtgtgtctaagctaccaagtatgaagagcaccagctaccccttgtgatacatattgttgagccgagcgatcgagggagctcacgctcaaacgatagctttttctatgtgctagctcgttgaggaagtgaagttcagaaaggtgaaggctacaaaacccaagaggggaaaagcactttttattctgctctacaccttactgttatagcataagagagaagagagttatatctctctataggcacgggatcctacccataaacatgtgcaactactcctaccttgtcatagttattgtaccatatgctaagcacctctaacatgccacaacatcaattatgacatgccgtaatggagggtataggtacctatgtctccgagtactctgtagttgataaccgctgaaggtgcatatactatatagtgttcatggatatatacacctatgatctgaggcggggctataatgatgcttttggccgctatgtcacttttgcaataaatagatggacaaattccatatttaactgctcgacgccatgtgtggttatcctgatcatgggagcatgtagtgttggggccatatcattcggagccatcctgccctgagggcgtcttgaggagtgctggaggaatcccatgcaaggcccccgtattatcggaccctagggctaaccgccatgggacttgggcctctatgcgtagggccccaaaaatataggttggagttgagtgaggctctatgggtctgccttctgctaatgaagtcatataggttgttttgacaccatatgggggtatgcctttcctagaataaagctaacagtggtacttgggcccaccataagcccaagaaggtccataggtgacaccaattttcctgcaaacatctaacaaaacaatataatatgtgtgcaggtaatctgcttgcttcaaccatcctggccagcagtgaatgtgtcaaatagtagtcatatcgcttgactatcaaattacaagggtcatgtgatgctttaggtgttgtgcctgatcgttgcatgaaagggagagaaagccaccttaaattttgggcatgtggttccatcttccttttgctttaatacttcgcacaatctattgcacacatgtcaacaagctcccttatctaccccatagtcgacacgaaccaaccatactcgactcatcccctcattcttttcaacaccatgcaaactcccttcccattgtacttgataccgagctcgcaaatcttgaaccaagaggagttggacaaggtgtgcggctcctcaattagaccttgccactagcccccaacaatttgtgggttgtgatgatcccacttcaaatgccttgagatgtttggggagtatatcttcatctagtccttcacgatggttgggataaacttctcactattgtgattcttccttcgtatcttggagtcctatgccttttagattaggcacctcactcgcaactccatcatcaccttgttgaccttcgcctacctgtgtgaggcattcatggggtgaggccctccatgacattgttccaaaacttcttcatcctttaggtgttgagtagttagaacttgttaagagtatactacgttcaactttgctcaagactgagcctcgaacaccatacatctcactcaacttcactagcaagtgggagcattggagggagatgtggtgtacctcattata

SEQ ID NO: 1191 - DNA, 1680 bp, Zea mays
  misc_feature (1)..(100): optimal_loci_34516_G1, chr1:210078433..210080112, Cluster 7
atgtgccctggcgatgtaaatttgatcaaattgggcactcttcgctagtggatagattgcatgcgttctcctttcccaacgcattaagcatgccgagttacccgccgatgatgtagatactagatagaatatgaaaaggaggagccgtagtggggttggtagcagccacaggaaaattggagccacgcgacacgagcttgactcaatgccccaattagggacgggcacagttgggcaaggcgaacaaccccgagcacccagtccaggcacctgcccaccgaactaggaatcactcctgctgctacagtagtatccaaactaggcggtgacggtgatcgtgagcactgggcgctggcgcctgacgtctcccggcccccagctcggtcaaaacgctcaccaaccgtccccattccccaacccaagtcgcactcgcacaccggccgcttcgttcctatagacatatggtccgttgaccgtcaattccgcaacggtaggtggaaaatttgctggaggaggtgtcttcccctggattgcccgatctaatttagtagtggctaaagttaggattaaggatctaagtttgcaggatagagaaaaccaaggctttcgagctaaagctcagacaaaccaaggctttcgagctaaagctcttgtctgaggtctctcccattcacttctaaacctaatcgcataagagaaaatgactaaaaactcaagtgattgtatggtcttcgatgaaagagagaacttgaaggatggggctagcttccatcctgtgctgtcagcaccgatttatttagaatcggtacaaaataaaactttcgtacaggttttaactgtcgtatcatcgtagaagacatatcagtaccggttggtatcttcaataggtaataattaatgaacattagtaatagttacaaacactaaccgttactaatgtttcccttcataacccctctcctacctccagctagcgtcaagaacagagcggagatatgttcatgatgccataatcttcaatgggagaaggcactgtctaatgtttttccaaaaaaattgttgaagatttcattcatttatgtgtgagaataggttagaaagttcatcctctcatatagtatggttgcaatacttacttgctttgtttatatttcttgattgtatggttcattatataatttagagagagagagagagagaatagtgagttcatcctctcatatgtcttgcaatgtgtatgaaggtaatatagtttagaaaaaatcataatagtaaaaaatgatgcaattaagtttttaaaactaagtttataaaagggtaagatttagaaagggcaagaagaccatggtgccaagactaaatcattgaaatgacaatcttgtattccatatggtagagaacttaagcatggtctttagaaagggatctggtggccaacctaccccaagtgaagatagaaaggcaccaatgtccaatgctgaagaagaagttaatattttggcacctacctttctggaaagtatcagatgtccgccatgcaatcaacatgatgcatctcacaaagaatatttacattaacatacttggtttcttaggcacatataggaaggacaaagatgcactagaatcacagaaagacttgaaagctacaaaacaacaagaggacctgcaccattatac

SEQ ID NO: 1192 - DNA, 2173 bp, Zea mays
  misc_feature (1)..(100): optimal_loci_345436_G1, chr10:123846279..123848451, Cluster 7
gacttaggctaaactttagcagaagcaaccaaacacacccttaaatacacgccgttcatgagaggtcagcagggcagtgcaataaattcgatgcgcagtgagtcagtggaggccctttcgcgaagaggaccctcgacgtggtgcacgaacccgaagccttggatcgcttcgataagaagggcctggagtatgtttttttcttaaagtgtaaagtgtgctgctgtggactttgctattcagtccaggtttttttgggtgcggccgttgagtaagaaaaaaaaaactatattcccaaacatgccctcaaagagacccttaaagtgtaacgcaatattttgtgtgcagtgaaaatatcaacggtacaacaaacgacattttgatacactctcgtacatgcatttattagaaaaaaaagattttctcatgtatagcactcgctggagattctccctgagagatatacagtaattgttactactactactacatagtttaacatttttttcttcttttgtcgtgatattggaaggagcatatatatatatatatatatatatagcaccagcaatgaattagtgatatctgaagatctttacaatatactagtcaacaatataaaataatgtaaaaatactcctaacaaccccctgaatgtgatttgcccactgcggcacgggaggcgcacaaggaccgcaggccgcgccagcagcggacgagaaactgagcatcccggtcatgtgactggatcctgaccagtacgtaaatcgcctccaactgtacgtaaatcgcctattgtgactggatcctgacgtcataattacgtacggccggtgaacatgtgttgacgtccaactgtacgtaaatcgcctattctgaccggatccctgagcagtacgtgacagggtacgtgtgtcacccacaagcctagcatctctgctctctagctagcatgcttcaagtatcatcggtagctcgcttggtctgtgcatgagtcgtgacatgtggctgcaggagcctggaggagaaagcatagctttatacagagagatgagatctgcaacaaagccaggtctcaagcatatccatcagacactgctaactaccgatcgcagctggattgccggccgtcttaccttagctgacttttttctttctttctttctttcttaaagacaagttcctttaatttcaaggtttaagcgaacactaatgaggtgtacgttggtttgaggaatgaactagtccatcgtcttcttactgctcactatttttgtttggtttgtggaatagaatgcgttgatccatcaccatctcattcctcatagttagttagttagcactaatatgaggaatgaagtcatcccaccaaatctgaggaatgaaactcatgatgcaccaccttaatttggatgatatggttcctcaaaccaaacactctataaatgatctttttgtccggcgacctcgcagagatcatcctcatcattatctcgcggtgcccgcagcaagctaaggaggggggctgccgagaagaaagcagcgagggggccggtggaaatgatcgatgccattgacttgggcacctctaggccattgggatttgggagccgaggtggcgtggtgaaccggatgattggctgccgcgggcatggcggtggaccggactggtggaggacggacgtgcatggcggattggcagacgatgtgtgcctttctccggagtccggactcatccgtttgacccaggacggatcgccatgatgctggcctcctggccgatgtgttgtcaagacgattggccgccgccatcgccttcatgcggtgcgggagtagtcgtcgagccatctgaccgtgaccgttggcgaagtcagaattgtacaggatctcggtgagaagagctgacaccgccgcgcggctccatgttctcatgcccccttgtttaagaaaaccagagcagagtttgttgaatggtttttccatggaggcacgtgatgcacacggaacaggcaaggccatctggggaatggctcgattggctttcgctggccgacacggcaatggcgacatggcgttgcgctgcggctgcccgtctggggcccactactttctgcttccggaatgtggcggcccaactaataatgactcgtaccattattatttagctgtatatatt

SEQ ID NO: 1193 - DNA, 1554 bp, Zea mays
  misc_feature (1)..(100): optimal_loci_34733_G1, chr1:211276642..211278195, Cluster 7
tcttttgagtttctaatgtggatatagaagcaatcaataattattttatttaattacgctaattaggattcgaactcgaggtctctgactttgatatcatattaagttacatgtaccaaagtagtagtacaaccccaaaagtttaagctgataaaaggagtggacaattcactcattataattctaacaggagaaacagtattctctaaattcaaaagatcgcaagatccaaagcgaaatggaggtatattactgaatatttgcgtccacgaagtgtttcatatgttctaccactatatactaggacgtgtaaaactaaaagaaagaacaaaaaaaatatgatcctgcaaatggggaaacaagcggttgctagtacaagcgaaacacaatatgttgcttgattcatgttatgtacaatcaaaaggaggtgtcacctgagggattttatcccatatcttagcaagatagtattaagcggcaggcgcaactgtgagaccgctcattcatttacaccataaaaaatatgttgtgagtacaagtgaagactcaagaagcgtcaaaatacagtattccgtaaccaaatcaaagcaccagaccagcaagaagtcgagcgtttgttcgagggtcaattcggacgcaagaacaccacaagaggccaaaattcacgttgtgtacaaaccatagaaaggtaaatacggattaaagagactcgttcgatgtacgcaccttcctgggggcgcctttccggagaaaaggaaggacgcattcttcttcgggagcacccgccgccgccttctccttaccccattcctccgctttcgcgacgatcgacgtagtcgagggagccttaggggacctgcgacgactccttagagtggaggacgacgcctccgagggtaggctgcggacacggagttggactcggaccgagcgacggggacggggagttaccgcgccggatggagagggcgcatccgcctcggcctctcgcggtggtgtagacgcgctcatgggtggggacggtagggagacactccgacggaccctgatcaggattgtggagcggcgttggggctgcgaggacgtcaacaaggcggtctcggaacacgcgggctgattctgatcgtcgtcttgacatggggggggggggggggggggggggcgatcaaacgagtggaacggcgccgcaccgccgggggcgcggtggaggtggtcagggcggcctgaggtgcccacatggcctttaaacttcgagcagttgctgaggagagcatcgaggcgaggtggaggcgggaagaagaagagagggaaaggaaatgccgttgcggggttggtcggtttctttcgttttgttgggcttattctgggttcgttagggtgtgcagcgatgggctacaacagtcttgggcctgctcgtttgatcaaaaactaaggcccatgtttagaacagctacaagcctacaactctatgaaatttgttgaagttggtggagtatgatattaggtgctccggaaaattatagggctgaagttgtaacttgtaagccttcagaa

SEQ ID NO: 1194 - DNA, 1861 bp, Zea mays
  misc_feature (1)..(100): optimal_loci_347406_G1, chr10:134778484..134780344, Cluster 7
ttgagccgtggggctctacgacacctgtgcgttggcctaggacacgggatggtgagatcatgaggcacaggtttgcttcgttccatgactgttccttggtcctcattatgccctgcagttcctgtacctctcatagattccccatggactgatcgacatgccgtactagccaccgcgcctgtacgacgcccgacgccaacacatgcacatttaacaccggcgagtcagtcgcgcgcggtggctaataataataacatgcaaaatcccagtccaagtactctggcattcgacggacgcccccatgtccacaactccacatgcaggagacagatcaggcacgttgacaaatcttcaggaaatgcaggcgcatcttgtcacgacccactgcactgctgctcgcctacagaagcggatcctgctgccgcgccgcggccaccgccgaagttgaccgcagcaggcgactcgagatcgcaaatggctcggctcggcgcatcatgaaattcgccagcgccaatggccgcgagcctggatgcgtgtgccacggagaatcccagggtcgcaaggggacagaaacgagacggctcacatgcgtacgaacgccctggcgcacacgcgtcgcgccggcctgcctgtggaagtccaaccccctttgtttccccgctgttttcgtttcggtggctcagccagaagaagccacctgaaacaaggcagtcagaccggcagctccctggaatttccttccccggtgagcgccccctcctctcattggagcatagtgaaggtaatgttgggtgactggtggctccatggatgctgggacgtccttggccctccaaggatctcagtgcgataaggttcttcaaacctttcgatgctctcaagaggccggttgatgtggcgggtattgatcttgacaatgctatgtggtgagctagttttgccacttcgctaaggccgtctttagatccttctagcttattgtttgacggtggtaaataatcagctagcaaaaattagccaggttatgtttgtagacttggctaatagatgtttttttctctttatacgatctattagcacctatccaatagctgatggataaacagtttgtcaaccctccgattaacaattagtcaatttatcagcccacctgtttggaggctaatgtgttaaaattagtcggcaaattgtttgccacgaggatcctaacatgccctaagttcatgtaggagttaatagctggattggtggagatgcaatggacttggaatgggtgtattttaggttgattaccccatcttttaatctttttttttaactcctaccactatatctagctctcgtcgcacgaacaggatagaatacaacattacaacgctacagctcgcttctcaattgagtagcatatgaatctcctcgtcccaatcctttacgcgcatagagagttagagcaaacctctagtatcatggactactaaatacactcgctcgtgcgtgtagagtgtagacgatcaggtttttggacaatgttttcgtgaccgttcgctaagaatcttaatcctaaagggctttcaagggacggtaatatgaacatctacactatggtccacaacttcaaacaatacatgatgtcaacttatatggatgcagtcaccaattccttgattctgttttggagtgtttggtttagagaatcaattaatctaaatgatgtgtgcatcatgagtccattccataaatttagtggaataaactcattctttatattattgctaattattagcctattaggaatgcaatggtgatggatcaacctatttcattccacaaaccaaacaaaaaagtgaggactgagaagatg

SEQ ID NO: 1195 - DNA, 1621 bp, Zea mays
  misc_feature (1)..(100): optimal_loci_347529_G1, chr10:135624844..135626464, Cluster 7
ctagcaattgtttagtcgtcgctagttgtgcgcgtcatggtccctaatcccgacaagcacgtcgccttttggccaatggcgtgaggataagcgccgcccgagaccgatcgagagcgagggctaatattagtggcgtgattaaacctagcttaatccatctcgtcgagtccgcgactgagaccaaagttaagcatgccgcagctggctgtctgtgcacccaggagcgagaggaagaagagagagagccgccgccgcactcgccgaccgacgcctccaccaggaggcgagaggccatttttgcatcggtaaagctagctactagctcatgtcggggacggaggcgagcgcgtccatacgtacgagtacgcatgcgattctgcagcaggggttctcgttctccctccagattcacacagcaataatcaacaacaagcgcaggtcatataatttggtttcgtggcactagtagtctgtgtgtgttggttggcctgtcgctgtttcaagttgaaagcaacaccgggaaagtccaacctccgggtccgatggctggtagagcccctctgcccttggacgttcgtgatttcggagatatgtcaccgagaaatgctgtcggctagcaccagctttcaacatcatccctaggcgacttgcaggttaatttcttgggaaccctaatttctcctcccttttcttttatcgatacacaaacacacatcagcttggatcggagacacagtacccacacaccacaagcaacgcccacacacacatgcatgtgttttggcaactgactacatatatgctaattaatggcggaaattcttaaagcctttttagatacacctcgatccgcaatatgaattgaggtggattgaagcgcagcttaaactaacttacactcgaataatccacctactaaacaagaccgaatgtcttttctgttgagaacaaataaatttaaccgaagcttcccggtcatcgatgcacctatgctaataagcagtatcagtcatatgcattatctaaaaaaaatatgttgtctctgtgcccttcctaattatatatgagatgtatgtcctttcctactgatacatactatatatatttgcagcccaaaggattgggagattctgtttgttcattcaccaatgatgaggatacactactacatacttaatgtagtgtcaccaagaaagtaataagttaatcagaggaatagaaaattctacgcttactctcatgtcgataacttctaattctagtttagctcttctttgccggttctttccgctggcttttttttagttgctgttacaagtaaccagcagtgcaaacaattcagccacatgactatgttcatcaattccttggattagcagctagcaccatgcatgtgttgacgtttataataaaacaccgcatgcaaaatctatctccaagtcaagtcaaatactagattattgccacgcaaaagtttgtataaccacggataacattagatatgagaagaagttacagccttatgtttcttttttattatatatattgtgtgtcgttggtgatactatctaatgagtagacgagcaccttgtttaattaatctctatactatgtgtgcaca

SEQ ID NO: 1196 - DNA, 1848 bp, Zea mays
  misc_feature (1)..(100): optimal_loci_347531_G1, chr10:135627046..135628893, Cluster 7
tatgataacaatacttaaataaatgaagtacttaaaaaggcttgttataatttattattgtttcagccaattttttaaacttcaagaaccactaatatttactcattaaatcttttttatgcatgatagtttttagtaaacaaacttaaacatcactggatgtactgtaaggcggcggctctggggtggggcagaggggtggccgtcccgggcctccagattcatagggctctgatcctagatataaattcagtagttagactatcagtgtatgatataatagtttatcaacaaagtaccaaaaagtttatggctacgacgtattcacaatccgatcttatctaaacatgttagaatcttttaaggtaatattataatatgtatctttttatttactaattgcttgatataaatgtttttagatgtatcttaagtgtttatattgataatatttatatataaaaatatttagaatgaccactattttaaatcttgtcctaagccccaaaatctcaggaccgccactggtactgtagctgctcaagatcaatgaagacgacaagcgctgccctgatcagcatgcgcaataagcaccacaaagtgatgacgggaaacgagaggaaattaagaactcgagcacatgtacgcacaactaacagacgggcggttatagtttattaggcatgcatttgggacaaccgatattaaagaagaggaaaagattctgcatatatatatagactttgtttgctcggaggcgcgtcacctaatcatgtggccatttgaagctagctagcttctgtccctcccccacacccattattatcaaaagccaatgatcgattagctcgcaattattttagggttcaacggcatctttgccagggctgcctttagctaaatggccactgaagataaacaccacacctgttcacacacacacacacctttgataagaacgacgacattggacatgaaatgtgaggcacgaacgggagggatggaaggcttaatgctgtgaaaggtgttgacctaacaagaaggagatgattgtgtgcgcgtgtgtgtacttttaattttacacggtagctagagagagaaaaaatactgaccgaccaagagttgattgtgcgcgcacagagacccggccggccccttgtcgattgataatgattgatttatcaccgctttcaactccataatttagtggtttaaataaattgttaatatgtcatgtcaaatctagctggctatatatatgtattcgcccctgtcatctccagctagatatccgacccccaactcctgccccgcacatatatagtttatacatatggtagctagatttggaccaatgcagatcgattaaaatgttatctttgtgttgtttatttacctacgggaaagtggtgtgcagtgtggggatgatggctagctcgatgcttgattctgctaacagaatatgtgaccaatgcaaatggctaactggctaagtagtactatatggtttctatatgactatatccctctctaatattactatatggttaattaatttctactcaggtcatctgtcatgctcaatccctgttccaagtaaaaaaattactagattattattactccaaagcagagcttagtttattatgttacttgatgagctatatataaattaaacatgcaacacaactacaaattattaatacatccagagtgccggacccaacaatgttacttggcatgcatctaagtgcccgtttgggagtgcttctagtcggctccggctctggctccttgccggagccctcccaaacggcgtcttaaaaacggctccatatgcagagcggg

SEQ ID NO: 1197 - DNA, 1993 bp, Zea mays
  misc_feature (1)..(100): optimal_loci_349390_G1, chr10:145105129..145107121, Cluster 7
ccccaaacttgaccgcgcgcgtcccagcagaggcagaaacgggctagctagcatgggttgcccgttgcccccagcttccagtgcgcgacgccgccgccggccgtcagcagcgtaggcgactgagaggagggggaacgtgagggtggcctgacgagcacgacacatttcgggctccttttataaccttggcatcggatcttcccatgtatggcgcggagcacgcatcgtacgtacgtaggctctgcacgcagcaacagcaacgtacggagaaaaatgtttgccgcggatcggagatccgttaccatttgtggcactactgtgctgcagtgaatatcaagtatagaacatgttgacgtgcaggatagacgatgggcatcgcatgccgcatgcagcatggagagacggtgcatgacaccacggctggaatggacgattgcgaagttgcgacccgcccggtggtccacgcctgctgcgtcgccgcctcgccggccgcgcccgcccgcgcccgccggtggcgagagctagctcacgtgagggagtagtggcttcatcgatgcggcgaaccaaggacagggtggcgacgatggcgaaactttttctgcgagcgataggcgacacaggtgccagccgcctcagcacagcgctatctcgccgttgcagccttgcaggcttgcagccttgcagattactcaagccgcttcaccgtcccatctgccatgctagcaccaccactactggagaacggggttccggtcaacaacatttgttccagttgttttaaaaccggtattaatactggagaatggggctttcgtctaacaacgtttgtctcggttgtttttaaaaccggtattgatactggtgaatgatctttctgtctaacaatgtttgtgtcggtttataaaaaccggtattgatttaatttaaagcttcagtatcagtttaaaacgtctagcacgtcaagaggatatcagtaccagttaaccaatactaatatttagttatttagaattggttcaaagacaataagtcctaatatatttagtaccggttgcttgacggaatcgttattaaatataattgtagagttcgtgcatagaaatttagtactggttgtggtcaccaaccaaccgaccacaaccggtactaaaataaaactccttcctcttcagtgcccagtcacagagatcggttagtccgcgggtactataaaacctcttcctcatgtcacaaactcacacccggttcttcgtcttccactcttcctctcctagatctcttcagcctcttctatcgttgccgcctcaatagacccagtggatgtcctcctctccatccagctttaatctcggatacagagtgacagcagtgacatgtagaaatccggtgtaggagccagttcccaaccaatattgaatgcacaatccgcagcagagagtgcactcgctcaatcagcgtgcatgttgactatgccagctgcttaacggtactggtgaaactgatctctctctctctctctctttgctttgtgttcagtagtgtctagctcttcgtcgagttgagtccaaactaaaacgtcccagagacgtctgttgtaaagacccgtgtctaatatgatatgcgtatcagaaatccgatgtaaagacctgttttttaaatgttattatgctcgattcttttagagacttttatatcgttgttttggtttaagtacccgagaatcaaacatatttttggatcttggttgcatggggtgcatcctaaagcaaaaaatctcattatcacaattgttgtagccttatgttgggttatttggataacctggattaatttagtgtttaatattatcggacaactcattggcttaggttatagagacttttgtagaagaaaacatgtcgacgaatcggagtagcatctatgcaaattttctctcgttttggttgaagttttatgaacaagattacgttttgagttttccagcctttctgtt

SEQ ID NO: 1198 - DNA, 1486 bp, Zea mays
  misc_feature (1)..(100): optimal_loci_349833_G1, chr10:147810423..147811908, Cluster 7
gtatcgtagctgcagcctgcaggcaatgtcggaggctcccagcactaggtccatgcgtgcatgtgcatccctagctagctgtcctcctacagtcccagtccccaccacactctcgctggccgccgccttgacgtcgccgcgctgcgacgcacagcggattcctgggaggcctcgaactcgaaccattggtggtggtgactggtgagtggtgagaggatccgagaccggtacgccgtacgcgtgggaatagggagcattttgattcgctcgccggccggacgggcggaggcgcggagcgtctgccggcacttgccactacgggtaggttgagtacttgtaccactgctagagaaggctaggcaggcagcgatgcatggccaaagcaaaaggctgtcctggcctgtggcggtggcggggcggcgctcgtttgtggcctggacctgggcggagctagggaggggagggcctcagatcatggagaaatgatccgtgcctgcatcgggggccgaccgttttgctcggggcgggggccgggggggtccgtgacccgtggggacgtgagcgattgggcaagcgagcgagtgcgccgtggggccgcggtggtgcaaagggagattgcgagcagcgggagatattttccgctccaaacttggctgtcagcctatgactgtgaccgtgaggctgcgcatgcatcctctgctccgccggccttgcgtacgtacgtaccggcccaagctacatactagccgcattccgcagttcggtctctggcaggcagtcgcctatacggtgccgtccagccgcctgcagctacacctgccggaacagtaccgtcccgcctgcatgcgacaactggtccgagaacagtgcgatggcgcgagcagatcacgcgtgcgcgtgcacgcgcacggcacccgcggcgcggcgccatccgtccgtccttcctggcctgcaggggacgggacgggacggcaagcgggcgggcgggggggaccgggcgcggccagcctgagcacaagtctcgctcgcgcagtcgccgtcgcaggcgtgcagcgcgtcacggcacggcacgcaggcgacgcgctgccccagctcgccgggcccggcggccgcacggtggtggtggtcgtcggcagagagagcgatggacacggccggggacagcaggccgcgcggaccagggccagcagggcaatcggcccctccagcttttggcgcagctatagcgcgcgcgggggctccggcgctgttccctctccctctccgccctgccggcctgcccccagcgtcgaaaagccaaataaaggaggcggtgttgctctcgtacatgtcgcgctgctgtccgtaaccgtaccccggcgcgccgccgccgccgccgacggcggccctccacctgaggcaccacccccaagtcccaacccccatccggccggatctcggagcagcgccccacctttccttcgcgtacggccaggctccatgccca

SEQ ID NO: 1199 - DNA, 1476 bp, Zea mays
  misc_feature (1)..(100): optimal_loci_37213_G1, chr1:224099949..224101424, Cluster 7
attacgaggaggtgatttggatgtgctagtcggaataaagtcatacactagagtcgtatgtatagcacgactcatattgaaaatgttagtattgaattagatccaatactaattttactagttttaaaaatgagttgcaatacaaatctgttgattaaatgcaactgaaattgcaattacaatcaatacagagggtctaggatctgaatggtgagttggggatagttcaataccaaggaattgggatccaattttgactctaaattcattagacaaccaaatagcagaattcagaaatcctgatttcaattctcaattccggacttcaatatctacatccaaacgggctgtcaagtaaaacttaggaccaacagtgacatttatttaatcatttttacttcactgggaataggacctaacattgtttctatacatatctgtgtaaaagacacttctctagttaaagaagtggaaagcgcaaataagagttaaaagttgtgtacctttgcaccatcgtctttggattctatcaataatatagtaccataacatgtgtcacagaaacccttgctccctctaacgccaaagaatttgccttgtttgacgcaccctttgcagacagagtacgtacaagtataacacatgtattgtactgccttttcgcagctgctgcatatgtgccaacctgatacatgtggcatcaagaaatgagtgcatatgaaaccatcacatttgaaaatttgaattgtaacagtaactcatgcatgaacatatccatcattgtacttctataaaaaatcacaagataattttgtcctacccagatgccatatagttccaagggacacatccttctctcctatagtcctatggcaatctaagtataataaatatttttggctcggtctttaaacatagatccccaacaaagaagatcacattgcacgagttatactgctaattttgtcctcttctaacaagtcaacatatacaatattgaatcagctcccatttgcatgctcaagtcaaatgagatggcagcattaccataactgactaactcatttaatatgggagtatatgcattaattaccatatgtttctgcttgaatgtttctataattaattatttacagcttttggcttgcattatcccaaaagttatggtatgtcaaagtgctataacaacatctacttaaacattaatatttgtaatactactcagtatctattcaataatgattcggcattaaacaccgagaagatgcagtccacaagagaaaagctcaccacaatcccacttgacccgacaccgaaagaaggattcatctcgcttgatgcacgcaggatggtacaccttcgggcaacccctaaaggcaaagtgaagcttatcagcatgcgcaatcaagtggaaaccgccaaccgcattactgttccgcaatacaagagctaatcgcgcgcgtgcgcgcaccttcg

SEQ ID NO: 1200 - DNA, 1791 bp, Zea mays
  misc_feature (1)..(100): optimal_loci_37539_G1, chr1:225882885..225884675, Cluster 7
taagcctcgtttggacagaaccgaacgcaagcactcacatgccatggttggtggtggcgaccggccggtgttggtgccggactgccggcgttgctgttgctttccttgcagtgcgcgtgtggaagggtcgtgtggcggccgttgccgcggacgtcgtttttcgcagaacagcgaaaggatatattcgctccaagttacagggacgcgtcaaccctacttcttcctggtcgctactggtacatcctagtcgtcttgttcagagtagcacagacaattactgctgaattgttcgcctccttcgagcgatctttcacagcctcgctcctgctcctttctctggaattttctgcccctgccgggctccaaagtccaaatttaacgcaggaatctgaggctccacacaagtgcgcggcaagtgcggagggggagggccatggatggatcgaccgagtgggaggcgacagagatggattggatggcacggaacgtaggcttgtttggcttactgctgcagcagtgttgcagttgcaatccatacatagctgtagccggattaaaacagcaacaaactcgccttgccagcactaaacgcgaagtggttgggtggccgattagcggcagctgatcgctactagctcaccgctggggcatcgacaggatgctcgtgcaatttccttgggtccattttcgtccttctccttcagcgggcgaattcataattgtagtagttctagctacaagtctacaacaaaccagatagtggttattagatggataatggagtacataattaagccgggggtaggtctggagtctgaacaattagcgcgtcattggacaggtggttcgatggaaattaagataggaggctgagaaacaggttacaggtcaacagcacaagcgaacaagaagcggcctgccaggcatggatgcacccgagtgatgagagcatctcagttcgtgtgaaagcgcacagcacacacaggtctggatctgcctgactgaccagtagccgtgtagattcgaactgaccaacgcctccctcggtcggtcagtctcggtcccggtcaactcgtctaatcgtcttttcctcgcccggaacacgctggcatgttcgtgtttatagtttaaattcataccagtccaatacggtacacaaattattcgataaaatattagtgtacaatgattaaatgaaaacgaataacacatatattatcattgatcttaatatctcaaacttagtttaaatatgtggtgataagtacaactccaaatatccgaaacaaacataacttgcaatagataattatgaaagggtgaagttggtcttacttttatggaaatggtgtacattaactttggccagcatagactaagaagctacttcaatcacaaaatagtgaatctcatcatcgttctgcatataaagaacacaaagctcaaaacttcattcacctctgtcagcacgcaaatgattaacatcaggattatcgcacccctcacaaaacaaaacaaaacaaaacgtgtagtacataaatagatacaactacagaaaccaatcagaaacctgtttgaaagtggacacctcagctatatatccatcttctatcctagcaattttcaactcaattgcagccttcatgatatcatcttcctctgtaatgcctagcatctatacggtgattgttaagcttaaacatgttagtcaacaaactattaaaaaagacaaacaatccaatcaattgtgaacttatccaacaaaaattcagaatgcggtcacacattttt

SEQ ID NO: 1201 - DNA, 2205 bp, Zea mays
  misc_feature (1)..(100): optimal_loci_38577_G1, chr1:230936231..230938435, Cluster 7
attcttttgagcctgagtggaatgtttgcgttgaatgcatcgtaactaaatgggatctactacgtggaagtgcaagcagatagcagaggtagagatgctgcgaaatggaagaccccactgcatgcatgcgggcctgcagacgtgcagctagctagctagttccattccatcccaaacctacctactacccggccgggggaacaaacgtgcgcgccaacataagccgcatcgaggcgacacgatcagttgggccggccgccggcgcacggtgaaaagtggcgacggcgacgcgagacgaacacggaagacatgaacagtcgcggtgtaagtggagcgcccgcgtggagagggagagggaattgaggagagcacgggtggtgatgcttgctgcactgatccgatccttatcccttcccggttccgggagtgtcgtcagtgcgccgacgacggagcgaagcagcacggcgccgtcggcgacagcgagacatctgtcgtccagcggccccatcgtcctcagcattccagcagaggctcggagtcaaacaacagcgacgtcgccttggagcactgggctgacccaacccgcgcgcgtggatcacacgacgtacgccgtgcatgcaagcgctggccccgatcgccgccgggcactggccccgcgcgcgcgcgcgcggtggtgcgagggaggcattccgtgcgtcgttgcgccactggcggctggcgcattagcgtatgcgaaacacaggagtggtagcatctttgtcaaacacgcttcctctgacgaccaacctcggcatttgctgctctgagcctgtgtcttgcgcgccgcccactggtaaaacgtgttcgtctgaaaagcagggcaagaacgcgactcccgatccgtagtatcatactatcatagcgtcaccgaacttctcgcactcgcacgcactgatcaggtactggaccacggcggccaaaagtccgcacggcaagcgacgatgatcgacagcgagcagtggccggccggccggccggccgacggccacacactcgagcgcgtgcatgcgtgcagcgcaggccagccaggggtgtgagacgacagagcggataagggggcagggccgaacagggaacagtacgtgacggggccagcaggcaggcaggtcggccggccgacgaccccggcagcccggcgacaggaacgccaggcgtccagcgctgcctgcctgcctgcccgcccgctcgctctccacaccgcatcatttcggacacgaacccgtcggtcgatcgagtagctaggccgagcgagtaggcggcctagcgtagcgcttggccagccactcgctgaaccggcggtccaactcagcccccccttccaccgcaagcgcccgcgccgccgccggcccaacgggaatggcgggcgggagctgtgggagcgccgaaagattggcgggcaaagtcgtggtggtgtcaatagggggtttatcccctgggagtggtgctttttgctcactcttgggtttaccatttgcgtgcaaactacagtaagaaacagtgccagcgctgggcctggagccccccaactctctcgcgcacagcacagggatgcccagctggccagctgccctgccatgctgtccactgcctgtttggtttggatgggagcccctcccctccgaacagctcccggccggtgtctctgtccactctgcttgtctgtgttgatctaagcgatcgtttacacgcgtccaaaatcgaatgccgagggcccatgccacgcatgtgtctgtccgggctgaaaccgcgccgtgcagcgcgccggatgggcacacggccggcaccaagatgactagatgagccagccagcacctcgtgtctcctcgctctgggcgtccgcgcaaatgcggtcgtcgaggcacccatcgctatgccggccggcgccgcacctggcgcatcattctgctcgacccctgccactgccaacacggacgccaaaaggtccggcgccggtcctcatcgacctgccgctcctcctgtctccgaaaagcttggcgtcgtatggtatgggtcaccaactgtatgagtctagatgacggaaactgccccctcgcaccggctgtaaataaaatcttttgttcgaccgtggccaatgtccccctcaccccacacgtctccaaacccagctttgggagcctgccctctagcaccacgtcctcgagcttt

SEQ ID NO: 1202 - DNA, 2303 bp, Zea mays
  misc_feature (1)..(100): optimal_loci_40563_G1, chr1:241240280..241242582, Cluster 7
cgaatctagatcagtattcttgggacgattactccagtccatccatccatccatgctgttagctatactaggtcattgaaattgcttagttatgcctgaatttgattgaccttgaccccgtctattacttgtttcttttggtcatcatagttaggtacatgtgaacagcagggcctatcttctgcttttgcttcttagcaatggcgaatgcaaacaaacacttgcaaccttcaaccaaatcaagcaatgacagaaagtaccaaggcacactggttgcttctccagcaaaggacatttcaccgaagtgtgtggatcgcattgtgccatcgtctcatctatttctcgatgtacttgatatttgaggacctctctgcatacagcaatccaaaggtttgtttaccaccacaccatgctcaataatctatacttttattatttttaaatgataaaatatccggagccgatggattgttgctcttgcaccatgcattcctgctggtttttagttgtttactgaccagttgattcagcacgaaatgtgtttgacacattgggtaaactttggaagagttaatgtttgttgaattggacctattagtattgaccacacatgaacaataatagcacgtgaaataattgaaccccgcattcgagcacgcaattttgaggtgtctgtatgatcaggagctgatggggttcagggtggcatgtactccgcatgatggtagtgcaccattgaggtttgaggatgcaattgagtgtgatattcctggttaagtttgcaaatgtggacttaatatcaaccgagttaattatatactaaaacagagtctacaacctagaggttttctcttccttttaaacacatatagatatctaaacttcaatagaatttgattttcacctaagcagtgtccatcaattaaaatgtttgtcatcaagaaaaaatctagattctattgttatcctctaagcattgacttactctggtgatatataattagttttgagtgaaatactcggccgactccatgcccaacaaaacactccacaacaccaaaactgttcctttcagcatgctcactgaaatgttcaaatataatagtgaaacactccacaacaccaaaattgttcctttcagcatgctcactagcatgctcactgaaatgttcaaatataatagtgtgccgtcgcaagagaaggtgcaactgctggcttcctccgtgcatcttgttttattttcagcagttcagaaagcatggcttcacagcctggatcatttgcaagtaaatccatcactaaaagaattgtttgtacttctgttgggcattttagtttagaggtgaaataatagatacagatctattgctttttactatttcagcatgcctagcttgcattctcttttctgttggggttttgtatcagaatcataatttaattgtgacaatatttcagaatttaatcatgacagtattattttgacaaaattcatgcaaaacaaggaatctaggatcctggagcctgattcaaaaacaaatacctttatatgctacttaccatgaatactaaagtgccactgactatgttggctaatctcttacccagaatctgtcacctaaatgtatggctgcttatttgcagatccctcgatttgggtcagtgaacaatcaccctcgacaaccatctaggtaagatgctggtaaatgatgcagaattaactaaattttctagatctgtaaatatacaccagtgaaaaaatgtttacgtaggtggagagaacacctcaaaacaaagatcagaaatttaattgaaactaatctaaaaaggctatctgaactcatatgcctcagatactaaatagattgtgttatctattttaaagagaaaaaatgactttaagaaagcatataaaggtacacgtattacccaattaaaggttggaaatgcatggaaggtctactcctactatgatcaacttttatgatttgtttaactgtaattcctaactcacaaagtgttgcccaaaactatgcaggttgtcatcagaagttgcaggccttccgaatcaacagcatgacattgttcaacaaagttttctcactgacaacttggttccacagaatttaacaattccttctgtcaaatatccaaataaccacagccagcaatcactcaagtactgtatttatacaccaacatcaccttccacagtttctgtaggacgatggcattatagcatctagaagaactgtcgtatgaaactgtaggcgctgaagaggaaggaaagcatgaagttgata

SEQ ID NO: 1203 - DNA, 1788 bp, Zea mays
  misc_feature (1)..(100): optimal_loci_40999_G1, chr1:243194930..243196717, Cluster 7
gaaattcaagaccttctatcaagataacccagttagcatcaaaacccaactgataggcattcaggcactggaggagactcctcttcgatgacaacttcttctgggaactatacatgaaataacaagctcatgaatgctcgctatgtcatgaaaatgcaaccctacatatagaatatatacatcaaacttgtaaaaaacacttcctacaaggagctaagcatccttaaacatcgttcaaaaatctcaaaactcaagtaactttatctctcctctaaggcactaggtgtcctaattacctaaggtgaaactcttttctattttgagcaacaattagtttgctgagcagatcattttcaaacagcttcaaacctaaccaaagggttaatatgactaagataagcttacttaaattttcctataatttttagtgctccatttttattgctaaaattcatataaacatttttagggcacttctttattatctaaaaatcaatcaattgctagaaaaccataaaactattttattgcgaacccaacacaatttatctcacaatctattttaattaagtgaaaattagttaatcaactaaacacactccaatataaaccaaacttttcggagagccactctaagcctgcaataccaaactcaagtcgagattcgtgaagactgcaactaatctgacttaaacgtaacactgaacagctaccgaaacactgacgaaacttttttttaccatttagtcccttttgtccattaattacatgattgcgacacacatacaaaattacaaggtcggatccaatagcgcgagtcacaagccggctacaaaccctcatggaaaaatctttcctggacactcacaactacaaacactcatgaaaaatctttccctggacactcacaacgattctattcattggaacacttagataacgctgtcgaacctgaagaagatggagcgtgagcggcaaagactgcgacgaggtcagaggtaggacgtcaagtaaacatcgcggttgtagtttccttccctggcacatggccacacgaccaatagagaatgaggcaccgcagcggatcctggctagagaggacgtagatgcggcaatctgcaggaattgacgccgaacgaactcttgccgacagtttcaacaattaaaattcaacgacgaaccggtgaggcgaggcaaacgacgccgaataaatagggtgacgacggcggtgcggaggctaggatctactccgatggcgaggttgctgcgacccatggttcggacgggaaggagccgaggacgagctgaggcagcgcgtcgggttgaagcgagctcgcgcaggacacgccgaagttgagtcgtggcggcacacggctcacaagtgagcacgttgaggcagcagaggacgggaggatctggcgatagttgacgacgccagcgagttctacggatgcaaaggcgcgaaggtggacgatgctgcactaaagagctggagcacgcacgacggcgcgacgacgacgtcgtgatggcgaggcgaggatgccgacgtggagaggacggctgggtgccggtgagcgcgcacaccaaggagtgcggcgagcagcggcgtacgtccagatgcagcgacgagagaggtcgagcagtgagacacgccggcgtctcggagctgcagcggagctcgagcacgaggctaaaggcgagcggctgaggaagtcgacgtcgagctgctgctgctccaccgatggggagaaccagggtgtgttgactgttgaggaatcagggacttgc

SEQ ID NO: 1204 - DNA, 1488 bp, Zea mays
  misc_feature (1)..(100): optimal_loci_42117_G1, chr1:248692952..248694439, Cluster 7
atttatatgtggagcacgggttaggttagaaaaaatatgagaactttttgcaaaatggatgatagtaaaaatcataaaaattggtgatttatagtagtagagaagagatagagatttagtgaactagacgttcttgccacgtagggtggtgggttaccctttttgatttattgataagtattgtctttcctcaccatgtaaatatatgatattcaccacaggccgattctcgaaaccagttagactggtttttggcagaattgcgctatctgaatccgcaagggttctaacgcttcttatagcatgtgacccatcttttgtggttgtggaaattttgactactttgcggccaatttgtgcatgaacagatatatctgctaagatcacaacccgtactccacgtatcgttcaggaaaacgtcaccgaagatttgcgtgacgcacaacaacaaacgtttcgcttccccttccgacaaaaaatggtttcgcgttgtggagattgccatttccagagagaacaaactgaaattgaaccgctaacctccttgtgcggttgtgctggtcctcgctgaccggtcagtccgccggggaggcgaaagagaaaatgaacaagtcacctgtggcgattcgccgattccaaacggctctcgacttcccgtcaagatgagggcgcgcggcgcgctcgtggcgttaaacgacgggggtagatgctcgggagctgttcgacggaatgcccaaccggcaccaaatactacggcttactaacggaccggcccgcacttcaggctgctagctatcggaggagaagagcaaaatgcaatcgaagaacgaaggagaagatgcggctgttcaggactccaccagaggtattgcacctatcattgtgaacataattaccagcatagttatcatcatggtatctcaaaccatggtattaatatacatgtgcaagactagtcaataacaaaaactttaagttagtgtagagttcaaatactctaagaatactataatatcgataaagtcatagtattcaaaacaaagttttttacactatagtcaaacaactcttaagaaaaagatactatgatattctttaataccataattttaccttaaaactctaaaaataatttacttccaaacaccctctaaagcaccgataactgcctttgtcaaagatttatgtacgcagaatgttcaacatttatgtccatcaaagattagtaaactaagtgcatgtttggatccattgtgattataataatcagctaaaataatctgattgtgatcctatgatccaactgaggcctgctttttggagattatgggtatttgtcacttgaaccaacgacagtccaggaatccaaacactgcgattattatagtccacaattcagattataataatcctataggtaattgagattataatactcgagctgtgatcacaacatgcgctaagaataaatttaataatcaagtggag

SEQ ID NO: 1205 - DNA, 1790 bp, Zea mays
  misc_feature (1)..(100): optimal_loci_44095_G1, chr1:258907357..258909146, Cluster 7
aaggtgttggagggttgcagagaagggattatgtggcagaggctcaacgatgtcgtcgatgcctaagtcaaggtgtcgagtacgcttgggggttgcctcatgatggtcctaacatgaagctagaggagtggaatgcgcagaagggtcatgctcccccaaagcccagagaggcatgaattgtgacacctctagggcgtgcatgctttggaaggagcatgaactaaagcatggtttcatgattagcaccatgtgaccctaccaggcgatatcctcccactcggacaagaccaaataggattgcatcaccgtctatgttgcatcttatgattgaagttcctagagtaggtgtcaaaggtgactgctccatcaagtggacatgttgggtgacgccatggctacacatcgcaataaagcataccaaatctaagaaaaaaccacccctattcccatgatatatccataactttttctctctttagggtacttatggtaccttgatgtcttcttagtatgtctgttgtctatattgttgtgatagtgcacctacttgaccgtaatatcgcccatcacatttaatgtgatagaagggagccttatctagactgttagtaccacgagatcatctaaagtagaattgatcgtagtacaggagccatacctttgggggccttcttgccctaggagtaaggacattcatattctttggtctgcaggtgctccatatttaaccgaatcaggagtactgtttttaatatgaagggccctaatccccaaaagggccatatgtcccattacttgtcaggagtctaaggtcaagggaactccaggagttcgaaagagcctcaaaatctagaaagacctaagggcctaggtctcacttgtttcgagagatggtgatgattggaagaggctcagaggtacgataacccttagatcgggttccttgatgaaatgggcctatgtatgagtaggtaataaggtatgggtccactgtgggcatgtggctgatgctagaagggacacactatttcgtccattgagattcttgaaaggtgtcttgacagcattcgaaggtataacctttctcatatgctaacaaggatgccatattgaaaccattagagataaaattagagaaagcaaacgaagaaagtattatattcgttaacaatgtactgtgagaaccagctagtatgttgggtaggtaaggaaacaccacaatgacaaaagaggggtgaagctaataaggctaattttatgtcatacaaataccattaaaaataaattaatgaaacaaacaaacatacacttggctaattactagtgctaagtagctaactagggatgcatttttttgggtggggaagtggcatttaggcacactccaacggttcctgggcccctccccctgttggccatagggtggccagggacacctcgacactcgtccaaccgctcctcatcgggcctgcatgcacgggggacataagattttccccatggaagctccccagtaattgattgtatttactgttaaattaatcctatttgactttaattaatagataacaatgtgtattatgatactataaatatggtactattttttaaaactctaaaaactggtatataaaagacaaataacccagataaagagttaaatgggagctgaataatgggaatggttggagatgagaagaaatatggggaagaatggttgaggtggagatatttaaatatgaatagaaagtatgaatagagagatttgggaggaggaatagttggagata

SEQ ID NO: 1206 - DNA, 2080 bp, Zea mays
  misc_feature (1)..(100): optimal_loci_44345_G1, chr1:260382869..260384948, Cluster 7
cttgtataataaaaactataaatttgaaaaggccaatttcatttacaaatttaaatggagctagcgaatagtcatgtacaatattaggactaccatatagattgtgctaacgctacgcgattctggagaggaggggtcgatggctacatcgacatgagtgagggggagggggtggctgggtcgcaggggatcggagggggtggcggggtagtggggaggtgaaggggtgaaggatggtacaaataatattgtctattgaatttgagtgagtaagggagagagaattatctagcggtctgaaccgttttttataatgtgttaagtttgtgtgcaatttgtttgatggatctagtggaggttatatgggtgtgggggtgatctggttgggagggcttagcaaagttcaagctcatggattaaattactcacatataattagctacattgtcttgtacgtatccatgcatgaattacgttctaatacttgtctatttcaattagaattacttgcgcatgcggaagagctagctctgctggttgatggactacggtgacaaagtaaaaaagaaactctttggaccagctgaggaaggcaattgtttcgaatctggctgctgcgtagccagacatagagaatccttttagacgcaacgaggccccagcaattcattgtggcgttttgcacccacatcaacccgccgcgccccccttcacaataggagccagaacaaaaaaaaaaccactactcctctctctccctcacacacagagtgagagagagagagacgcacaagaaatcagtaggtcaatctctcctctcacctttacatcgtctttgtatttacaaagttgttgatgacttgatgtagaggctgtacctgctggtttgctacccctagctagctatatgtcgtccaatcctagttgagctctcgatctggatggccctctgattagtcgtcctttgcttggtggtgcctgctgtgtatatcgccaccccggccgcttgcttccgctagtagctagtcccttcttctcttctcgatcagtttgtttaattggcagagcgtatgtatcacacccaaggcgaaggaatgtcgtcggcggcccagatcgcgccggtgccggagcatgtatgctacgtgcactgcaacttctgcaacacaattctcgcggtaatatatatataaccccgatctgatctctagctagctagcctctcgatctgtttgcccccctcagctcgttttctcccccggctctctcgatcggttttttccctggttgccggcctctgaactgaagcgcagctatatatatacagcagaaagatgcatgaaaaatagttgattggctgcgtgcgcctgcatcgtcgtcgtatagtagttagttttaatttgtacgaattggctgttccgctttctggatttcatcagcttctggatcatttcatcagagcttttggtctaaattgaaaattggggatggttcttgcatcaaattaagtcttgggaacaagatgactaattagctagcagtcttagacgaagctagtcagcaagttctcaaagcattctcgccttctgcaggccctcctgtactttttttctgggaaattatcgtcatcatcgttgatgagtggtggtctttatattaattagatctcaagtatatatagctttgtttgcctgcaggtgtatatgtgtgatatttgtacatatataaagcttcttcagcaccgcgctagctagcttctttcgcataaccagagtccgatccggccggtggttaacttatttcagctaatatttgaaacacaatacatgtatacgacatagggcaatagatttactcgttaccttcttgatcgaactgcaacagagagtgcatgcaataataaccatttttaagacgataaaaaaatttagtgtgtaccgcgtggatctttagcttttatgcttttctatataatatgtagaccatatctcacataaatcgaggtcgtgtcctaataaatatactaagagatatattgactaaaacaaaggccttttttattgactaataataataacatata

SEQ ID NO: 1207 - DNA, 1406 bp, Zea mays
  misc_feature (1)..(100): optimal_loci_44363_G1, chr1:260447389..260448794, Cluster 7
gttaacgcctgttgtttccctttcttcttttctaaccatcataattttatgcaacccattaattatttgccactatcaatggcacgtgtggaccctatttgtcatcaatggcacatgagtgtcatgcataagagatttgaaattttgtctaccgatggtaaaaattatgaatgagcttccctacataggtatcttgtttaacaatatagagcatgtttgtttgagcattctagaatcccttggatctcagctttttaaatctttcaaaatccaagaagcttttagaagtcaaaagctagaggtgttgtggacttatgggtaatcatatgagcctccactaggctttgtttggttcacttaactagtatctactatctgttaataattatttttatctaaacagacacaaatgatatactagttaattgttattagctaaaattctatataacaactatttcactagatgcaccaaatcagataatagcagctaatagataaatagttataattataccccactaattagctatatatttaaacactcttctagccccagctaatagataggatattagttatatgctattaagggcatgtacaacccacataaatgactagtattctaagaggtatctaagagtgtaagtgaaaaaaaaacacaagagacatattttagtgaagggacgtctctaatacggttctctaagtttaagatacggttctatcgatacaatccacataaatgagccgtgtattgagtggttctagtgaataagataaaaggcttgaatatattaggttgcatgaacgagtttcgtgtatcatagtatctaggttgtggagatggtagcattaattagctctagctagatagtacatgtatgtgaccttcatgcgcgtgcgtgggcctcaattttatgaatgtccgccggccccatccaggtgatgagacaacaggaactcaggaaggtaccaaagcaccctaggcgcgcaggccatggcccatgggcatatgcaacagctagctcgattgcgtgcgtagcctcgctcgctttttagttttcttttcacacccttttcccttttcagcttggccgccggccgccggcagcctagggttgatttgaaacgccgtgacgagttcgctcgcccggccaccgagcgagcaggacgtagtagtagtagtatgtagagtaggatggagatgcatgcatggacgatgggtggtgtcgcggtggggggtgatgggatcggatccggacgtacagtagggcaggcaccgttcgtgtgcttccgtatcctccagatctctattggcgtcgcttcgtcgtcaggggtcagctatcgaaacgacgccccctccactcactgcgtcactgcgtgtactcctgtcgcccattacc

SEQ ID NO: 1208 - DNA, 1695 bp, Zea mays
  misc_feature (1)..(100): optimal_loci_4465_G1, chr1:23200649..23202343, Cluster 7
atagctcaatataagttacgaacagctctaactccgcaagacgggccatagcattttattttgaatataggttgtatgcattttatagagatgctgctggctcactttagtgggggatgagaaagcttctcaccaggcctatccttaagtgataataaccaatgaacttgcaaccattgtgagggttgtcggttttccatataggaaaagacatatagtagtattttctttggtcaagttagagctaaatccttaagaaacatatagtagtatatgtttctttagcattttctgaattttctttagaatcatttctagttctagctagtagctactgtgaacatgctacagactgttgaggaagaaacaaatcaatgatgattcaatacaccatcactatgatgcacttcccacatggcataagattcaatccaatgtgaggtcgtgggagacgatcaccaggttggtctcgtagctggggtcctggtccagcctcccattgtcgatgtgccgccacggcgactgtaggaagcttgcctaacccatggtgaaggagaagagcatagggagacgatggacctggtcgactcaccagcggacgtccctcggcggtgggggactcgccagcggaggtcccacggcggggcgagcgtcggaggagggtcgaggcaacgattttacgtgtagatatggggagccgctcatacagcaggtgtgccatgacggtcgtcttctccctctattcactaactgcagggaagaacacttgggttctacgatgtcgccattgtcgtgtagagacgccgaagggaaggaaaagagacctcttcttcgtcgtcacctacacttttttctatcctgagttattacgcctcgcgatgcttccagttatccagtaggaggccgacgtgagacgcggcgagaggtcggccacgcgaagcgtaaacttgagcgacgtttctgaccgttgtgaggcgatcgagcggctgaaaataatcgaggtgatagggatatgctggtaggccaggtttactcccgatttatatatatgaatttaatgtgatccatatcatataaatcaatagcaacattggcctccgtagcatagtggtagtgcgttcgcttcgtaagcgaaaggtcgcgagttcgatcctcgccgggggctcttttggtgggagtaattaattattttttataatttatataactcacgtgtttttcttcccgggatattcgtttcttcggtgtttttattattacatcctatcacgctagaaaaaaactagtaaacactccgggccaagtaaatagtcaactaacaaatctaaataaactagtaaacaacaaattgattcacaatcaaaccgactcctaaacaaaaagcatttgagaaaatctctgtttctaaaacatttgattgccaaatcttacccacttttctcactattttcttctcggtttggttgtcctgtcgttgtgtcttttctaatactagggtcgtgcatgtgcgttgcaacgattttcatatatctcatggtagacctttaataatgatgcatgcttcaatttaaaggacatgcattgctcaaatctccgaggaattgcagtgaagcaaaaataccctagactctaaataaaattgtcccccaccaaaaaagaaaatgtaaactaagtgtacaaatttgtaagagttgc

SEQ ID NO: 1209 - DNA, 2626 bp, Zea mays
  misc_feature (1)..(100): optimal_loci_47492_G1, chr1:278447333..278449958, Cluster 7
ttatgaaatatatttttataataaattatattggagctataataaagataaatattggtcactatgaatttggttaaatgcgaaacacttttattgatatacattttagaagaagtgctgcccgcgaaatcgtccttacagctcccgcgaagccaccaaattcacgaaactcgggaaattgagaagcacgggcgccccgcgtggcatgacaattcagtaaatttgctaatatctcactacaataaataagaacgaaacttccatctagactttggcttagcacttcccttctgatcatctacgcttttgccacatttattgtgggctacaaatcaagagcattttggacctggcgggccactcggccctgccacgttctttctttcgtcccacatccatctgggctttcggcttcatgggctcattccgaaaccaagaacctgacgggcctgccgtaaatgctgcgccgtccttgcgattccccacaccgacaccgtaccaagtactgtactaccagcaccaccagcgccaggtcagaactcagaaccctctagcctctcgaccagtcaacagttgtcaggcacagttgtgggccaagaaacaaaaagctgcagccaaaaaaataaactacgcggtcgcgcatcccacagtgacagcgctggtcatccagcaaaacgagagagagaaacgcacttaaacagtgccgctgccgcgcccgtcgagccgagcacgttgagagccggagaaagttttttttttttttggttgcagccgcgaaagcagcagaccagagtaccagccgttccgctacttgtacagttctgctacttgcctctctcgttttctgtggaggagaaacggaacgccccgcgtgtttttgctgaagcggcgccatcacgccatagcctttttctgttcgctcgcgcgctccatccgctgctcgtcgctcgttgtggcaaaacacgcgatggtccatgccgtccggcggcgaaatgcactcgtgctttttcttaaggcgcaagcgcaagcgcaagcgcaagctttcttccccgcacgcggcggtcgctaccggccggatttagatggaagatgcctgctcctccacccggtgccgccgcattcgatgccggctcgcgtgggcggagggacattcgttggatccgagggcgaaccacgtgtgcgttgtttccccccgcacagtcgctatcaaagggcctattcgatacagccatgcagctagtaaattagttcccccttttttttttgttgactttaacttaacgcctgcgaacatgggatctagtagtaggagtttgaattgagctcttcgtaattctaggaccccgagagaagcgtgtttcagggtctgatcgagttcggaccaatcgacatcttttcctgattggcgctcaggattttgagctagctggagtcaaggtgggactgtgggagtggtgatgattaaatctaattctcagtctgtctcacatctagagcgggggagttaccgtgatatactgatattcaagggtggaccatggcacggtccaaaaaggacaatatagtcacaacacggcactattttttttgggctatatatgtctagaatctcaacacgatgactatatgattcacgatggactatatgattcgacctgtattttgggttggcaccacatgaaaatagcaacaatataattttgtagtatttgctccttccgtcctaatttatattgtttgatttttaacaaagtttaactggcttgtcttatttatttttttcgaaaaaaactacaatatgaagccatatatacaatatatattatatgataaacgatatcataataaaagctaataataagcatgacgttttccgaataagacgagtcgggttaaatttaggacaaaaaattcaaaacggattataaattggaagcatacatttcgtctaattctcgaatagattatagaagttgttacattttatacaaatataagatataatatatattgtttatgccatgagcagaaaaaaaactagaatatatattttgagggtgtgcttatacacttctcgaatgcttggaccaaagaaaatatttatcgggccgtatcggcacacggttggatgtgcctcaggtttgctaggacaagggtcacgaaaccgattgataaatccggctaaccggcccattaatcggtaatcagtcccggcctgtttggccgtatcacgggtttaccatttgaatttgggatgttttataaaatttgaacaaatttgatgtaagatttctataaatactatggattgtttttaagactttccagtgaaagcacgctacggatttcaaactaaaattcaaacaagtttgaaaaaatataaaccattctactttaccgattagccgcccctgctagccaattaatcggtcacaagtcgtgataaaaccggtggcctctagttgctaggttttcaggattttctttattttaacttcaattcttttaacttgtgataacatttgggccatcttttgtttaaaccttgtgatcccaatatacttttatttgccaaaagacaagtggttcggtttcttcacacgtgacgccgatttatcgattcaat

SEQ ID NO: 1210 - DNA, 1787 bp, Zea mays
  misc_feature (1)..(100): optimal_loci_48267_G1, chr1:281834112..281835898, Cluster 7
agtgacgctggtgctcccggtgctgccttcgctcctgcctttcctatggcggaaacacgattgataccatgaaagaatgaggaatttgtgtaatcactccgtgagttgatagtttagtcatgattgtaatatataggcagcgcttatgcaccaaaaaggaacctaatcctctaactatggaaggtccaactatggaaaccattagaaaaggaagccaatcttgcaactatggtaaactcagaatatggaaactaatccctatggatgggcaccgctaacagcaccaactataataaccgaacaagacctatattcgaatcttagaaaagtggggcttcaattaaaaatatttgcataaacaaataattactagatcgatcgagctccaagacacaatccagattaagctgacaataatttaactctaacccatatccactaaaacagtatttgatgagggagagggccggaacacaaataagcattcttagggtccatccaaaaatgtttacctaatatatataaggtttaattagcagctggaaccatttatagtctcgtttctacacaaacgaaagtatctttagggttggtttggtgactaaggattacgaggggatccatggaaggaatctccttgctatccaagggattccttcctctgtttcctatagattctctcgtgatccctgatcatttgaatagcaaagaaatttctcatatatatctccttataatcactggtcaccaaatacttagctgtattatctactccacgagatagcggcgtccatcgacctaatgcaagcacccggccgtagctctcatcagatgagcgaggagaccgtgtcttctgctcgtcctgtcaaatctatgtcgaaaagatatgggctactctgcgtgcccgttacatgccgtgcatgccagcaggcctgagtcctgaggcacatgatccgtcccgccacccccatcacatccccagccagtcagcaatccttgttgggctccagcgcgcctcgtcaagatgattcaagagaagaatataacgagcaaacagcaaaagatggagatcgcgtgtgacatgtagaaagtgaacaacaaactcggtcgcgcgctgttattaaccaccaaacagttgtaatttgcacaggctatccgtcaccggtcagaccttattgtccggttattcctatactgtatggattgtatgacattgaaaaaattatgcaaaattttaacttatttagaatttaaaaccgttcaaactacctaattcatatggattcacaataaaaccaacaaacccaccgagcttggatccggaattgtttataaaatgcatagtatcacggtcgtgcatggtatgttccatcgagatcggatatgatggtcaaagaatctcatgtcacttaaagccttcccttatcacgtcctttcctgcacccctggctagacagtaggcacacactagtatggttggtgctacgtggcctcgtcggccttgtcgtaggtattctttgtttcttctggcggtatttagtatatatatatatatattaaagcttgttcgaaatctgctcttagatgtgtccacgatagcgttttttattttgaccgtaagatcctcatctaacggcgcattatggtcctcccttttggcttctgcacagaacggtaactccttttgttctcgacttctcgcgaacctaccgcgttgctaatctggctgctccaactcctcgtatcctgagtcctccggaaagctttgccctaggaagaagcgagga

SEQ ID NO: 1211 - DNA, 2353 bp, Zea mays
  misc_feature (1)..(100): optimal_loci_50719_G1, chr1:294676851..294679203, Cluster 7
agaagatatgatgcacgctaaatgtttttttaaacatgacagagtcacacatacttgttgcattacatcgtctatgataaatcctaggtgggtgtagagttttgtcgagtatagttgggtgatgtgtttgcaacgacgacgaggcggaggccatccgctactgcaaccaccaactacatgaaacgaaacaactcatcagtaggtaacttgttattttttcttcatatatacaagtctatgtgatggaccagtgaaaaaaaaaccatttttcattatttaatgaattgtgttgcgtgcccttctgtttaaggcatttcatcctgcttttttagacctaaaatttctaggattacttgcagaatgttttttagtcgagcgatcaagcagtaactcagcgaaattgggttttgtttgcttctaagtgtatattaagctaacctttatagttttcaaagtccaaacccagctaccttttctaaatacatgaaaataaaagtaatgttttagttgttgcatcttaagtgtaatattttaattgaccccctaccctcccaaaacacacaaagggcaaaaacgtcacataacacatgtcatatgaaactaaaagaaggttggtatcctgcttatggtttcagaacgtgcattgttaatttctacttgatcttatctaaagataactaataagggtttgattatagtatgtgtagcagggctttgcactagcttgccaagctgatcacaaccctcttttacatgtgcttcacccaatgtgttaaaacaacacaagaaagttattttcttaaagcaaaaaaatgtaactcaatattgcagaatatactttattctctcatatatgttagggtgcactttttttttgaaaaaggagtagtagatttttttgaaaaaggagcagtagagaaggtccctactgaattagtattaaaagaaaaatagtagttcagaagctgtacagaggaagacaaaaaaaggaaggagacaacaggattacagacctttaagccttgaagtgaaagccaaagaggaataacaagatcaaatttacagttttccctaggcataactataggagcagctcatgctttagatgctgtcgacaaccttcgatagttgggtttgttttcaaatatccaagaatttctgtatttccagatgcttcacatctttagaataagaatttccatagtgtaggcaatctagagctgccctctagatatagctctgaggtgacgattggtgcggggaggtgagagacgaatggagttccaacaatatgttagggcgcgtttacattggcaaacgttttattcaagtcttaaacatgtgtttgtttgcttatttctatattgcttccaaatatgctttcttcaagatggatttagataattggcaaaacgagaagtgtacatgggtcatttatgcctattctgaaatgcataaattaaatattaagatgccaatacagaaaacaaatgcaatgttggttgttgggaaaggaatagagtgtgcatatgcagttgcaatataaatatttttaccaactataaaaacaatccaaatagcacgcaaacaaagtagtatatgcagaaacttcttactttttatatttgtcattaaaatgcactaggttcataaataaaatgatgtaactgcacatatcctttatatctgtactaatgggtatactggagatgttagaatgattgatggggcaatattccagtgcaacatacaaatttctagggaatggaggccacttattttgtcaaggtagacgaaattaactgtgtttacttcgaccaaatggacaagctaaataattatggtgctcacaatcataagtcacaacatgagatatttgaattaagggaagcctataactatagggaagttggtctggatcttgtaaagctcctaaagaaattcgatatcaacgccactccagtctgtaaggtactaaaaaaattcgatatcgactccatgcaaatcaaaccacccctacactcagcttcaataggttttcaggcatgcaatgtgttacttgagaaaagtctcagtcaagttgatcattgagcgtgcatagtaatgtggtcttttctcgtgccaccatttgcacggagccacatccatatgtgtatataatcattgtacacaatcattttattgagcattgtactagattacatatttatattgtcaatataatattattagtgttacgatgatattttatcacactaattttgcattatagtgatatttaccgtttcatatttatgttttccatatttatattttatactaattttaaactcccgtgacaacgcacgagtat

SEQ ID NO: 1212 - DNA, 2188 bp, Zea mays
  misc_feature (1)..(100): optimal_loci_5177_G1, chr1:26570199..26572386, Cluster 7
gaacttaccgtgagactctccatttatcatgcaaacataaaagggattaaaattatttggctagaactctcaccacatccatgatgtgagagggaactagaaggtcttaatgctcattagtgttagagcttgtattttttctcatttgtgttcatcaatcaatgagtaccatgagaacgtagggttatgtacattgtggcccaaacctcattaactgcctacgtgctgactctcacttgtgcctaggttcaacatggtcatagacctacgccgtgctccctcctaactctgtctcttgtactttgtataccctgatgttgttacacaatgataatcatgcttgtaacctaaatattatctatcaattgacaaataattgttggtagtttggttgggtgtatttcaaaattaaatgatatgtttttggttattggaatgtgtagtaaaggagacttgtcaaaatgcaattgtacctgctgtattctcatcaataacggaaaaatatgtgaaacgttggatgtgtggccttgtattttttttgtgcgtgcatgaatatgtgtgtacttatgtcgaacagaacaaattacactctccattatttcctcaatataatgcataaaatcgagcttaattaatgtgcaaagataccatgaaaacggcctttattctgaattttttatttggccacatattagccgtcatacagctgtatattatattaatgtatgcagtcctaactacttcgaagcaaacatacatagtgagtagattgtccccgcttggaccatactatcatatgcaatccgattgttccaaagaatccaagcgatcgacttgattgatcaatcgctatgcacacacaaactatgggttgcgagtggcgactgacaccgtccagagtggggatcactgtcgttaggacttgagagctcacaacaataaccgtgatgtgtgaagctacggggaccgagggaggggcgcgcgtgtgatggatgagctctctgcctctctgcatgcaccccctgctgctacatattgtcaggtatatatagtactatacctctacgactacaccaaagaaggaaccaaaaattgaagtatgctgtacaaatctttccagccacagatcgatatagtatcattgccaacccatcatcgatctaaaaaaaaatatcattgctgccaaaaccaaaccaatagcatcgacacatgcacatttgacgcatgcggccggacggcggggcggctgacgccgagcgatccaatcggcatgcccccaacagtgtcgcagctgctgctgggcgcgcgagtaccggctgcgtgagcaagctgctgctgctgccgcctgccgcaggagggagaggaggcagtagggcgctagctagggcatgctagctgcgtccacagggacagttccagacacgcggatggctacacatcccggagaaaaacatgccctggccgcggccgacggggcatgcacacccacacacacacacacacacccccagctgcggtgctcagcatatggcgcgcgcccgcgcagcgagaggggcagagcacgcagctagcgaccaaaccaaaggtggtgttgaagtgacaagatatcctagaatcttcctcccctcgatcctaccctaaaccggcatgcatgcgatcgctttaaagcccggccggccggccagcacacacagcagctgcgtgctagtatgatcagtgcactcgctacggccagcgggggtacgcgcgacggggcaagatagctgctggatgcctactatatactaggagtagtgcatgcatatgcatttgctcgccggccggccggccgtagaggcgtacgtacacagcggcttagcttagctagccgccgtagcagctagctaaaccggggtggggatacggtggtggtggcgatcggcggagcgagtaaaaagtgacggatcggatggatgcctcaatcgctgctgactgctgctgcggtggtgaccggtgacttatacctagagggagtaagctgggacgaagggtggaagggtgggcgctttttcctggaaaggaaactgaggattcgtcacatcaccacgaggggtcgcagtctccaacctccaccggacagcaacctagacgacgggctctctttatggccttatcatctccggccggccggccatctatcgatccccgt

SEQ ID NO: 1213 - DNA, 1813 bp, Zea mays
  misc_feature (1)..(100): optimal_loci_54628_G1, chr2:15278954..15280766, Cluster 7
ctgataatctaattctagctgtgagctagcgattgtggaaaagctataatatagggttaaaacaattgtcaactgtagattctgtagagcatgacaactaggtaacatggatgatggtaatctaaaaaaatatttagggtaagaggtgattctaaattgaaatagaggaatctatagattttcgagaatttattgtgatgttgtacccgtttaattgagattctagatttttggcaatgaatctggttcaaaaagctaaattggtggtttccgtcaatcttaattgaaagtagtcagtatctgagtagtaaatactcaggatgccactgaagtgagaaagcaattgaactatccttatgatgaggtatgtatgtgggaagacatgctgattaagactaagcactttattgcaaatgtatcaggctgccacatggaattgcttagttaatctaagcactatatagttggcatagtattttttttaattgaattcttagcgtgaaggcatttgaaatgagctgatcaggcagtaacgactaacgaggatcccttacgggacagaagcacgagtgaatcaactgatattgtgacataccatagtattgcagcctgatttggcttcctagaaccaaacgagatgctccgcagtcctattcaagaatgcttcggaaaaatatatgatttgccttctgaaactgtttgcttctccgtggacgactccggaaaaagggtagttttgtaagatatggtcattccatggaaggctagaaaagcagtcagctggaatgtttcttaactacagtatgtagtttagtctgttacgatccactgttggctatgcgggttcaagttttatattcacctttcaatagttctgcagtgcacacatgctgacctatttttatgttgtcgacttgttgcataatgctgtcttgtcttatcctcctacggcagactgtcagactcctctagttctcggtagccctccatcccaaattccccaatcatgcatggaacaaaagttgattttttttttttcgtttgatccatcttcgttcagactgactgggagggaggttggatattttccctttactctgtattttgctaaagattacccagatggtccttgagtctgcaagtttccggccagtccagcaggaatccttcagcacttcgtcaaccgcgttctggaggcgagatagggtctggctcggtctctttaacccgaatctgatgagaagtgatcctggtaaaccgaaatttgagcacatccaaatatccaatgcatatgttattactttatgtgaaaacattagaaaggtttttttgttctgctgtgccttaactgttccatggaaagtggaatggatcaccacatccacgttgcaaccagaacagatccagcccagatcggcgcaagagagggctgagtgggcatggtggtggttccaattatccgactcacaatccaggagacccgccactcctggttccaagtcaacaaagcttccaccattgttaattctctcctcctgtacttgcactgcctcttgaaagccctatccggctacccccctccccgctggatccaggctgtgctagtcatacacactcatactaccaattaacaagagagcctgcctgcctgggccagtcgtccatgcggacagtgacaagtggtggcgtttcgtgaggaaggaaccaaactgagagcgattaaacacacggactacatatatatacacatatgccttgcccccgtcggtgctctgaatttggatcgcgtggactcgcctatacgtgctactat

SEQ ID NO: 1214 - DNA, 1527 bp, Zea mays
  misc_feature (1)..(100): optimal_loci_54878_G1, chr2:16813413..16814939, Cluster 7
tatggttggacatggtccaaagtttagtccgtaataaagtttagaagtaaggatacaaacacacccttagttcctggaaatgacttttggaaaagtctggtgtgccgcatgtcctttcgtcatctgttgacatcccaccaacaattagataccgatggtgtttcttttcttttttcctgtgggcgacgaagtggtaagtgagccggtacttccatgagattgagagaagcagtatccaaccttgtgtgtctctaccaaacatgcagctaggtacgctgatggctgaccacattgagcgttcgtaccaaaacaccaactgccatcgctattctgcatgcgcttcctcctcagttcctctagctagagagagctaccaactgacgttctcttgctatcctgctgcgcttccttagtagtagtaggtaatgcggacacgagcattcgctggattcagcatgggcattaaaaaaagaggaaacgcaattcttgctcgctggacgtacgagtgccacgcgcgacaacctgggcagaggacatcaacatcatcatcagcaggaatccttcgtcgtcgttgcgtttatccgctgctgggtcttgtggccaatctggacctggcctttgccctttgggaatagaaaaaatgcacgcggccgagatgcgcttcagtcaccagatctccccccgctgactccccccgaactgctcccccctcctctcctcttcgttcacgtgcgaatgtgggtgagccggtacgcaggcagagtcagaccaagaaacgggtcgacaaccaccacgccagcgagtaggaacgcgcgcgcaaatgcggcatggcgctggtatggccaatggtcctcggcgggaaatcgattgttttgttggcttgttgccacttcggcgaggacgacgacgaccgtcgaagaagaagaggaagaacgggcaactgttcctgttcgttccaccatgcatccatccgccttgtttgttccatgccctcgccgttcacaaggacggattaaaaaccggtcacgactagtccttttggcgcttagtattagagtagtacgctatagattccggggatcggttacggtacgaattgttttgtaggtgtggtttagtatggtccaatggctgccccactctacgccctaaaaggtccttgttgttgacctgtcttctgtagccatgtaggcttggtactatggttgttattatactttatataatactgccttcgtcaatgacaaaacaagactgctattctcacttgttaagaaatcaacgaccatgtcgaataaagttggtcgctgcaaaatagcatatgaacactcttaatacaacggagacagcgctaacaaagtatagtagttcctagaatctagatgctacgcacacaatgacacaaaggtagggaggtttttttcccctcaaaccaatcaccatacagggaggttgacctccaattatacgttgtactttcttttctttatctcgacgaaaatcaccaaggcacagtttttcttcttc

SEQ ID NO: 1215 - DNA, 2692 bp, Zea mays
  misc_feature (1)..(100): optimal_loci_57107_G1, chr2:29053457..29056148, Cluster 7
taactttcaggaggttggagagagcgatgtgaccgaagaaaacatagtatgaaactgtagctgagactccaaagctagctagctagatcatagccactgtggacagattaaaaaatagaaacgaattggtatggacaatacagatgcatcgtcacttaaaaagtttatggacccaaaacaccgcttcgtccacagttgatggacctaagtgaaacatatggtcaaaacttaattgaccaatggtgcatttagctcttattatattataccagggaaaactccaattactccctccaagttgtttcatctatgtttagatagcctcctaaattaatgtcggatccaatttttcttgaacatgatttactattttgtttctccacgtataagctgaatattaatatcaaattgtgtgaggtgatagagaggatatcataagttatgctagaaaaaaaatatacattttaattttttaccacagtttccatgcttaggaaatttagtagtagtaagtaaacagtagagatacaatatcatgcaaaatataatgatgaaaattttataatttatttttaatcataaaatatgatatcttctatcacctcaccaaatttaaacctaaaacacaatttttctggatgaaaattttataacattatgttgcatgtgtgttattcgaggtagtcttataatgtggtggaagtgggggtaatttgatgcatgttagagtcatatataagggtattttatgtagatcttggcaatctaaatgtaaatccagagggctacttattagattaaactcctatttcataatggaagagatagatatgcaacctagctaggggatagattcatacgttttttggagtactttataatagtaaatgccggtattaatttctttaaaaaaactgatattcacctacttaactggtgtggccagatgtttatgtttttcgaaagaacttctaaggtttacttacctcttgttatatagtcttgtatatccgtatgctgcagctgatttaactgttgctcctcaacaattattcatccaatttaattcacatatgtagacctacaaggtgcagcatcccgtgtcctcgctcctgtgcaatcagcctattaaactatatatcagtcccttgtcgtcaatccatcaccattttttttgatactgtttgcaaacagggtgttttgattctagactctggagctgcggtgacgaccgtaccttttctcttgctgtgtgtacgtagttgcagcacttgaatttttaacaaaaagacctgccgaagcaaaaaggttttgccatttcagtttccttcacacatttcggttttcgtacgaatacatacaggagttgtcgttgcgggtatcatgagggccgcaaatgattgtacgacgaacggcgtcagccaatcaactcgatccaccaataaccagcagccaaccggcaactctatagagataaaacacgtataagtattagaagtcggtacaattaaagccaactgaataggctgcttggtgcaagcatttcgagccgccccgtcgtcgatacatcatcagcggccctgcctgctgtggtgtggtggtacagtggtagctagtgtgtggactggattcagacaaggccaaatcgcagtcggacacccgggcacggcgaggccccgcaggtgacgcgcgcgcggttgttgccttgcccccgatggatccatcggaacggaaggcgaccggccgggggggtcgtcgtcctggtcctggatctggatggatggaggccgatggatgcaccgcgaaaaccggttgccgcaaggaagagagcacggagccgtcactccacgggcaagagagccgaaacggctatggccgtggccgctgcctgcctgcgacaactgcacgcgcacgcctacatggcagccagatccagatggcacgcggcgcgccgcgaaccctggccccaatcatggagcctgctggggccctcgatcgttcccgccgcgcgtgccgccaataatttaatgcgtgtcccgtgcgtgcgtgaccgaagcgcgacggatgtgcctgtgtggccctgtgcatgcacgcgcggcgcggaagcctttccttgccttgcctcgccgggacgcggcagcgtgccagcagctaccgcccgcccgtccttgtccgcgcgtcgggcccgcgcgccgcggctgctgccatatgggatagcaatggcatacaacaggtagccaaagccatcgctgcgggcatccttgctagctgcctacaagagggaaagtacgatcaaccgacgagctgtattgatctcaaatgctgtacgtacggtatatatgttgcattgcattacaacaatggctactagtagccaaagcctatctagatgagtgcgcagcaggcacggggcgtgcatggacaagtgaagatcgtgggtgccctgcagtacgccaaaggaaggttcgacgcggcgtgggtgtgatcgagtcaagacctggagctatctgttggagctgcgttgacacctcgatgtagatccaaaatcgaggaacaaagccgtcagtatgccacccgtcaaaatcgctatgtgatcgtctgtgacacttgttaaaaacagtcactacttttttaacagttacatccttttaaaaaaacgtgtcactaacgactgtgcacatgtaccatctac

SEQ ID NO: 1216 - DNA, 1425 bp, Zea mays
  misc_feature (1)..(100): optimal_loci_57248_G1, chr2:29650518..29651942, Cluster 7
actagagtacccaaactaggcctcagcgttttttatatttttttaattaaaatttaattagtaatttaggtaataacatagttattagaaagatagttagttagaaaggcacgcacgcccttttgcacttgtggatgtttctaattgtcaccccacaccactgtccgtctacccccgcgtttatctcgctgtgaagtgtagaggaatcctgtcctgtgcctgtgccacggacctagctagcttgccggacggcatatcctcggtttatccccgccgcggcgccggacgaaccgtaccacgcacccaggcgctccgctttgttccgtcctgtcccggtcccgagctttgcttggtttgcaagcgatccggcagcagtggtataagccggaggagattcccggcctcttcggatctcggaagcttcatcgctccgctcgccacgcgaatctcactggccactggctgcagcctgcagcgcctttatttgctacgtttttgtttgttgcttcatcggttgtgctaccgtttataaaaagacctgatacgatctcctccttattggcttctcttttctgggcaattgagtgcgcatgcattacaagtggggagaatgtgatacctgtgcacgtttatatataggcaccgatacgctatcgcggtttctttgtgttaacacagatcagccaaatctacaattttagtgtagcaaaataaataataattatcgtccatgcgtgacagatgagcgagccggagctatgtgtaatccccaaaacttgttcagcaacactactgaagaaaatgacagtcttacccttagcttactcattactttaaatgtataggcttaaggttataattgtaatttttctgaagttgtatctcacagctataaatatacaaacaatttcatgcattaaatacactttttggccagagagggaatcaaatcgctctgcctatgaaggcgtattccccttaccttcgtattgtaacttcaaggagccaaatatatttttgtattattttgttaaataataaaagaagggaggaagtaatgttcaataaggttgaattatgtgcttcatctttagatcatgcacgatctacctttatcgtcatttgcttcttctctgttaattctttgtcttcatccattaatcaatttcttatttgaaaggaatagactagaggatgaatatgaagcttgatttaattatgttgccttgtttttggtatctccgagggataaaaaagagtgaccaacaacccccgttgtcaaagtaataacgacaaacaaaagtattgcccatgtcaactagttatgcgttattctacaggcaaaactaaagcatctcctcttaggacgaagtttcattcgcatataattacatcagtaacttcgcagtttctacaactagtgga

SEQ ID NO: 1217 - DNA, 1594 bp, Zea mays
  misc_feature (1)..(100): optimal_loci_60041_G1, chr2:46731106..46732699, Cluster 7
tctgatgcatctggtagctagttgcgtccttcttcgcatagtatcgatgatatctagtgctttatcttatgcaccattggacacattcggtgttgtcgagcagcatgcgttttcttcatttcttcacatgtgtttgtccaggcttctaccatcttgtgacttataaacacactaagagtgcgttcgtttgttcaggattgaagccaggaatggttccaggtgattaaagcttatacaaattagataagcattcctggctggattggttctaggtcatgattgcggaacaaacgaacacgccctaaaacagtacaaaacctttgatttcaccgttgtcttatggggtttgtagaactcacaaaataaaatagggatgtagctagaacaagtttcccaaaacatcagaggccgggggttttctataaaacatttttcttacttgcagaatatttgatgtacaataaactagtcaatacagcatgtaaaaaaaatagagggagtacatgcaacaactgctccggcgacctccgatcccgtccagattaaactcacggagtgaactcatctgggtatagaggagaccgagccataagatgataagaggcccgggcgggcggaatccggagaggaccgttcagaggcctgtcggtacgcgcccgatcgatgggcatgcgcagtgcaggtgcaggtgcaggcgcaggtgcagatgcagtagcgaggtgaggagggcgcgtacggccatgaggaagttaaggttatcatcaggcagccatgccagtgaagaggacgacgggtggtggtccagtgcgagttgctcgaacgaatcagagtcgaggcactgttccgtgaacaggacacttcaccagccgcctgctggggaatccatcgacgggctaattatggagatgaacatgggctggtctcgtcgtctacggccggtctaccggcctcatctcttccacactcatgcatgcatgcgtgctacggcgtaggcgcgtcggcgagctcgcccgaggagcggtagctagagccaggatgtggacgcgcgcgcgctctgaacaggcagagatcagagacgacggtgatcaggattcaggcgtgagagcttttctacagcctatgggctagtataggcggccatactctactgtactgctgctgctacagatgctcagtagctagcggtcatacatgctctagcgtgtccgcgccgccgtacatgttcggttcggacatgtatagctactactacgtacgtacagagtatatactacgtatggtacgtctctctcgcaaccttcctgtagtatatagtatgtggctccgatccatcggagattcagaatcctgataggtgcacaaatctgtctgctcccaaggactcatgtacagtgctacgtgctgtggcagttgtgagtcctaagctcatacagtgcaaccgcaatacggcgggcgggacagcgctagctacatacacgatcgggatattcatgcaaatatgcaatgcatggttctctcttctcttagtaacaatatatatagatgttaataatgggatccgatacccatttacccatctagaattcctctgtta

SEQ ID NO: 1218 - DNA, 1578 bp, Zea mays
  misc_feature (1)..(100): optimal_loci_63010_G1, chr2:62491218..62492795, Cluster 7
ggggcacatgagctggcatactatctgtagagggccatggcagttggcaaaaatgcccttccctattaacattgcaagcttggtgtgccagctacactctattgtgggttgtggcaactctatgagtgaggaggtatccataatcggtgttggagacatcgatggatggatacggtggtgctcaggctacaatttattgaggctcgttaagtgcagtgtagtggggaaggtgtgatgatgttagagttagggtgaaaggggcttgctttgtggtcctttagcaagccatggtaggcacatggcaagtactattcctcctactaaattttgggtcatgtcgtgccacctagcatacctaggaagcatcttaagtatgaccctaagcatcaaactaggcccgactaggcttagtcaccatcaagtcgagtcatgcttgtgctaggccaaaaagacgagctttgtgtcatcccttcgagctgctagatgcatgtcaatccatataggagcgagtctattaaagggccttggcttggtaggagtgtgggcgaggctgtgcaatgagggtgtttcccaacatagatctttttagacatcatctaaggcatgataccaatatttgtgatattcttcaacaaaaatagctatagcggttgaaaagatctaaggacgcttagaggggtcaatagactattaaaattttctacaagaacaataacactaaacatgtttaatagtgtgacagacaattataaaagccactatttttctcccatattatatatagtgcatgcttccctaaacaatttgcaatctccacatccgatcccataaaatcattaaatttggcaaatgctttctcttttatcagtgatccactatcaactagatcgatgaagaatatctaaaatctgcttttggataagtgattcccttgtcactacattcttggatcccaccttaactccaaacctggtagcttgcacacaagttaaaagaggcattcttaacaacaagtggtgagctaacaagacctaacactaagctacactactgattagagagcaagaattaaagtagcaaccaaacaaactactagcctagacaaactactcaagcaactacacaagcacaattaatgaattgaaaatattagtgtagaaagagcaaccctataactctcaaatgaaaagaactggatcctcaccaatcccgacaaacacaatcaccaagtcaagcaagtgagtgagaagtttgtttatccttagggatgtatatatgtcaacatgtggacaagagatccactgacagagcaatcatctattcatataggactagcatatagcccatgataacactacgatcctatagagggaaggagaggggtcaacgatggtggtagtgtgaggggaggggttggcggtggcggcatgagtgggggcgagggttgcagggatgcgggggaggggaggctgggggcggcgaggtcgcgggggagggggaggtatgattcaaataatattgttcattggatttgagtgagtcagagagagagggttatccaacgatctaaaccattgg

SEQ ID NO: 1219 - DNA, 2511 bp, Zea mays
  misc_feature (1)..(100): optimal_loci_63068_G1, chr2:62717159..62719669, Cluster 7
ctcaaatcacagctaagaaatcatccctcacttaaagagtttggtatcttgatttgagaacaagggaaagggcaagcctaagccttttttgttttccaaaacatagtagacttaggcaagccttggtggcgagccaaaccacgagatacatatgtgtcttatgtgattcatttacattttgcatattcatattgttgagttagggtttgtgatcgatctactggctgatctacatactgtgatttatgtactacagacaggctagaaatttactagatctatgttctgtaggttatattttgaatttggtttaatcttccctacgtaggtcaacagtaccaccctctattctaatagaatctcaagttggattttttttacaagcctattcaaccccctctaggatgacatcatattttaggagatcctacacatatcgtgtgcataacactttggtgcagatattaaatcttgtccatctattatagatctaacatccttgttgtcctgtatatttcacaagaaagaacttccgccactactctccatcacttatgtagtacttggagagtatttttacaaaatatgtagatcagccaggaacgtaaatattcataaacattgtacgactatgacaccatagaagaggacagtcaagtgtttatggggtgtttgggactgttctaggtttcagctctagtgtggatactttaaatgtaaataataaacaaaatgacttatctaaatgttttctaaaggttcaaagcttcagctccataattttatcgagcatctaatgacttgcttcaccacctttaccaaattttctaaagctggagcagttccaaacaccccctatatatgggtgtaaggtacgacaacgatggaatagtgggagacactcaactatggatgtaaatggtatggatattatttgtccgtattcgaatttgatacgtctaaaagggctgagatcctatttgtatctgagtactcaatatttgatctgtatccgtatttgcaaagttggatatttaagacgtcgatatccattcaaatcttatctgatgcattgatattattcgtatcttatccgaatgcgaagagaaaatatgaaaacaaatatggtacaagtaaatccgtacgagtaatatccattcatatctgatcagattgcacccatacactcaacccttgcatggatcgcgaagaagattaattttgtgttcttatattcatcagctacaattatcactaaagataaaattcaactttaatttgatgttagtaggggccgcgagaatgcgtacctcttcaaccataaattttgacggccactctcccgcttagggagattgtaagcgagcactcctcctacgtgcaatggaagccagcctaggctaagcctcttcttgatcgaccatagaccccgtccagataagtatggatcaaggctgcacctggggtccactttgtagtcctccctgatgggcaggtcaagattagcaaaccgatacgggtttaattagttgatactaaacccctcgtcatcaactaatataatgttaggtcataatataaggcctgcgctgggtgaaagcccacccgtctttttggtacctggcccaaacggtgtattggatacttatacggttctacccgcccagattagcgtttgatgcacggagtactatttttttgggatgagtccagaaccaacgacggtcttcaacagtgagaccaagaaagaaagaacctgttgcggcacagaatagatgtgcctgtgatgagaatgaagtcgctagttgcggcaaggacagatcagagggcttcagatgctgggttttctgattgctacgtgatgagaaagaacagaacctccagcgcgaagatgtaggccctgcaggcgccccggggcctgacgctgctcaccgggctgctctgcttactcctgaacacccacatgccgagcgcagctcgctgggagaaacaaatatacgcaggcacacagccttctgagattttaggagccaggggcgagtaatgcgagcagtcgtgcacaatctgggttccccaactcgatgacaggagcaccattgtaaaaaacaaaaaaaggaaaaaggaaatcagatccactattcctctgctcaagaaagcctaaccagaaggataagataaagcctaaccagaagggtaagtggttttaacgatcacagggagaagagggagctgaggcatgaggcaaggacgaagaggtcaactgccattaacgcactagcgccagcataccaaacagatcctcctctgctccggaactaaggcaagaggagactagagaaaagaattgtggccagtagcccagtatgcatatacaaatacagaggagcactggaacactgctgcgtacccctagtaaagaatgcgagacccgttgagcctccaacattcgagtttctaaattagtaaggtggctatcccatgaattccgctaggtaaataaaacaaacctac

SEQ ID NO: 1220 - DNA, 1609 bp, Zea mays
  misc_feature (1)..(100): optimal_loci_75365_G1, chr2:143392005..143393613, Cluster 7
ctgcagcaggagccctcgcagctccggctcggccggcccgtccagctcctgcactgctgagtgctgaccaacatgtgaagattctccagcttccagcaggtacgtaccgccacagctgaccgcgtgtcttcgtgggcagcctggaagtatactttggacaatgacaatgtcagatcttccaggttttgtctagggaagttgttgcacgggcattcgtcgtcgtggtcgtcgtcacctcgtctttttggcccacgagccacgaaagctcacacattgttggaaaaagacacgaaattcgtgatggtatctagctagccaataacaataagctaataatttcggtcgacggcctaaaaacctttaaagattatccatttttcttgcagtgacacgaactgcggtgcaaatagtaatgtcgcctagcctaacactctcgctgccactcaactattgttttttatctgatatagtacgcggtactggaagttcagaaatctggaagggagaaaagatacggctattagcagcatcaagcagtgcgtaagacatgacagcagcacatagcaggagagcctgattcgaaaactggcgattttcaaacaaaacacgtcctccttcacttcctatggtcgtcacttcctatttcttgactcaacagaccttatttggagtcaatactgttttcttttgtttacatgatttttctatatgcatctaataatgggtgtgcccaatgagtatgtttactgtcttttccaaaaaaaaaaaaacagtattctgagttgaaacaacgacataatgcgcataaccgacatctgatgttgtgtttgtcagaaatgtgcggttccttcgaaatttggcgaggatttggtctggattggccccacgccattaaaaatggtcgctaaacatgtcttgagctttatacatgggaacccatcttctactgcatgctgcacccaattgctactcccttgtgtgccccgtgcggtcgtatgtcgtccccttcgttggtctatagctccatgttgcccccacggcatgcacgttcattgtcccccatcgcggcatgtgagccacccccaccacgtgcacatgtatcgcctccctctgcctggttgagctccaacgcccatgcctaggcatgcagtgtcttctagtgcctagctccccaaatctctaggaactagtgtcgtcttccatagcctgttggtttcagcgtgcataaacaaaacatgattggtcactgggcatatcataccactagtagtttaatctcctagtttgttcctcgatgcaaggtcgagattaacatgttgcttttagtttttaatcacgtgatctataatcgaagaacgtcgtatgtctccttgcgcccccgatcatgtagacatcgtcggccatgcacgccagcagccaacttcgtgccccacccatccttgttgccccgtcatctgctttgcttcaaggcatacaactttctctgtactagaattagaatgcaaatgttgtgaatgtgatttttagttgataattgttgtgaatgtgcttgttagtttttatatgcctactgaaattaaactgtgagttacactagatgcccgaaatt

SEQ ID NO: 1221 - DNA, 1772 bp, Zea mays
  misc_feature (1)..(100): optimal_loci_80379_G1, chr2:173768968..173770739, Cluster 7
gcgagctgacggcaccaggcacgagcaggccggcgacaggtgcagccctgccccgcggccgccggccaggcattgagggaggcatgcatgcgacggtgcatgggtcgcggggagacggacgactgcatgcatgcatgcacgcagcaggcgcggctcgagtggggactccgccgacgtggttggtcgaggcgctccccgggccggccggcgaccgaccgaccaagcgcggcctcaaagtgagcgccggcgcctcgcacgctccgcagaaaatcatgctgcctgtgtgcgtacgtattctacagttctacctgaaaactgcttgtgttctccctccattaatttccttagaatcagtctatggatcacgtttttttttacccagatccctaattttcccccatcttcctctctggcctctccacgcgcctctgtatcattcccgcgccgtgcgctcatcgatcgatcgcctagctagctagcttgctgcagcagcacgttagggactcgtcactgtgcatgcatgcattatatattgatggatgcatgcatatgcatctcatggcatacatgcgtgtctcattccagcgatctagaaacggattcgaagagagacagacatccctactatactttgcacactagtaagtgcctgtacgtatacgtacgtacatgcgtgcgtcagtgcgtgccactgtgcatgtcgtcgaccacgcacatacgtacgctttccggcagtagtcgtcgtagccgcgcgcgcgcagtcccctagctagcgaatgcaccctgtgcagcgggccgggccggccgggtcgcgttactattgggctagctcaggcgttcaggtcgtccacgcatccatccaattgatgatcgaccaccggccgccgtcgtcgggtcagtcagtcagtcgtcacaggggcatgtacatacatacactgtgctggttgccacctctacagttgttgttggagactacagcgcgtcgtcgtggctggctacgtactgctgcactactactgcttcatacatgaacagacctatagctctgtgtgtgtctatcagttggtggagtagtacgcgtgcctagctagctacctctgaggagagacagggagagagtgagctgacctactagcttgtgtgtggtgtgctgtgggagcgagtgtgtgtgtgcgcgcccgcgtgagagaacgagcgagcagatatgcgcctagctgaacgcgctgctgctcgctgtgtggtggctagcgtggtcatgtcactggcagcgtggcacgcacgacaaggatactgttgcccgggccctcacagccctctcttcctcgatctgttgttgccgcgcgcgcgcacatgcatgccttccgaattccgatgtgcactgcacaccaccgtttgacaacaaatggatcacacacaatcactcgaccgtttctcactccctctccctctctgcagaaagtacactaccgtcacatcgtctttcgtcagagccttggtagggtagctcatcacacacagctgagacgatctttactttctgctctcaatttgttagcagcacaatatacttctataagttgatgaacatatgctctcaatttacattggctgcactgcacctgcaccggccggtgctccagttttggtgaacaacaagcgcgcgcaagagcggctggctgcgtgcatggatgctagctagctccaagctaatacatctgcatgcatgggcacgcacacagccttgcataacattacgccttttttaaacctgt

SEQ ID NO: 1222 - DNA, 1833 bp, Zea mays
  misc_feature (1)..(100): optimal_loci_81775_G1, chr2:180532393..180534225, Cluster 7
cgtgttgggtggtacaccaaacatgtgcactagatacatgatttgttctctcactcactatagttttcgtccgagtaccaagaggtccaatgtgcacaggatgtgcctaaccagataggagacacagagagtagtaaagtgagttattcaactataacatgcatcagacgtgtctggtgctagcacttgatgccacaccgaacaagaaactcaaagagcatttgaattggtatttcagctctaacaagtatcgaacttgtgacaagcaataatgtctagttttgagctgttgggatgtaaccattggagatgcaccgaatgtgtccagtgcgatcatcgatggtccaccagttatgtttgatgccatcacaatcaacccaccaagaggataacaactatatttctttgggattccataaatagatcttgtggcttgctttggccatactcttagcatcctatacacttgtgcacacctcttgagggatgagtaacacactccacgcacttgcacctcttgagggatggtgaatcacatttagtttatgcatcttgtgacactagttgagtgacttaggctagttattctcttgttactcttagtgattctcatcacctagctagtccgaagtttgtggaatccctgagaggctactggagattgttgccaactccagtcgttgaatataatgggctcttatggtcatccctcactagagattcaaaaagagcaactctagtggaattgtggatagttgtagtgcctctctagtgtggttcttacgatgccccattgttgggatggcatgttatatcaattattacatcaaccacatagcttagactcaccacaatgaggacacaaaccaccaacaagaaatcaaacctcgggataaatcatagtcattattcttttgtcttgttaggtttaatcgctatcacactttcatttatattcatatgtttgtcttgagtggtagttgcttgagtagctctagagtagcttgtagttgtaactagttattaactctctagtgtatttgtgtagttgctagtttgtgtgcttgagtgaaatcaacttagagacatagcaactagatttgttcaaggggtatgcttgttgtgaaatagatctagagcaagaagtagcattaacaccaccttctatactaattaaactttgttgtagtgttttgtggtcatgtaagaaatttttataggctattcaccctctctagccatttaggtactttactaaaaaatgttgcatattttgatttgattacctctcttcatgtagtttataccaaaaaatgcacataaaatatcaagagaaaaaaatccaagaaaacaaagccatctaacaactctagacataacatagaactctagatggcattggaaaaaattccttcttatttctcattttaattttattatttgttttcctttcaaatttactagagcatcatggtaacaaatttttttcaaggttaacatatgagaaaatccacaactaattccattcattcattgtgtagcagcctaaaatagtgtgttctgcattttctactacaatgtaatgtagaaggagacagaaaaattgtcaataagctatgagcacatcttttcattggtcattaatggttatatacacacacaggggaagaggagattctaggagaatggcccagctgccatatcccaagatgtgaattgtgcacatatatgtggtcatgggaattctagtgcatgagaggaacttccacatactacagaacatgagatcgtggtttgactagcaagatatttccccatcgatttagtctagat

SEQ ID NO: 1223 - DNA, 1435 bp, Zea mays
  misc_feature (1)..(100): optimal_loci_83489_G1, chr2:189846504..189847938, Cluster 7
atgccctgtactgtactactagatagctcctaggtcccataacaatgactgtctgcacagaaaagagagctgtgtcctttgcctgtactgtactgtacaatgccctgtactgtactgtgctgggtttttggtagctgtgtcctttgccttttgtctctctccgacaatggaccggtttccagtacttggatggatcatgcttgagccagcaagaaatccatttggaacttggcgattcacagtcgccttaacctaccactacttaactactactacgtactactgttgctagcccctgttaccttagcagttttgttgtgccaacaaaacgattcaagaaccagtgccggcgtgtgagagaactgtttcgactgcagcagtcgattcttcttctttttattttctcggttctgaggccaaggccaaacaatgcaatggatggaggtcaggtcaccagagtccatcgtcgtgtcattgttcgcctacagtacctggactgcacgccgtcgtacagtggtcccgttgcttcctcgccgtcgcgcctccgctgccagtgccagtgtcagtgccaggtgccagccagctctcaccgatcacctcaggcctggcctgtggagtcaggaggagcgcgagcgcccacatgcgcgcgtcgtattcgggcaccaagcgtgttccctttcccatctgcgtgacgtcgtgtacaccgcccgggcagcagcacggaatctaatcttgcggctgccgctgggctggtgctggtgtaccgcctccggctggctggcgggcgggcgcgctggccgcagctacagagacgcgacgacgacggcgggagatggggagcagcgagagagagagagagagagggggccgccggccaaggccgacgcagctactgccgctggcactgttgctgacgctttaccggcggtaactgtgcgccgggtcgttggcgcacgtgggccgcctctgggcgccgtgccgggcccccgcgcgcgtgctagcgcggcactgtgcgcatgtgacatgggccggggcgcaacgagggcatcctgttcctgcgtgcctggtctggtctggtatgcctctgtccaagcgaggattttgacaggccggctcggatatccaaatgcatactgttgtgagtacacagtagagtaaaaccacaagtgaagtccaacttgtttacgatcgagctgtagaaattaacagctctcaaccgctgttctttccatggtaaaaccagcctctgtcctataattttgagagcccatatacgagctcattgtgatgagtcttctatagtgtataaattttttataatatatatataaataatatgtgtaaaatataaataaataaatacattgatatatattcaatttaacatgtctgataattatcgataaataaagtcgaccaaataacaatatattta

SEQ ID NO: 1224 - DNA, 1884 bp, Zea mays
  misc_feature (1)..(100): optimal_loci_85048_G1, chr2:199366640..199368523, Cluster 7
gagcaccatccattcacacgaagacaaggttcgcgggctacatagacatatttaccaaagagaaaacgatcagaagcacgtgcgctgattttatattgaattgaattcattcacaaggcccaggtagcaatagcaaagaatagactgcctgttaccacagccacgccagcagcagaatatatatatatgcccgcacatgctgacagccaaaaacctgagaatattatatacacaaacgctgcaacagctcctgaaccaagcgtcacaaatgtcttccacgcaacacataaggcatcgacggtcgaccagactctcgatgagatgtatggaccttttcgagctagctacagaaagtcatcaggcatgcatgtggttaaggtctttcatgtgcatgacaaggaggatacgggctgaaggctcctgctttagcatgatattgagatgcctatggcggtggcggcggcctttggctgataatgttcatcagtgtcgacttcttcaatctcctgtttgtgtgaacaagcagaccaaaaatacaaaatctaataagcaagcattgaagtgatgtcataccatacgtagacagcccccgacatgtgcatatgccaacatttcatctaaaaaaattgtgcatgtgccaatagtccttacacaaacgacatccaaatttgtgaggctgttcccattgttgcagcatgttatattcctacataacttggcattttaaacacctgctaagtgctaacctacataaattgagatttcaaacatccatttggggggctcagattctgaagggcaagtatatgaaaacagagttctccctttgtcgccgaacaaaaaggttcctcagttctggcagcgtctacaaagaagttaaacatcttttcaaatgggagacaaacttttttattggaatggccagcatatatatcctacagctctactactttgacctatttagattatgctctgatcctgatattctagcacctcagttgtatgacgatggtgactgttcagaagtctccgtggagcacaggtggagctcctggagaacttgggagctcaacttgattttgtgtgtagataataggaaagagggtaaggttatagagtttagataaatacaaatccaatgctatactactaaaagtccctctatagattcttaactgatgtaggagtgactcatattcaggcaagggcaattttgagtacaaagtaccaatgagaattaatgtttataaggcaattgtttcacagaaagttacaatctgctgtgacttcaagaagaggagtttacattttactgttgtttatgtggtcaacaggaagcagtacgccacttttttgttgctctgtagcaaaggatgctctggtgctgtctaacaaattcgtttggctggaatggtttcccaatctcaagagctgactttaggagagttggctccaaataggaacggtgtctctaagcatggcaatgtttgttttttcaggtttcgcttgggcattgtgaaataacaggaacaagatggcgactaaacacaccttcccaataagcctatgggcatagtcaacactggtgccgctttcttgcagaaatgcagaccctgcagaaggaaaaagactgcgggatctcgatgttatgacggagaaactcctgagctagctgcatagctttagccttcaaatgtgccaagctcagatgtgggagagatttaactgtactattctagggcagcttcttgtattgcttagttttcgtctcttggccgcctagtgtttcttgtacccagttcctgttacgctggtatccccagcatactttcgcctgcgcacagcgccccaagcgcggccgtcaccgccgctatttctcgtgca

SEQ ID NO: 1225 - DNA, 1667 bp, Zea mays
  misc_feature (1)..(100): optimal_loci_86985_G1, chr2:210633586..210635252, Cluster 7
aaggtacgacaggtgataaaacgatatatgatttgtgcatggatatgtacttcagcttgtgcaacataagacaagtaagaaatttaattatctgcgtgcggttattaatgtcttaaaaattttaactctcgtggcaacgcacgggtacatatctagttaataaataagaacatgtgttgccgtcgtcgtgctcccgtcgtggattcggatcatcggcagctgcgcgcgcggatcgtcgcgattcggatcaaccgctgtggaaaacacaggggatgcttggaggtgcagcttgacattttggtttcagatataaatatatgcttgtgtggaatggatttcacctacggcagggcaccctcatcctcgtagtcgtacgtgtgtgaactgtgaagtggtttcctgtcgtcgtcacgggttctccttcagctagccggcatgctttcttttttcctgagctgaactctctgtggacaatcttgtttcagaagacggaaagcattaaccttagcttctgaataacacatgtatttttttttaccctttctgacgagcgagagcggcacagagaaagagaaaggttaggtgatggcgccgaattgtggtcgttggtttctcaatattcctccctagctaaagatgaaagacgtactgtcgggcagctatagctaactacagatgattagttggcacgtcctagactcctagctatagcgagcattattcattgcttccagtggctcatcctcagaaagacgtgtgatcaatcatgggcccgtggtgcatatcgatcctcacaaagaattatgccattagctatagcaagcaatgctcgattggatcctgccatgaagaagaaccttacggcatgctggttcttcagtgcacacacaggcatctggttcttcgaactggccggaagcaactcactgaaaatcatgcggtggttcaaccgctaaccagcggcagagagacatgcgcatgcacatacagaaatactatacacatacatacctgccgaagcttctaactgccgccgtacgtccttgcattttcttcagagtagatattagtgaggacgacagagacgagcagctgagtcgatcaggttaataaataaaaaaacctacagacgtgcatctactccagacttcacatgacccgcaacaaatgaaaacaagttcgacctcgaggtcccagccaccacctgagcgagcagtttgtggtccaggaatgagtgcgtgtgcgcaacgctttgggtgaacgagaactgcatctgcaagcgtgtgcgcggaaaggcgccatcgattaggagacttttgcactgtaaaatgcttatggtcgccgacgattcgcatcgagctgttcttttagggcagagatcgcacgcatgtgacatgcaatgcaagtggggtcgttgcggggggcagcggctgagttgagtacttgagtcccatctaccaacagcaacaggctcgttcgttcgtttaaaagtttgttaagctactgaagaatggcgagctcatttgaatcaaaatgctttagtttaatgatttgatgatatgctacactagcctgaggtttttaaaaggcttgatgatgaaacaattatgaagcggttctaaatcaccaaaatacgaaggacgaatttgctgattcttaaaggactt

SEQ ID NO: 1226 - DNA, 1474 bp, Zea mays
  misc_feature (1)..(100): optimal_loci_899_G1, chr1:4730112..4731585, Cluster 7
cacgacaagattagcggagggaggggagggcgagggcggagccgtggtgaagcaagtggtggacgcccacggtacaaaactctacaacagatggcatgtatgtttcatgttattatacaattatattcgattagagaacaccatttctctccaccgctttttcggtaataattgttgcaatcaatcatcacatatgcacagctgaaggtcagaggacaagcaagcctgcactgcaaagtgcaatccttcctttgaaggtaaaccaaacaccgcaatgacaacattggctcttcaactactgttgctaaacatttaaaccacaactaaagcacaatttgaaggcgtctgcgatagcatctcataaatatgtagatcaaattactatgcactccatttctccaacagaaaataaaccattactggtcacctctgcgaaggcaacataaatgtcaactattttgcagagaaagcaagagaagctcaaactcagaggacagtgttggtggtaaccaaccagaagtagaatgcttagttaacaggataaagtaccatgaatagtaatacaaaccatttcgtttaactccaatgtgctccaacgtctcttcgatttcaggttcaagataccttagtccggttaaacattgtatagaaggtagcaaatccatataccctgattggtgcaacttcgacaattttagcaatctgaatacagagaaaacattgtctgaagtacaaaaaaacataggaaattaagttttccaaacatggtgacaacagtttgtaaacagataatagtacacaataagacctaaaaacaggtgccacaagcaccaaaccggaacacatgtaattttcttgcctctaatttcattatacatggttggtgctatcctgaaaaccttgggtgcttatcacttgatcaatcgtcttgctctatggggacttttgctcacctgccagtcacctgcaatagtcctcaaatatcttatatcaacttaatgcctcaatcacattctcagggtatgtttacgttcattgttgcaatagtatgggggctttacaaaattcctagatgatctgataccagacatctacattcttactatgacctcaaagtatgtacaagcagacagtttcctagcaccagcagcatgctttaattgtgacataggagaaaggtagctcattaagtaaataaatcataggagacaaaacatgttctccacctggttccacctctttgaatttcaataaattgaaaaaacatctgtgatagcaaaataaatatggagcacaatatcactttgttacagtacatgccaaaagtccattttactatatctataccagaaaaaaactatgattccattgcgacatggaccatggtagattatatttttgggtgttgaaggctgaaacaaaaatatccacatccaaataagcacttaccccctaatggatatcaatgatctag

SEQ ID NO: 1227 - DNA, 1430 bp, Zea mays
  misc_feature (1)..(100): optimal_loci_90017_G1, chr2:226638869..226640298, Cluster 7
cacaaccaaaaagttgcttggatttgaaacaatcacatgatataacacataaatcctaaattacttaaactgccatttgaacagcatgtaaacagtaaacaaaagttgctatctacccagcacacaacaaaatggaactgcctggtattagttggttctggctatcttttcttaacataaacttaactcttcattgtgcaaagagatgcactccaacatctgatcttaacagaactgtggaaacagtttatgcatccagtggactgaaactgaaagcgaccattgtgaactctgaaatatagtggcagatccagatgtggtaacgaatttaattcactggacacagtccgtcgatgcaacaccatcatttccaataacatgctacagtcaatcctaccagaatgctacaacagcagattcaacacacgaactggacgaaaagaaactccagtcgcttagcaaaatgccacggaccacacttgtaacacaattacacaatcctatacggaacggcaagcgcgcacctgaggtagacacggccgccatgtggaggtcgttgcccttctccaccactacctccatctgcccctcgtcactgcctccctttctctggagccagtagatatgtgcaggcgggagctagttatagagcatatttcatgtgtcgttgatatgctgtcgtactgtacgcttgagtgatgcatatcatatgatccagagttcccactctgaacatgcaagaaaccctatattgtgggggacattttggtgattggagaagcagcaggtaggcatctgttgtccttggatccagaaaacagagataactataagatgctggctggttttatgtttcaactgggagaaccggagaagtacaaagttgtcgatgtcaaaataactggacttgagactaggctgtagctggactgaaggtggctaaagattgcaatacatgctagaaggtatgatttcagcatgtttgcatgttctttaaaaaatgattgcatcaataaatgtgaatcaacatttgaatctcagttggaatttcttgtaccatataaagatcacttgtgttaatataaagcaaaaactcctctagtatcatttcaaacttcaaaattgtaccttgtctcacttaccatgtgggtcctactgtgatcatgcaatgcagcccactgctgaaagcctgaaatggatgaagtgaagggacacagtttactaatactactaatactatacgtggaatggaacatttggtattcgattgaacaactggtaacaggtgtaaagctccaaagtatacaaagagaacaagaagagggcgagctgttgccatagacaatggtatctctctagagagaacggtaagcgacagctcttgggcttcattggaactatttttttaggaagtgatcagccgttgcaac

SEQ ID NO: 1228 - DNA, 1450 bp, Zea mays
  misc_feature (1)..(100): optimal_loci_94193_G1, chr3:10468903..10470352, Cluster 7
agtagtgtttggatagagagacgaagaaggatgaatagagatgggatgtgatcattctaacttgacccgcgtctggtttagaggtccaaagtgagagtcaaggaatattcttcaaaattggtcgatgaggtcatccctcaaaaaaataagggacgaaatcagtttaggattaatcccatccctagttgacaccgaaccaacactaactaaaacatcgtagctgtccacgctgaggagagttggggacgagggctgcccgaccgagtgacgggtcgacactagggcgaacgggatcgcgcttcgtgggctcaaacgagggaggagctgatcgtgcgtgcgcccgacgctatggatgctgcttcggcgaccatcgctgtcgaggatacacatcggggcacgcggatcccgcacgtcctgggcacttgggggcggtggcagcatgcttgcgttgcgttgcgttgcgtgcatgcaatgctgatcgactgaccacagggtggttcacaagcattgaagggacaggtgccgagatagagcaacgcaacgcaccgacccggccggcctcgtcacctcgacgacctaacgagacgctggctggcaggctgcgtgcttgccgatcggcattacacagccgtttcggggggcgggcgacgactcctccgaacaatctgtagcacgtgctgcactggcgctgcgaccacaaatggtgccggacccgagcggtccactctgggtaggtaggcagcaggaagactgaccacgcgttgcttcagtctttcggacgagagacgatctgcaggctctgcccaactatactatagagctgtgttgggtgggtgggcaggccgggctggctggctggcgagagcccaaaagccatgcctgccgccgcgaccggggttcggtggtggacaggagaggagcgcgggcgcatggccagccaggcacgccccagcggcgtgtaagcgacacgtattggcgggcaggcgggacgggacagcccgaccccgaccgagccacgccgtgtgggcgtcgtctcgtctccgtccgcggcagagatgacgatgagacgagcggtcgatcgaccacgccagccacgaccacacgacgcgaccgcccggacgggacgcctgcggagcgggagggcatgtgcccccccctccctccccgtgtcgctcgacagctcagacggcaccggatggccatggccggatcagggtccagccgcagcagcgcgggcgcggcggcgacgccgtcagcgtcggcgtcagatcaattcgatcggccagccagagcgatcaccctgtctgtgtgcggcccggccatgcgggcctagtatcgtgggcttgcagtgcgcggcttttggtgggcctcactcacgttttgctttgctttccagcccacacaaccccgctgaacttgtgccgctccgctccgcatcaaccggccaact

SEQ ID NO: 1229 - DNA, 1560 bp, Zea mays
  misc_feature (1)..(100): optimal_loci_94205_G1, chr3:10528400..10529959, Cluster 7
agattagaaacaccgacaagagacaagcttgcctccaagcaaccaaggcagcgaggacacgagatagaaacgccaagaaaagtacatcatcatttatacagtggtgagtggataacccaaatgtatataaaaataaaagaggtctagtttattattttttttacctttctcacgagacacaagtaagcgagagccttcacaaatccaaaagcatatgttagacaaatcctgtttcatcaagagtaagcgagagccttcactcttggtaaaacttttatttggacagttatgtaagttttctttagagcaaggatgtattgttgtagcaggaagaggtgtctctctatgtttggctgacgatattcgtggtcaaggtctcaaggagaagatttacacagtacgtggcccctgaccgttggtggactgggcagggcagggccgtggaggggggtggggttctttacgtactttttctcctcttgacacgagtcagtgcttagccccggccagttcgtcccgtgaatatcccttttgtctgctgccacgtccgcgcgcgaatattccttccctcccccctatctctgctttgctgccatccggccagtttcgaacgtcgagccaaagccaacacatactactgtaccgtactgtgtagcatatagtacataaacaagctactctgatactgaactgagtttttatgagctcttttcagacaatatacacatacacagtttgctctttcgttttcatcttcagaggaatgcacactcatatctactaatgaaacccatgaacaacttgaagggcaatgcgaaaaacagacaagaggaaatcagacagaggcagcgtgtgggcctgcccgctagcttatttattcgacgtcatggccgccgagagatctatcgcgaataatgagtgtgccagccatgggctaacactaacagctcgccatgatgcgcacgtacgcgcagtggtgggtgggggtggggcgcggtgcgggttgccgattcccccaagccaacgccaatgcgagagcagacgaagggagggaaggggaattgaaggggggaaaaaaaaaagcagcggcagcagaagggattaggacgcagcgagaaggcgtagtagaaaaaagaacggccggagctcttcaggaatctaatgggatgctaattgtctccctctccctgcgttaaggttcaggttcttggagtgaagcaccccaccccaccccgcaaatccttgcacgcaggcacgcagctttgagaagctagctttccgtctagctagtggacgggtccgggaccgggaggaaggaatccgcacagaaaaccatatcgccttggcgcgatccggatttgcgccgtgaatgttccgttcctcctccctatccgcctgctcgatctggatgaccatggccggtggtgctagctctctcttgagctgctgttgctccgggctgctagctactgccgctcgttcgttcgatcgtgcaccgccgaatcgttcgtgccgtgtttcctctttcctctcaagttcagagcggcagtagggatgaag

SEQ ID NO: 1230 - DNA, 1882 bp, Zea mays
  misc_feature (1)..(100): optimal_loci_94271_G1, chr3:10947994..10949875, Cluster 7
gttcttaaaaattagttcatataaactaaacacctcctaaatcacatggcttgcactacttaaacggcgtgtgttttttttggttggagtgagcgccgatcgagtggtgcacggccctattctttgtcctccttttgctttcacatgtttagaaaaaaaaatgttttcttcgtatttgaattattagagttggcaacttctttcgagtccttagcgggatggagtatcgatcgttaaccgaagggaaacgacatcggcaaccggcatacacatcgcctttcaagtccgcagcgcgatggaaagggacatggcgtgctatcgttgccggaggaaaacgatggagaacgacgagagccggggaaggcgatgatgcccccccgattcgatggttcggcggacagacagacaggccaggcacgccaggccgcgcgccgccggtgacgggtcgcaggcgcgcgtgtgtcgtctgagcctctcgccgtcgggcgctaaggaccgacgtccaggcgttccaagtcatgaatgagatcgcggtggaccaagatggcaagatgtttggaatctaaagacggggacgggccgcgggcgatgggtcgagttggctggcgcgctggtgcagacatgaacgggaacggggcacatcgccgaacccgcgcgctgccaagacaccctggacctggttggcatgtactataccttcctggcgtggtgaccgagaacgcaatatctgctcacctctcggctctcgcgtcgcgcgcgagcgcgcgccacggactagcgcggcagcacggtgacaggtgcggtacagtacagagcataaaaaatctttacagaaaagaaagagtacgtacccctgctgttcgtgtatgcgtacagtacagaacataaaaatctttaccggaaagaaagagtacacgtacccgggctgctcgtgtatcggtgtatgtgcagtacagaacataaaaatcgttacagaaaagggtggattagagagtgggttttacgaaaagcatttggtccacatctctctaaaatgtattccctaaaacatcgtacccttgtgttacaacggagtccaatacgtataagaatcaaactctataatattactacatgcatgcgagttgttctaacgtcgtaaatctcgagatatgtaaagaacgactcgatgcacattggaatcggagtcgtatctgtcgtcctcaacaaacactagagtacataaagtactgaaaaaagagattgggagaaagcggggcatatgcaagcagtgtgtgaaatctaggcacgtggacaattaggagagattcataatgtaatgcgtataatacatatgtcctcttcctacttaacgattgatgaacataatagtgaagaagattacaagctcatagcacaatagagcattacgaccgcctagctccctccaacctctaggttatatggtgagagttatagcctactaatcgtaatctacctttatacatgctctatgtgtagagtaaattcttatgtgtgtccgatcatgaaccgaactaactggttgaactgaagttctctaccacgtgataagattgaaatccctttcctcgttaccttgctcccccgtttatagtgcaagagaggagagatgtcacattaattggaccttggatccaaccggctaagacccaactacatcgttcttatcctattcatgaagtcatacatggacccatactctcattatggtacatgccttacttattgtgagggtaggtataatgtgtcgtttgcacgggcactagggcccatgccattggatacgacatagttgttgatatgtatagccttctatacttgataacactttatggtacattgtcatgagcatgcttggcta

SEQ ID NO: 1231 - DNA, 2729 bp, Zea mays
  misc_feature (1)..(100): optimal_loci_94326_G1, chr3:11230027..11232755, Cluster 7
ttctcatcccacaacttttttaaattttcaataccaccacttctcacatgattctatctcctagcaaaacagcacacttccacacgctcaaaaccgcaggtgccatctaaatattatttttctcatcttgtaatctactgtcctaacaattattgtggtgtagcaacatcaggatactgtagctacccaaatgtattgatgagtgaaggacagagcgagggacacaggctagaggcacgctgatcctggatactgtcaagttactatcatacgagagatttataatgcttgcaggtatattgccatagtgttgagatcgtcttgtacatgtactcatgctgtaggggttgatacgtactttcatagtggcaggacctatgacctaagatcacaccatgggtacaacgtagttgataaacggtgtagctgcttgcactttataatgcttgcaggtatgttggcaaattcaggcgtgactacaaggacaatggcacgcactgtacaatgatcccaggtacccttgctatccattgttgtgcctacagggacaatgtacagtggtcatgggtacacctgctacctccgttacggcaacagtgcacctctttgagcataatgtctcatgtcacatttaatatgatggaggaagccttatcttaacagctcagcacccggtggttgtcctaggtaggggtatacatggcaccagggttataccgctagggtcgtcttgccctaagggcttcgattaccaagttgtggatgtagcctacaggggtccttacacttggcagaacagtgaatttgatttccgaccagtagagccctgaacgccaagagagtcctaaaggccaagaggttcttggatctggtctttcgacatgggggcaccagacttagctagagccgccgggcatgatccctagagtacgagatctctgggacacggggctcgtatcaacgccccccccccccccccaccttcaggtttcttgtactgatgtaatcttcagaaggcatttgaacaatatgcggagatatgatttttcctagatgctaacaacaattattcttaatcgtgcaggatccaagaacttagggcttcccgtcctctaatctactagttcaatatcgtgtgtcatagttatttgccttgagctcttctacatgtcactcattgccttgtattttaggagatttttccattaccatgtgagtcaatggtatgccaaataagttaatcaaatattcaaatacgcatgacttgaatgctctgccttctgcaaccatgcgtaattaatttaagaattacataaactgaattcatttgcataatttcaggaataacagatggtaaccacatggacagcagccaagcatcatagaactattctgcattgtgtgccatgatattaaaaatggtagattccatacatataagaatcttagacataattatcagctccattcattcaactaatgaggattctaacagagtgaactgtttcatgcttaagccaaatcaactaaatggattttctgtttccattgcatgccacacacaatgtttcagtttgttaatcctattgagcaagattagggagcaaacacaggccccgcatgtttgcgattcgactccttttgtcagtgcatctgtttgcaaacagttaggagcctgtagttttgccgataaaggcagcatattactatgtccaagacaagagaaacccggaggagactatcaatgctgaataaataactggaccctggaggcaatacagtagtttcggaaatggattagtgtaaccatacccttctaagactactacttaaaaacgtgcaatattatttactactcccgaaaatctaatagtaataaactaagcagctgcttgaaaaaaacaactaatcgtaaaaatgaggacctcagctgaggccaccagattaaaaaaccaaaaaaatgcatggacgcaaacaccacgtaactggtaagtggtatgtactatgtagcattcgatttctccgcgtgatcaggaaaaccgagaacagcaatgcctgccttggcataaggccgaaagcgtgatgcccgtagatcctactgtgcacccttcgatcggggcacaatcggctcggttcggcgcaaaattgagcctaactttcgcagagaccggtaaccccacacccctttatctcggcggccgcacctggcgccgctgcagggcacagcaaggaggaagatacagccgccctagggagggggcgagcccgccatatgacgagggcaggaatctggcaatatccaagcaggtagagacaaggcgcaggcgggaatgggaagcgaacaaaaatccaggcagggaaggggggcgatcatgtaccagcgcctcctaggatcgtggatcttgtcgcggcccgcttgcccttgtcatcatcattcatctgcctcccgccccgcgtcgcgtggcgtacactccgtacgcgccgctcacgcgatccctctcactcccaatcattcgcggcggcgtcgtgtttcgcggtgtcgccatcgcctgtttttttaacctcggtttgggcctttgggagcggaacttgaatggaggattggaggctgggtgcagccacagtgcatgacacctgtggatcgctgccgccgcggggtcggccggtaggacgagagcgttttggaaggccgcttggttttggtgcaactgccaaacgtttatactgtt

SEQ ID NO: 1232 - DNA, 2790 bp, Zea mays
  misc_feature (1)..(100): optimal_loci_97752_G1, chr3:30045047..30047836, Cluster 7
cgatccgtgaatgcgaccttaattatttgaattgattgtgtccaatgtcacggggatcctgggaatgtaagttttcttgtcaggtacattctaggtgccgtttggttcacatattgttaacgtaataggtaaccgataacgttaaatcatgtttgtttaagtccaaccataattgataccacactacaaatggataccgtcttattcaaatttgttaccaccggtattcgagtgtgaatcgttaacattaccatttattttatatttcatgaaccaaacgacactctagacgtatccatattgtcgatttcgtcccgcacctaccaaagagccacacaatgcaattgattagatgtaacagcacgtcacttcaaagttttgaactgagaacaggacacatgcttccaagttgcaatcttctgcacggcctgacaccgcaaccaatcgattcttcatattcctgacgcgctccaacatcagcctgctaacttttctaaggctgggtaagcttccttctccagagtcgtgtttcgctagctccgtcgtgtggggctcccccgcggcagtggcctgcaccaccagccacttggctcttcatggcgctcttccgcccgtcatgggcaccgatgatggtggcagcttgcactccatggcccccggccgcctgctggctcgtctcgtagtagtccgtggcgaagctagggatctaggactgtaccagctagcgttggtgccgacccacgctcagaatcagccgatcagcggaggccggcgggctaggttgggtcgcgctcgcttgctgagggactacgtcgctgggatcgccctctttctcggagactcgctttggttctagagaggataggtcgctttggttctagaataatcgactatcatcgagtatgcgacaacaccaaggcgctcgtccggcgagggcagttgcatgaaggaaaacatgaaacggttttcaccgtcggaattggatcggacgaccaggaaaaaagaagatgacgtggcattctaagctgtgagctatgctccttcgcttaatatataggaaggaatagggttgtacactaccggcatagtattctgcgacagtaaactgtgtgctttgaacctggcattcagcaggttaattaccagctgtgtaggtaggagctactaccgtgtcgcagaagcggttcacatgcatgcatgctcaactacagcctacaggagaggagatgaccgagtggcgcgggcagcaagtcatccgtgtgcgtcgagacagtagtagtcccgtgcacgtagtacgtggttttgtctctgtaaaacagggcggaaacgagcagcggccgggaaaaccgggtgccagccatgcaatgcctgttaatcaagcgtactatactaccgctggctaacttcttttttttctctttgtttttcttcttataaaaaaaaaagaagaaaaaaagtaccgggtggctctgggttgtgcgtgcgactgtaccccggccccatctctgccaacttggcccgcaaataccatcgaccatctcgtggtacgtactttaggcccggtgcggccgcttcaactgtttgagcaagcgagcagcagagcagcgcatccatccgttccgtcgccatccctcctcactccgatctgttcaaagtagcgccgccgctgccggtcttctcgtgaccacgggctctctctgtacagctagctaaaaactttcgtatccatgtcgttgttggagtagccatcccagtgatccttattcgctatggctggctacggctttaatctcgctatgactactacttatacagtattttatctttatagattatatctgtggtagtccgaacagctataacaactacgccatgcaccaccgccagctctcgacatggcaacacgtacgtacgtaccattacgcgtcgcaagcattaactacttaatctggactagtagtagcagtattgacgatgatgacgacttgatgaaagatcaggcgggccgcgaaccgcggtgcgttgcgcttgcggtgccgcgccttcgccctgctgcactttccggtgacccttttgtaggagtattttcttttagctgcggcgcttccgaaagcgatacccccatatgcatatgatctgtgcgaccgtgacgaccctgtccctgtctgtcatcgatgagtcgtcgtgctcttcttctgtgtggaaaagaaagaaggcccccacgcgctcgactacccgatcaatcacagactccgcgcgcgttcgttcgtttctcagagcacctttccacgtggctcagttctatacgaccgcgcccgcgttggtggagacgatgctgcagacgcgggtggaggggccacatgtcacactcccacttcagacagcattggcatctaatagaattacatattctaatatatatatatacattccacacatatatgcactggtgtggtgtgtagcacacactcataccatgcacaggaaaggtgcaggtaacatgctatttatattttttgggtatcaaagttgtcttcgctactatgcactatatataaacaaagaagatgactagaattgttatttggagacaaaaaaaaaatttccaagcgctagtaaacgaatcaaatctttctatttttttccataaaaaagataataagaaagatcatacaaacctaataagagctaaatacgtctgtttaaaattaaaattgatacaagattgttaactaccatggcaccacgtggaattgccacgcctggtagttattgcaggcacagatgcag

SEQ ID NO: 1233 - DNA, 2241 bp, Zea mays
  misc_feature (1)..(100): optimal_loci_83937_G1, chr2:192746622..192748862, Cluster 8
acgcacacaataaatttaatccagtctacaaatgtcttctccttcattttaagccttggggtttgggaaactggaatatataggacatgcttttatacgtgccctacaaactttactctgggatgatgcaggttctaatcacatttggtcgaaccaaaagcttgctcaattgaactagagtggtatttcacataatttgggtgaggggagaaattaaatagaatataatgacatttaactgtaattagttaactcttttaatttgtatgtttgatgtattttatcccttctagctgccgtagtgtccatttcctcaacagctcaacattgaaaaacgagacgaggcacctaaattgtgtgcacacactgtgcatgcaatcacgctgctttgcaaactcttttgcagtctgtttacaagggtgaagtcatatatatctgcacagtagtgccggtgaagcttgacgatggctggaacaaaatctcgctgatgtgacaaaaagggtgtatatatatatgtgtatggcacaaactgctacgtagagacgcgacgctgcgggtacaagctcatgcaaattaaactgctgacttggcagaatttacttctctgaccgcttctaatcggaggacgcgcctgacgaataattcaagatctaccttccaatccaagtgatgagaactcctctattcatgtactgtatgtatttcgtcgtaaaatatttcttagctgcttaccctatctcctgcatctcctttttgcgagaaattcacagagggcgtgcatggagagagacttcggtcgtcaccagaggagacatatacataatactaccattattgtgaggatccctttcgcataacctagctagctgcacattggccttcctgatgagatccagaaatttggcagaatgtttctgttagtttcctgactgattgttgtgcgctgaatggttaggctcttctcgatctgttcatagcatgcaaggtgagggttcttactagtccgaaccattatttggctaccggccccttccgatccaaagcaaaagcgtaccgttactgcttactccgcctggtcatttaacgtgctcctcttccatagttgtacgtaccataccatctctatctatggtagtagtatcatgtgaccaccggttgttgttgtattgtatgcattgcatgccaagcgtgatccgcattaaatgcttctcttctctttagcgtcatccgtgctgactgccgactgccgactgcctgctgcagtcgtcctgctcggtctagctagcgctctgaatgtacccgaaagcactgcgtactgtactgctttcagaaatcgggtcctgtttgtgttatctgtgtatcgatcgaaactgttcgtgtggttcacaggaacagtcgaaatcgttttgactaggcgcaaggattggaattgagcggggtgctgcaggccgccggcacagggctcgggtcgtgggcgttctagctggcgagcaaatggttgggcaacacgcgctgcggtgtacaggccaaggcggccaggggaccagtgcggcgggcgggcgggcggtggctacccagcagcagccccggccttgccgcctggtacacggcgcagagacggggccgggccggatgcaggcagggcagggcaggggacgccgggacgggcaacgcaacagggcaagcgagtaaaacggggccgcacaggcacagcgctcagcgagcggtgagtccacccacccaccgcacggcctggtccggctcatgtgccgcggccgcgcgccatgccagcccgggccacggccgcgcgcgcccgcgcccaccgtgccggaccacgccgcgcagacccgtccgccactccgcctccgcgtccgtgccggtgccgcaggggggtcgtcaggcgtggccgtgaaacgatctgcgctcccggcgtccaaggcgctgcgcgcggccgtacgtagcgccaaaagctggcgtacctgtactgtactgggcgtagcatgtagtaggtagcagcagcactgtattgagtggcgggccggcggcaggtcggtttacttgcagattgccgttggtggctggccgcggccgggtccacgtcacaaatgacgggcgggcagggcagatcgtcgtgccgtggcatcgcaggccgctggcagttgacctctgagtaacgtgaccacttggtgcagcatcgggcgcccacacgtagcattgtttgctcctgtcccccatttagtc

SEQ ID NO: 1234 - DNA, 1507 bp, Zea mays
  misc_feature (1)..(100): optimal_loci_11368_G1, chr1:61632994..61634500, Cluster 8
tgcatgcgtttagtgacgcactcgcttttagaaaagagaagtgtgtcacgtacgatccaccgtacgactagatgtcattgtcttttgttttaaccgagcctatccggctatccctagattcctacgtgtagcagcacaagaacccaagtacaatggacaaaagggccctatgacctatttaaatttgattttggtgtttagtgatcgacatgactatttaaattcatattatttccctataatatttagttacaccgactaaaatttagtttatatcacatcaaatatctaaatatcaactacaagtattaaatatagtctaattataaaactaattacttaaacgaataaggatccagcctgaacctatcaagcctgattcttagtatcaccgatccaaacacgctctagaggatttcctgtgaaaaattgggatcgcatctctagaataaactcaacgtcacctgtcaggctgtcatcggctaagtacacacaaggtagtgtcacaccaagaaatgtaaatacaacagaaaaagttgtaggtctagtgcattcggagaacaagtgagaaatattttttttcgtgacttccctacgaagcagacacaatccttggtaaagatctaaacaaagaaatataacagtgagcgctagcacttaggaacaaacatgactccgctatggttggtggttaaattccagatggctgaatttgcacaaacggctcaatatttgtttcggattaaaaagtcggctgctgctgcaactgttacgaaatcttcggcggtctcacaagatttggcaacgctgtccgtcattcatgagctcccgtccgggcggcgggcggcgacctggtgagacgtcggcgagggaccggcgaacgagcagagcgggggcgtcgcggcgcgggttaatgcgagagcgagaggccagcggaaggcggggacagcaggggccgcggcacggagcactccagggcccccggcctgccaccatgtcgcccgtgcccgcggcaagccagcgacgcccccactcttccggtcgccttccctcgccgcggaccgcggtgccagcgtgccgtgctccgcacctgaccgtgtcttccgtgatttgcttttaggacacggcacggcatacacgttgcatttcggtacacaagactgcgccgcgtacgcgtatatacgcgatgattccagggttccgggaggattcgttcaactccactgcttaacttcaccgtctataaaacactcctcgttaatgtaattcttctagtactatatcaccttatttagttggtcctccttctaaatcataatttaacttaaacaataacatgaatgtcattgcccctagccaaacacgaggaatactctaaataaagataaaaagtgctctaaccaaaggttaggaacaagagtatataaaacaaaacctacctttttcaatcatgtatatgactaatgtcggttacctaggaataaagtacccaaaataggtacataaa

SEQ ID NO: 1235 - DNA, 2495 bp, Zea mays
  misc_feature (1)..(100): optimal_loci_11765_G1, chr1:64085014..64087508, Cluster 8
cttgcatccccaccgaacacaaatcttatcgtctcctggttttcgaaaccacgacaaattactgttgctacaatgaagcactaaaaagtagcccgtgagaacttagagctatcttataacgtcactaatatatatatcaggtgcaggtggtgtatcatagtcttaaatttggttgactacgctgatggaggcggagctattttctaaacaagctttgcttctgaaatcttaaatttagttgactaggctaatggaaaccaacagccaacacaacttttttgagaaccaataggcaacacaactgcacagtgaaatacacgatgaagctaacgctaggattaaactgacttgcaaccatgttttcccaggaaaactcccaaattaatcagacacagacagcccataacaatctatagatgggccggcattgtctcaattggcccgccaggcgatttctttcctctactcgcttttcttttcccatgttaactaaactatcacgaaagagtgctacccggatcggaggatgacaggcaactgcagttacgccgtacgttctcagctagtctgaagaaaccatctctttcatcctcttggctagggctagccttcttgacgctactgctttgttgctttgcttgcttcaaatgatggccattgtggcattgcacatagatggaccacagggccgggctttcttgcactgttgcacatgacaggtcgtcgagctagcagagcccggagcactgccatgcgagccgcgcgtccgcctgtgcctgtctgtctgattgtttgctctaccgaactagagagagtactcccaaagctcgacaccgacgcgtgctttgtcttctgccgtcgtcttcctatcgtcctccttttctgcacgcaaacggaaggggtcgatccgatccttctagtcatactcttcacatataataacaaatttttttcaagcctgtaaaaaatgcgtggaaactctagctaacctaacccctgtacgcactgcattattatgcatgtaggggctagctggatccttgtccttgttttatcgatcattagcagtatctagtgtacggcttgacgttgacctaccctatcaccagcagcactaccacgcgtttctgtgtggctgccaacgaccgatcccacccaggatatttcttcttcgtgtctactcttgtggttcaagcatcgtctagttatgtgtacccttgttttcaggaccatctatctgactagctatctggtaataacagccctgacgaatgtgaataagaaacacgcatgcacggagtgaattgtccttcagaaataaacctttaaggatggtttgaaagcccaatttctaaacgaaccaacctaccttttcccgtatgcaaaacccaccgtggatatgggtcgtggggaaatttcacggcttgtttcgaacgtgctctcccggaccagcgctcccccgacccggcctatcagtagggaaaatgctcccccaacacattacctcgcgcaaccttccccacgggcaaagggagacgatgcaagggatgctccaccgtctgcacgtcaccgtccgctccgctgccgcagcctttccttgacacggtcgcgagcgggacacgaggtattgaaccattgccaccttccctggcttgccgtccttcatcgttgtccccgttcagtttgctatccttcactgtcgtcttccatgacacgatgtaaggtcttcccactcctctcatactacctagggttttgaatcattccccattctaatgttagatcttcttcgattcttgatctccaagatccaatacaaggtcggctctcctgcaagtctgtggcacatggagcgaaccgagcaagtccgcgcctccaccagcgtccaccgctcctccaccaagcaagttcttctcaccctctctactcgtttcctggatgcgaattcaactcacgtcggccaggggtgaaccaagaataaaattagagtgagagcatacttgtaaggatgaacatcaaaataccagagcatggacatctaagttggactgactaggggaccatatggtgaaatctgaactataatacttgcaacagagaagtgagcgagggcctaggccctcactcacatgtatgtaggtccgccccttccaagagatgcacttagagcgaattcaatgtttggacaagttctaaaaggccctaggaacatattggaacacattagaaaagttagaaaggtcagatattcaatatgatgttctaggagctaagtctcagtgacatttagtgaaagggttgagcaggtctaaaatatgaagaactatgactcaatgtggttggatggactaaggataagtttatctaagtcatataagtgctcaagagtatatcgaaacgaagagaacaaaagagaagaaaagaatgtctagaaaggacaagtctagctactttgaggtgcaccgagctggtctggtttggcaccggaccgggca

SEQ ID NO: 1236 - DNA, 2052 bp, Zea mays
  misc_feature (1)..(100): optimal_loci_120376_G1, chr3:175960964..175963015, Cluster 8
gtacaaggcccggccagtcgtgattgttcaggctacagtagctagctgctagctccatatatatcagcgtccgcgtgcagaaacagtcaaggctgttgcggtgcagctcgcacagtcgtcgcagcgctgagaggagtgtagcttaagcaagtgatgtagcctctcctcacagtcacagctagctaggggatcggagagctacaaaatcatggaagcaaccaccatgactccagtgaccagtgaggctgctgtggacgactgctatttgtggtccagcgtcaaagctgcagtccgccttttacctacacaagaaacactgttgctgaatcgatccatcgtccatcgtcgggtagatctgacgttactctcttgctacaaccctctatggtcactgcaaacttaacagacagtcatattttttaaaacctactgactgcatagacacatttttgaaactagtcatcttttaagatctctcttatatatatgcaatccgtaccatctctctatcacaagcagaactgcatgcaggagtgcagaaccccgtacagtagtgtgtgtaagtgatcgactgaagaggaagacatacggccgtgtgtcaggcttggttcaggaaaactagtactacaggagtacgtacgcgcgtataccgacaacgttagcggcaacatcatcaatgatgcacgaatcattggtcaagtgatcgtatagagaaaaaaaagtacactggccgggcttccccgacatgacgaccgcgcgcacgactgaacgaacaacatcgctagacctcctgtattatatgctgtactctactgcctgtcagacaatcaatgaagttatatcgctcctgtgtagtagattcgtcgcccgtcgacgttcgcttcctgtgcagtgttttcgtgtttttttaataaaggaattgaagggtttttattaatccatatatagttctgtatcaagttgattgctctaataattgtaaaaaaaaaatccatgatcgtctgtgttaattgatacataaacgttgttgtagctaaaattctgcgaagcaacttctaaggacaattcaaatccgtgtcctgcgtgccagacattgtaccgcgccgaccgttcggcaatgtttcagttttcttcgctgtatatgaccggactgaaatctccggttacagcagtactgctgtttgctgccgtccttgggtactctccttccccggaacagaacgtccaacttcctctcgactgcacgcacgtacgaacacttcccttttgatgagctgatctggcccaggaccgattcaaccagtgcgcgtacatcgtcacggcttctccattgccgtagcctcctacggtctgcactgtcttgtgtggttcttcaggccttcaggcaacttataatggccatcgttcttcagggaaatgcatttctgcaacttatgcagtatatgccacgatcaggattcgggactaggcatggacgaccaatggtggccctgcagaggggcggtcgctccgggccctgaatttatagggcctaattctagtcatgtgatccaatagccgatcaacaaaaataataaatatctaaatatgttagaagaaaattataaggtgatactataatatatatccttttatctactcattatttgatataaatatttttatatgtatttgagcgtttaattagtaacatttatatattaaaaataatttgaaggccctctgtttaaaacattgtccttgtgcccctaaattgagcgagcgcgatcaggatttccgcaacttataatgcccatcgtttcttcagggaaatgcatttctctgcaacgtatgcagtatgacacgatcaggattcgggactaggcatggacgacggagcgagagcgcgagagcacgcgacgggtgcagggaccgagcggcgcgcggcgttcacatcacaccacagggacacgccaggcacacgggccgtaactgtacgcgcgcggccccccggccccaatcatgcatagcacgggcgcgccagaggccgtgcacaagcaatctattctcgtc

SEQ ID NO: 1237 - DNA, 1511 bp, Zea mays
  misc_feature (1)..(100): optimal_loci_120460_G1, chr3:176350309..176351819, Cluster 8
ccaagcaaacgaagcagggcaacagccggccggggcgattggtggctgtggcgaaacagtgaatggggcctggaaagctttgcaggagcagcgcccaataattcacggccggggctctccattacaacttgtccgcacgtacagcgctgaatacaatgaagccaatatccgccgggacgaaaacaaggccgagaattttgcaagcgccgcgtgccctgcccgtcgttctggactcggcaacaggacagcaggcagcgtcgtgcgccttcgtcgccccgcccctggattttttttcggtcggcccgatccacacggtaaaaaacgaggagcgtagtgaaaacagagaccggcgtttgcgaactaactagtagtaccaggtaggccagcgcggcccgcccaggctgccgcgaatgaatgccaagttgtccgcattagcgcagctaagcgcggccggctttccgcagctggggggctcggctcggctccgctcaggagttcgtgaccctgacatggtcagtgagcttttggcgctagttagctgcgaatctctgtgcgcggccggcggccagcaccccgcacgggccgcggcagagccttttgcgccccgtagcctgccgtgccggagtccggtggcggcgcatgcgatgcatggatgacgacgaacggcaggcgcgcgccgcgacgcaagccttggcgaggcggcacgtccattaatgctgacacacggtcttgggcttggcagggttcacgggacgccgccttcgtttggcctttggccatccgctacagagtacgtacagaccaccagtgcaaactccacgcgaacctccaagctacttactgtaagggccaatgcgagctcgcgcgcggcgggcggcgccgagagcccgagacgcgcgcaccgcccaccaccgggtcattatgggggttgccggcggtggcggcgtggcggctactcgtagcgatggaagggggtgctttacatttattattatcgggacatcactaatcccgatccgcgctatcctgtgacccgcgagccgttgaagctgcgcgtgacgccgagctccacctccacacgcgtccgaaacgccttcattgccgtgtgcccgtgtccttgtcctgttcaccacctctctcgttttgttgtgctgggcgagcgatctattttgataaccaccttaacaaagtcaacgcacagttaaagctatacactctactccgtcggtccttaaatattagtgtcgctatagtttccgttcaaaagttctttaaattcaaattaaaaatatttaattttatgaaaaaggagaacgacacttatttttagaaacgaacaagtacattcatcctactagtacgttagctatcctagacattttctacgttcatctcattatgatcgtactagtatgttatgcacgatactcccaaattatcagcagccctgcgatttacatggtcgcaggatgctgatccacgtatctgttctcgtttactgaaaggagaat

SEQ ID NO: 1238 - DNA, 1542 bp, Zea mays
  misc_feature (1)..(100): optimal_loci_121304_G1, chr3:181071480..181073021, Cluster 8
ctcaccagtggctaggatgacaaaggcaaaaaaagatggagcgtgatcgcaacaagagtacaggacctggccgttcgtttccagtggcagcttttagatttgctccggccgccaagtcgtgtgtgtgtgcctgccgctgctgcttctagggtgctatcgacattagtttcttatgcagcatgattgggatatactgattatactctctattcttcgatatgggaggggaaaaaaagaggaaagggatatacatgggatcgggtcacgaacggtctcatggaatctgatgctgctggcgtcaaccggccgagcccacggtatctgacaaacaaatcagacgttcgtgaaaacggcacgcattgggtcgatctagacatctatgtctagccgcgcgcgtgctttgaaaacgtttccaagcgcagacaaaaaaaccggcacgtgggcgcatgcaggaaacaaacaaaaccggaaacctatcgctgcctctgctcgtcttcttctccaccagatctgcacccccaaggaagagcaggaaagaagcatgggggcgcgccacgctcgatcgtatccgggggaggggaagaggaagcttccatgcagcaggatgcaggacacttcacgctcgcactgcactgcacgtctgcactcggtgcgcgctgctccccccctactcgcctcgccatcagagcccgcgcgcgcggcgatagatagttcagtgacgaagcaaataacaggtggcgcccgcgcactgcgcctgcaatctggtggtcgtggtggcgaggtcgcaggcagcgatctgctcgcacttactttcgtttgtagtgtactagctcggtgggagctgaaaaaagcatgggcaatttgtgtgcggctgcccatggagagagagcgtctcggtcgatcgtgcactttcgcaccagtggacggtgcgtcactgctcctcctctccagactccagccatacagtataactgactcaaacggttgcgtgctgagacgaggcactcacgcgatccctcgacctctcgcgaggagagctcaccaccgcctgtctgttcgtgggtagctcgacacgttagagggcaggcgggcgccgcactgcgctgccgctcgccaccagtttggctggccttgggcttcccgtagcagcgtgccgtccacttgcgcggcggaggagccaagaatctccagacatgccgctctaaacaagagcaagatgacaaattctgaatggacgcgcgagcccgcccaagtctgtcctagacaccaactcgagacgtacgtcaccgagtaaattacacaccggcaacgtggtaagcactcgtagagtctcccttcccctcccctggatccaccgttatgcacaacaactgaataaccttactgcatatataagccagctatcagtgtgcagttgagatgacctccacaatcaaattaaggtcatgcaccctctatactgcagctattgggatgatgatctcatctacacctgatcagtagacaggccggatctttctcgcgcgtcctaatcgaaaacca

SEQ ID NO: 1239 - DNA, 2736 bp, Zea mays
  misc_feature (1)..(100): optimal_loci_121468_G1, chr3:181909715..181912450, Cluster 8
ttgccgatatctggagtatattttctcacgcgtggtctcgggaatcatgcatgcaactatcgcccccaagagctacaagaaacgggggaagataaaacttttgggcgactgcaacgggcacgatcgtccatccaggataccggaaagatgagtcaaacgagaataagaactagaagcaagtgtgtttttgcgtccaacaatgattagggttcagaagagcgacggagaagcctccccatgctttctttctagggagagagagagagagaggcgctaatgcagtatacaagatgcagcagagagattaaggaggccaatgatgacaaaactgtcgttttctgttgtccaaggaggaggttaatttcgacggtcattggctgactgccagtcaaaaaggtagggtaaaataactccaggccaaattcacccgcatcagcatatatatgtacggcatgtgacgatagatgacgaaaaacagcaataacaacatgcagatgcagggactcagtccaagctcttggtgcaattaacatgtccatgattgaaaacttttgcatgtgtgacagtggggttcatgtgatcagttgcttggataattacatcatgagagtgactgggtgcgtctttgcacttgcaaggaggcctgtcgactgtctccctactgctatgattcacctactgaccttttttttctagcagtctagcacaagacattctgaaactctagcacatcacatgaaggccattacaaagccagtttctttcggctggcaagcaagtttccaaggggagatgttttttttttcaagtagtcgacgcgtagggtaggaattagcaaaagggggttagaattgagctaggatgaacagagccctataattaagggcgcactaattcccccactcggccaccctggccagtattttagaggggagccgcggactgcatctttttctcgctgctgctgctgctgcgtctttggaatttgtagctttggccaaggctatctcagctctcatccttttcgttcatctccctagaggcggggagtgtggctgccgattctttgtcggccggtaacagggggtgctttgcgcagataatctttgttaaccagctatggtttcggttgcgcgcaatcagtactgctgcttcgttcttgaattcttgttttggtgctccagttcatcagcttttttttttctttctaaatgctcacgctgaaaatgctactgatctactgcagaatacaggtaaaatgccgccttctgcagctgttatcctgagcctttttccaggcaacgccgcgcgacagctgatgttggctaataacgcgctaatctttcaggtagactggtagccttatatagctccgtgatgatgagaactggggacagaatgtgacatgcaattgtgttagtgcaaagcatattgattttatagtggtaagtagcgtgcaaaaaaatggttttcaattagctaaaacatttagaattaggagcaccaatgctaccacttttgtccagtggaggaagaagcaaagggaatcagatgaggtgttgcattccctccctatattatttgaattacttacacaagaagtgaaggcccaagaatcaaatgatggccttgctttcttggctaattcaatcagagaaggaacacatggcatgaacattagaaagtgcactcttggatgctatcgttgaccctagtaagaaatgtagggccgtagcccaccaccacccttaacccaattagcaaggctcatactcgggggttagagcaaaaccaaaaagaggtgatctttgagcactcaaagggatcctgcatgggaaagtaacattaacctaatgagggaatcaagattaaggaccctgaatgaaagaataaggtcaaaaagttttacagcaattccatataaagggagaaaaggtcattgtaaaaagggtggaatcagagcaatgtcggaacattatttactgatgctgcatgaccaactgctactcggcgtaacatcctcttaaaaatggtaatgaaatattccgtgtataagtgtatctagccacttgcttagtgtaatttacaatatactctctctgtcctaaagccttgttgatgttttgagttttttagaaaataatagtgcttaacagagattgctcatgtatcccaatttattgaagatgaaccatgctaattaaggaataaatttctcgtaaaaaagaatgtacgaagacatgcagaccacaatctcaagctactagtataataatataagccaaatatactgtccagcagctaaatcatcaagttttctggaacacttactgaatcccagaaaacttaacattttagctgttttctgaacggagggagtataaaaattgtacggagtatatgttggtgacgataggctactagcttaaatcctttttggaaaaaaagcacgactggcagcatttagagttgaaaaatatagtagtttctgttgtgaacatgtgattatcaaataacgtttgccgattgagtttcctaactgtatataattcgttgcctgtaatgttctcatgcaaaaatatttatcacgaacaccatatgcttttataagatctttgataagtgaaactagtgatagcatgatatataaaaaggttaccacatagtatttgtatcgactcagaaccgtagataactgatgctttgaaatgttaggggtttattttcatagacgcc

SEQ ID NO: 1240 - DNA, 1712 bp, Zea mays
  misc_feature (1)..(100): optimal_loci_121802_G1, chr3:183443956..183445667, Cluster 8
gagcgctacaaataattttattttgagacaaagagatgattccgcagctagctgtgatctgatgagcattatatttcttgttttcggtatggcctgatctctctggccttgcattgctttcacatatatacaaaagagatcgaggacgaagacgaacagtggttagtggtctcccttggcctcgcctagcctttattttctccctcactttgtcaacgattaaagggctggctcgatctgtgtggctcaaggaggaaaagccgacgatatagctgctcaccttcacgtgcatgtcctgtacgtatgtgatccctgttctcctgtgcatccacccccggccggccagcggcatcgtcgtcaggtgcgcgcgggcctctccgcgctcgtgccgccactgtatcgatcgcgctgcgtagcatgcatacagtctacagtacccggccgcaacttgtctctcttcccttgcgtcggtgccatgcgtcgccgttgctctccgccgcgcgcgtccggccccgcaccgtgcaattgcactgtgcagccggccaccatgcatcggcgcgcgagaggcgcagctaggctattagcgacctcctcctcgatcttgctgggtcctgacggtggatcacgcacaggcggccggcccgtgttcttgtcggcgggaattgctgcctagcttggagtatcatatagtatattgtcagcagggtcttgtctgaaattatttgcatacagacggcaactatgtgcctgctgtacattagcctctctccccctggcttgcaccatattgggcaagacaaaggctttactactgccagcactgtaggaatcttgaatttcttgcaactttctgtgcctgtgtctagtaactacgacagtatcacatgcaatcatgtagcaggttcccactgacatcacctcgccgccgacaacgtacgtctggtatcatcatcgatcgaccttctatagctactagtctaatctataaaaaaaaggggaatgggagcgtacgtacgtgcttcattaatatatgttcgatcaacaatcgatcttttactaattaattaaccattttcagtacgggatagtcatctctcatgaatgacagacatcattggattcttcatggacgatgatcatcagcatcctgccatttaaaagcatgtttgtgtggttaggcgccagcaggtggagaacctgtactacgctgtggtgcatatatggagccggccaccatcatctctatcgtcgccttcttctttatgttggacatcggatagtagctagtacagtaactgttttgattgcatccaacatactgtttgttaatacttgattgcatgcatgaaccgaaaatctatggcacaaattaaagccagcatacgaattatatatgactagttttcggtactcttttgccgatatgcttctgttgtaacagcaagtatcatccgctgccttctccttgtaagcatacatcggatgctcttttcttgcaacttatataaatatttaatatatataataatatgcaagacatggatccataatttgctctgcatgacgtgtggatgcttataaagaaggtggccaaatcagtacttttccgatgctctcatattgaatgatcgaatcaaacaatcatagaagataaatataagctaacaagtcttgctttccaaaaatccgtcgcccatgtcctcgagacgtag

SEQ ID NO: 1241 - DNA, 2055 bp, Zea mays
  misc_feature (1)..(100): optimal_loci_123075_G1, chr3:190081958..190084012, Cluster 8
tgggtctgactgatcggcatactatgcggctgttgaccagttggacgacgctgcactgacgagaccgcacggccgattgaccaggtcaaaatggtctgacaactggtagtcagtctggatgaggggcaagcaatgattggcagttgcacgcacgcacgcacgctacaggagcagcacgttcggtacagagcgattggccggtttggcagcactccccggccgctccaggtccccctctcccgcacacaacacaacacacaatgacacaaacccccgtgccagtcagtccggcagcccccagccccattccagcaagccgcgcacgcccggagccgcggagatcattaccgccaaaggtgcgccaccgcgccgggggccgccctgtcgtctttgtaccgtgccgtccacatggatgcctgcctgtttgttgcctgggggtgtgctgtagcggtaggctcgcgctcgcctgttccggctttaaacgcaacgcctttcggcctttgcctttgtcgtctgctccccttgatccgccgatcgccaccagctccgatccccctcacgactgggggtggacgaactaacgtttcggccttttgaatcgatgtctttacgatccaatcgctggaatttgtacgagttcgtgtgtaaagacctgatccaaacgctcgcggttccaggaagattggcaaccaggcatgcccacgtataagcgcccccggtgctttatagaacaactaattaagctagtatactgctggagctggagtacaaagtcacggctagagagggaacgctagcttgtcatatgcatggaatcgtacatggttgtatgcaatttatttgtaggaattttaaatccatgtaccactcctcatttctaccctctctagctagtaattgatgaggcgattttactaatacaatgaggagtggtgctaaactaagggcacatatgtaaaaatgcctaaagtatggtaaaaaaaacttagcctaaatcactgtttttttatggttagggttcgaatatgcatggtcgcagccgtactattcattattagatttgtttccgtcttcgatcgctgtcatcttcagagacctagacgcctagctagtactacgtacgtaccgagatcaatgagttgctgacacagatgtctgatctaggagtatcagttgagcgctgcccagtgatcgaattaagacgcccggcctgccaaagagaaataaagttcaaatgggagcaaagtgcaattaatcgcaaaacaacattcaggaccgcacgcaccaatatgctagaacttctccgacactcctaccctccattcctccaagctgatgtatatcttctctctcagcccttgttcagttacgagggatgaaatcccaccataaatttaatacgggtctgaatttggtgaactcatacctcacatcaaatcatatggtgggattaaatctatcatttaatccacgtatctctcaaagctagtatttttttgatccatggattataatataaacttgtgcaatatgtcaatatcgtaatgaatttgttccatacctaatgagttatggatagaattcatgttttccataattttaaaaattatcaaactattgggttataatttatgatgaatttaaccgaacaaaaaaatcaagtagatttggattattttgggggcatggattgtaacatagatttaattctaattcatgctaatctagagctggattggtgtataaacgaacaaggcattatgaggttgaagagacagagccatacatgttctcatttgcaccttcttttttattatgttgggaacaatatttcattttaaaacaaaatctccttcatatataaaacacgcttcttttttatgcgcgccgagcatttcggtaaaacatgtaatcatgcatgtagaacaaagaaatgggccttaccataatatatttccccgaagtttttagtctttttttttatggagtgggagtgtgggacgggtgctctaaggacaaggagtgatttgtgcgagccatggatggtaacatatc

SEQ ID NO: 1242 - DNA, 1570 bp, Zea mays
  misc_feature (1)..(100): optimal_loci_123450_G1, chr3:192110195..192111764, Cluster 8
ttatcatgtgcagttcgaacaatgacttgagtatgcccctgtcattccaccaaggtttcaatttgaagttgcttgctcatttctaaatggatatctggcgtctcgaatcgtcttgtttgactatagcctgtcaattgctgactctggtatggtcgaactcgaacataagtagtagtagcttatgttgggaagagaggaattggaaatcacttgcaccaagcttaaaagaaaagatccaagaaaccgagttgttgttgggaaccgattgtaattttgagagaataacaataggacaacatattcccctactactaatttaaagcaacagtgtccaatatgacgtatgtttatttcttcgtatgaaaaccttagtaggagagagaaagacgaggagtgggtgggagggaaggacagggtgcaggaggaaccagcagacgccgtggtggaagcagcagcgaccacatttcattgtctccatggatcggtgtgtggtgaagctatcaaactgactataaatcattttctgagagaatataaatcagtcttggcatgtccgttgcaagctcctagatatatggagttgctggtaatggcatgcacattttaatcactaaaaattacaatctaagcactacatactgcttatactgctactgaactggttagcgttagtgaggtcaggtggtgaattattgctaacagtttactcgccaatgttgtgtttattcagctcatcacatatcaaattagcattaggcaatgatgctccttatctaattttttccatttcactgcttattgtcatacacaattatgtagatcctaacgaaactgtgaaaatggttgtcttagggagaactgtttgaggtgctcaaggatgatctatatgcctgagtatgtttgcgatgttgctttctcactatttttaataaagattttcttgctatatgttacataagagttgctactaggaattggctaggacattgtacactcagatattgcaagtaagaaaatttgctctagctagttagtgcatttttgttggtcctttgaatattgtactttgttttttctagatgcatgcagtatcatgtcatacaacatcttgcctgattacaatgctcggaatcatcctgacctttatttggatgccccctgagatgcaatgaggtgggattcatggaggcgacttattattcgtgaaactaggcaccgggatcctgacttagtgtgtcttcaagtaagaatccagtttcaatgatagtgatggcattcacgcactgcactctttaacactgttgtctggaagctgggaggtagataggtttcaggacattgctgtaggaatgaagagcagaggtacgaaggtatattttaggtacatcacttccttctcaaagacatttcctttaaatatttttatgtttcagttcttcagtgatagttcatgatcagaggcgaactggagatactagagatggatgtgacatgttttggaagtcaaaacagtatggatgatgcattgtcctttattatattcattgatccgaataacatggtattttca

SEQ ID NO: 1243 - DNA, 2017 bp, Zea mays
  misc_feature (1)..(100): optimal_loci_124525_G1, chr3:198034890..198036906, Cluster 8
tgtactactctttcttcttcaagcattacgtgcttcgcatgtttttttaacaaaatctttctagtgccgtcatggcataacgagcatacaatgcaaataaaatttatactaatctcaacgatactcagattctatgtacaactatattttcatgatcagaaaaaattgaatcaaacggaccctctattagttctcttttaggtttactgacaaaaagaaaacttcacgaccacgatacctgcagtgaagaatactatagctgcataagcaggtctataaaaccttttttccccatagcacgaggcacgagcaccagtggagtgtggagagccggctcgccgtctatcgtgtcaactatactttaatcccgcagcggcaccctcgaacggtggtggtgtttagttagtggcctgtcgcggtcgcggacagatggatccagggggctcggtagggtggctgcttttgttgccgatgcatctgacgctgccctggctggctttaaattgagcactcatgtgtttgcccctttctttttcggctgcacacccaccacgcgactagcccagggtctttgttgtagtgttacctctcctagcgccagtacgtagctagacgactgattccgggctcatgctaatgaagcgcatgtgctacctcaagttgcatgtttttaaatgttagctagccgtctgcaggtgccgactgccgaggaacaaaagccctgaacctgtcgaccccgtgctcctttttttttccttcctctatttgttttttctcgctttttggtgcttcattcagtagcactccaagtccaaggaaataaacaaaagggtactactactacgcacatcgcccacttgcgggttggattggatctctctctccccccaatcagaaaaccggatcctccatacgcggccggcctgtactttctacatgtttcaaatgtggctgcctgagcccctttcggtcttcagatagccgtgcatgtacaggagcttgccctttgcgttgctagaggcggcaagaccgccacgttccagtgtctcacgttttcagacctgggtcaatcaatcatggaacgaatcaaacgtccacgtgtcgtgtaaatcgaaagacgctgtctgtgctattgcctggaagcgtggtactagtattgtagtgacataacaaaagccgctttccctctattactcttcaggctttcctccgcgacaccacatactgtaccaccggtgcatatgcataccacgtgtaggtgagtggggcttgaccggtcagtcacgaatggaagacaagagagcccggattatccagcaaagacgagacagcaggatgtgccggcacgtcggcgccacaaatcacgtcgaatggctgggcctggaagaagtgggttgcactagtatgatagtgtccgcgagcccgacgcgttcctcggatagtgacaggtgtcagccggcgggtacggctgcgctgcagtcatcacgattcacgaccgaacgacgtcgcggcagggtcgccgtcggcagaaagcggagcgggaaagggcgccatggatggcgatggcgtcgccttcggccttggccccggcgcgtcgccatctgatccggttgggctcggggcgataagacggcgacgcgcatccgtccagcacgcgcatccgctgtggccaggaaccaccgcacggctcctgtttctttgggccgtgcgcgacatcatctttttttccggatgatttgaagggaccacggcggtggccttgtcttgggtttctttctacgctcgaggcccctgcacgcctgggtttcggcctcttcttttcggatgcctctgctccccgatgcacagtgcggcaatgcacagtgcggcagactctgtttagacatcgacttttttccaggtaggtaactgtgactatcgtgttgctagatttaacagtgttgcacggtctgctggagtgccataatacgagtgtagctcatattttatttaattaacttaaataattttagatata

SEQ ID NO: 1244 - DNA, 2095 bp, Zea mays
  misc_feature (1)..(100): optimal_loci_127935_G1, chr3:214853021..214855115, Cluster 8
ccatggaacttggttgtttcaattccttcaactcatatttcttctctaactcaaattggctccaagattgtgtttcgttgaaattgagctatacaacctatttgcatgagttaattatgttcctaggggtatttaaaacttatccaaatatagagcacatagaaaccttatattcacacttttagatttaaccggatttatatgaaaatactaatattgtgatgtaaaataaatataattagttttgtcgtgaaatatatgtttataacaaatcagtttggatattaattagatgcagctactgtttaccagaaatttagtcgaatttgaacaatttagtaaacccgtacgaccttcagcgtaaatagttactactttctttatgttgttgtcttggcggagggaggacgtgacgtgatacgggctcgcgctcacatgcaaattattcagtcgtcgtctttgatcctgaagacctgaacgaaagatacccgtgcacaccgcttttacacctgctgcgtgatgcgctgttgtcactagagtcgccttcatgatcgaggtggttccccggccgaagctaaacagccagccaatggagtagtagtaaacggtcaatccgtctgcagtggcagtgcgtgcatgtcacatcgatccgtctctgaatcaaagtcgatctctagcagctagtagtagtagtagttccgtagaatgcaagcatcgggacataactcccaacatctcacacatcgatggcacgccgttcttggtgtgcaccgcttttacagggacgagacgacgacgaccttcgggctttggctactacctatacgtagtagacgtgactagcaagcctcgtaaaagatgcatgcatttttttttgatctcgtacgtcagaacaaagagagcgacgtacggccttcgctcggaacaggtagcacagcaggctactagaggatcgacatgttgaagttgaagcacgatgggctaccgtgttcgctattcttgtacagagtgacgacgccatgcatatactcatatataaaagattatttccggtgtggcgcgcattggttccatccgtaaaataaaaggcgcatacgcggaagcactctagtgctcatactcgaccactacttcagtcaaaagggcaatcatgtgaacatgatgaatcacttcatcggctcaaccacgaattcagagcctcgatagagcccgtggcggtgccggtctattgacttgggcggcggttaagcccatgcaaccacggcggcacggcgctacggcggtgggagcgtccacaggacggagacggagacggatgcagctggcgaggcgtacatggcatggcggtgcaatgattacggcggccaagctgcggcccgacaggccgactcgcctacccccgagctgggggacctgccggcagttcccctgcactgcactgcacccgccccgcgccaggcgccgctcatctccacgtgccctccaccccggcccctcccccctctcctcctgcctagtgggccatcctcgctacgcccaccggggcgggcgagtgggcgactacagaacaggctactagcccaggggcagggcccagccagcccagtcagtttcaagtttgacatgacgagtcaggtcaatgtcgtggggcccactcgagcgaccgcccgcccgcccgcccgcgggctcccgttatcccatgcaacattgaaccaacccgcacctcgctctatctcgtctctggtgactgatgccacagcatctctcgcagctcgtccatatctggaccgctttgccactgcagagccaaatgctatggccaccagctgatgctagagcagagcggctttacacttctcggcaactactcgtgtgatcgtgtctgatcagtatactagtgaggcaagaggaatgcaaaattgcgctgctatagtaattccttagaagaataaaatgactacttactactatggtaatttatgaataattttattaagaataggtagttttagtcaatgtcatccttaacataaaacaagagcactaagccgctttaattcttgcatggaaccgtcacccgtgaccgtgactcgcg

SEQ ID NO: 1245 - DNA, 1996 bp, Zea mays
  misc_feature (1)..(100): optimal_loci_127937_G1, chr3:214865038..214867033, Cluster 8
cgcgccggcaaacaaaggagacaggattttccacttctcgatcgccgccgctggccatgcacgcgggaacaaagcaaaccagaccgatcccgatatgcgagcggcgacgcggtgatggatggcgtccgaatttcagcgccgctgttccgagatgcccgcgcgtacacgtacggccagagcgtctccccttttcgtaccgaatcgcatagatgggcgccggccggagctagaaaggcacacgccggcccgagcgcggcagcggacactgaaccttggccgctgccgctgtcggcacggcggctggctcaggtcggccaaacacgaagcagaccgtcgccagcttttgacgcgcgcgtgtaggtcgtcggtccgttggagctgagctagctagcacgcacgggtcgatggatcggtggtcgaaggcgacggggtggtgctgctgactgctggtagattctgatgcaaattgagctagccatgccaatgcactgcgatctccggtggaatcggatgcgagcggccggccggcgatcgactgctcgctcgatcggtccttggctagctagcgcatggacagggacttgtcgccgccggtagtcgtagcagcatctacgcaaaacggaactagcagcctttgcatcgcgactggaccgtgtggaaaaagcgcaactagctagctctcgtcgtcgctgccttttctgatgggactagctagatcggccggtgaggcgtactgtgctttgtattgcacggctgggagtgagccctgtgtttgattgacccatgcagctgcatttgcagagtgctgctggtccgcgatttagagacgttgattgaagctagctatctagtaacgacattaacttcatcctgtgtttcttacggctacatatagtagctcattacggaactggtcggcaggccaccaacccagcgaacgtgacgcgatttccgacaaggcaaagcacctgaattcgagcccccgaaacatgacagtctggtcaccgcctatggtatggtatggccgacagatcgacacggggcaacgccgcggtcttaggttgcccgagattgacgtaacgttaggtccgtgaccccccccccccccccccccccccctgcctgtgtgagtaacatgggcctatttaagacggcgcggccaattaagcagtcaaaatgttgtcatttagttagtccggccttgtgttgagagaacaaggtcaaaaaaaaaaaactacaagggtagtacaacacaacacatagagagagggtctcgactttagcagcttcaaacagaatatggaacatgacctcgtcccatatatcccgaaaactttgttttccaaacaagtaacgagaatatgttggagtaccatttcaactgtaccaaaaacacaacctcctaggcccagtggcgtagcgtatctagagggtggacaatatgggcttattttgattctactaaagtatatagtttttttgaattatttatttcttttgattcttatatgttgtaggatttaaaatgaaaacttatctatttattttgattttcataagattagaccatcctaactttaaaattctagattcgtcactgccctacacccctgtgtttgggaacaatcttttccaaaaccactgtttttaaaatactatagtagtatacattagtcatgacaatggtatagttcaaattactacagttttaaaaatcgaggtccagacctaaatttagaatactttaaaacaactacaatatttacaaatacttcagttttagaaaactaggattttattagctagcttgctaaacagtattctgtatataatactgcaatatttgtgaatactgcagtattcttccaataacaatgcaaatagatacggcctttagtttctaaaaatagccccacgttcttccatgtttctgtttcttgatcacgatgtgcatcgcggacgccttctcccactcccaccgggcactgtacaagtc

SEQ ID NO: 1246 - DNA, 1500 bp, Zea mays
  misc_feature (1)..(100): optimal_loci_128579_G1, chr3:217941681..217943180, Cluster 8
caggaacgggacatcggagagattgattcagatggtgttggaaagaattagatcagacagatagatgtaagactggactgagaagaaggacgagaattaggagaattgaactgatccaactaagagacctaggatagaactaatttgatctatctaaaacttttaatttttttctatacttacatataagagatactaaaaattgaggggggccacggcacctgccccttcagcatctcttatcacgaaatcccagctccccgaaccatcatgcggattgaaagctctatcggagttgatctttaggagatcaccctctggtttcgccaatctcacagccgacctcctagtagattggttagtttgcgagattttggagatttcatagaactcatgcgcctggtgtgtggtcatgaaagcgagctctaaagcacaacgctcttgctcaccctcccttcttttgtttctttcattccaccatgtccaaaggatgttcacaactgtgatctgctttatctcttccaggttcaagacgaaggcaaccacttcttttggattttgcatcactttcagtttactcctgatttcttccaaccccacagccctccatagttctttcacttctttgcacttgaaaaatagatgtcccccatcttcccacgtttttgggcaaatcacgcagtttctattgatctccatgccttggcttcttagcgtcattctcaaggccacagtattatgagccaatcgccacaggaaatgtttgatctttcttggggcattgtatcttccaaagctgcttccacatgttctcctccattagtggcatgcttgaactagaagaagagccatgtttgctttgttgcctaaccgcctctttgtgtactttgtatgctgatttcaccgaaaattccctttactgtttgcatgccatgctggtaaatcctgcatgtttgtgtgcactggaattgcaagaatagctttggcatcctcttactcaaatgtttgttataccaattgggcatcccaagtgccactataagggtccagcagattggcaactttcacgagcaggtttgatcctcttcttgacaccggccttcacgtgtttcaggctggtatccatggatcttcccaaatcttgatactttgaccattgcccacctccatatgagccctaatttaatgacctcaagcctattcaggatgcttctccaggtgtatgaaatacccccttttggcctcgcttgcaagatagagcagtttgggaagtattttgctttcagtactcggctacacagagattcaggatagtacaacaacctccaacattgtttcacaagcatggcaagatttaaaacatagatatctcggaaccccggtcggccggtccaccttgggcttttggcttggtcaaggtatcccatctgatccagtgcattttcctttccttgtcctgatgactccaccaatacctgcagatcatcatccttatagttg

SEQ ID NO: 1247 - DNA, 1589 bp, Zea mays
  misc_feature (1)..(100): optimal_loci_130752_G1, chr3:229080344..229081932, Cluster 8
caaatcatcatatatatttatatattggtagttgtcttaaatcgtgtatttatacatgtggttaccagtataaacatatagtttaacttagactgtggcggtaaacttgaagagagccacaagcaaaagtagaaatacgtttaagacatggacctacctgcaataccattagtagtgactagtcgtgatgcatgatatacgtagtacgaggagtacgtattattagagagacatgagctagctagtgctttctacgtggatatgcatggtgcatggaaataacgcgcataaaataattaagtggtatttccactagctaggctaagcatgcgatcgatgcgctagcttatatatatgtagctagacagaatggctggccgcatgagggcgtgaaaggttgatcaatcgacatgcaatgcgcaatgcagttgcgacgagaagagctagcagaagatgcgcgcgcgcgcctacgggtcgtcacagacgtccctaggcggcaacgaacgagcatggcttgacctttggggtgcatggaagggaaaggggcacatggatgcatgacgtctctccctccctgctgcctacctaaattcttggacgatcccgttcatggtcatggccggcataccaagatcaaagttggttaaaacggacacctcacgcacacacacatgcgccatatattccggccccccgcaggccgcagcggcttctcacgattctctatcgtgcactgcatgcgtcactcccagttgatcgtcaatcgtgcatgttttaagtagagaatattaatggatctttgccttttattagctttagtcctggttgtcttgagatccaggcttaacattggtattagatccactataaattcacggactacatgatgattacaattgaagttatttccacaaccagaataattggagtgcacggataagtgccttttaaataaattgttatatagacatgaatctatgaaacagaatacataactatttatgtggtccatgaaaatcagaaaaccaacataggttgcagaaaaatccagaaatgacaagtggagtgcacagtagaatataagcccgcaaagcacaaatatgtccatgccttatttatatgaacagttaaatgaacattcatagtagttggtaaaaaggtgaattcatctcaatagctcaacctctgttcgctagcatgacagtttgacatgtgatgtgttctcagtttgttgacaagaaataaaactttaaatttgaaccatcagcaacattctctaaaatgtatcattctctaaatataaaacacagaaaccttgcaatgctagcatatatcattcatgaagaagttatgccaaaggctatcatgtaataaattggagaagaaaggttaacaatgatcaggccacaagcccaggacacaggatcacaaaaacaatgaatatatttgtgtagtattgaactaaatatcaaaagaaatggacagtgaattaatcaggttccaatataacccaagggaagaggaaactaacactgattaaatgtttctttactttttcattaaagtagatctcacagtgaagcttgctt

SEQ ID NO: 1248 - DNA, 1419 bp, Zea mays
  misc_feature (1)..(100): optimal_loci_130777_G1, chr3:229237813..229239231, Cluster 8
ccttcctttttgcaacaagttaattctttataaatctcagtgttcgtatcatgaccaaagatgcttctttttctgttatttcatttcaccatgttttatagaattttcataaattttgtatcaattactacttagttcttgaaatttttttgtaaaggataaaaaatggctaggcccctcaattctattagatccgatcatcacattaagggtattaggcgctggccccgctgctagaaatacctagatgatttggctcaggtagaattgtggtcccttaggggaagggcggtagtaccacctacaagctctgctaccgcccgatgctaagcctcgaaagaacctccccattactctcatcatactttgatagtcgttctaagggtattgagggattcgatcaccctcgctacaacgttacctagacatcaatttggatggagtagggctccctttggggaatccgacaagtatcgtctacacggctcttcttgccgcctatgacctattcatgggatagcaaaagcccctctcggtttggttcactgatagggtaacagaaagaccattccaagggtaagaagaaggacttctccacaggtgaacaacaagatttcttcccaaaggtacaaacctatagggtctcctgactcaatcaccaacacaaggactactccgggagtataatagttgttgagtcctaggatttagccttttaaatgagacccttctgagggcctattttaatccctttcgaagcgatgaaatcactgggtctcaggactcggttttctaaataggagcgacatactattaaatctcttgatttatgtaatttcgttctggaatccctgatgcagatctattttgaagcatcctaacgatagtcagataatatattactgattcctttgactcgggggcttgatgttgtgtgcgacccgactgggtatggtaatggacagataacccttccatgttagactcgagggctcctataaagaatatatactaggaatacctgagatacatcaatagtcaaggcgctgacaaaggagagcaaatgactcaggtcaagtcagggaattcggacttggaatggacaactcggactcagctggtagacttagactgaaattggacggaaccacaagtctaaaccagatcggcatgcataaacagataagaaaagacaatgtttttttgtaaaaagacggtttctagttacggtattctcacgtcttaagggaacccaaatgtaaatttaaataaagatatcctagatggtaggacaaactgtttagcatggatcttattccatatgcgatgcattaccaaatatcatttctataatttcttcccttcttaaactataaaagatgccccaagagagtagaagaatacatcagaaggaatagg

SEQ ID NO: 1249 - DNA, 1796 bp, Zea mays
  misc_feature (1)..(100): optimal_loci_131605_G1, chr4:1979600..1981395, Cluster 8
catggtccctaaacctctaatctcaatacgggttggactttaatcaagattgtttatgattgtctattggacatatctccaaaaggcacgccccataacactcttgcgcgtactattactcttagagcaggccttgaaaacgagtgtcttccaagagtttacctgttcgagtgaaggacggtaatcacattttaagcagtgttcataagtgatatgattgcttgctttgtcctctactttctcttgttgatcgatgctttgtcctctctccttccaggtacacagctatatacgtgcactgcaccgagtgagacgattacaccaactaggcaccatgtctgccactgggccaacgttcgtgccatgtatgttgtcatttgtcaatcacctagaataaaaaccaactgaactagtatatatacgatataacaatatatatcgcaatttcaagatttttttggtgggtggtgggggtgggtgggggtggggtaattgcagttgttctttggatctgcagaggcactgtaccgatcgatcttcactgttgagcaggtattcagtgcccatacctcctagctagtaattgctggccagccattgcaggccggagttatatgccttgtatggctactcctacccccaagccaagtactaatagaacacgacgatttctctctatataaacggatcggagaagcgtcatgcatgtcaccgtgacttgcaaagcagctagcatagggaacatcgagagagagatgagggtagcgatggtgggttccggcctaagcgggctagtggcggcgcatgagctagcgagaagtggcggcgtgcgtgtcaccgtgtacgagaaggaggaccatctcggcggcgccaagaccgttgccgtggacggcggagcagaagaaggccgtgtcctcgtcgacctcggccccgtggtcttcaacccggtgcggaacatgcatgcatgtacatatatatgcacgcaaaccgttggccaccatgcatataatgctctcgtttgggttaattagctagtatttgttataaacagaattgctacctgctagaaagttcatagtaagaaataattaaacggaaaactatcagacaaattccaaaatctattaatgagccacttggtggagatcgacagagacagagacagtgatcagtgctgggtgttccttcgaattcattgagagagaggtctccttttcagtggcagacgactttaatccctccaatccatttaatggattttcagaggcacgcattgctgcttattacactaacatcttttctaatgtattgaaagaattaaatttctcgtatgcgtaggttttacatgcatggcgttgctactctcgtctgttgtaagtaagttgtaactcacgatctaaattgcaggtgacaagcccaaacttgatggaatggtttgaaaggctaggggtggagatgtgcacatcagacatgtcattctcagcaagtatgcggctaaacaaaagtagtgaaagcttcgaatggggtagccgcagtggtatgtctggtgttctggcgcagaagagcaatttgcttagccccagattctggctcgtggtccatgagatattcaagttcaagaatcacgccctcaagtgagttcgatgatggggaattatttgtgcattctgccataggccggccggccatataaattcatgctgaattattgataaaaaattgattctttattttgatttgcaggtacctggaggaccacagaagtggtcctaaccgcaatgaaactttggggcaat

SEQ ID NO: 1250 - DNA, 1787 bp, Zea mays
  misc_feature (1)..(100): optimal_loci_132451_G1, chr4:4904846..4906632, Cluster 8
acgatatagatgatgatgcaatgcagtccacaaaatcgtccagaaagaggtgaagcagttgctggtagaatacgccatcattcgtctgttactgttagttgtaaatgacaaaactttgccaccaagcatgaacacgtcacatatcagatcgccacgccaaaataagtaacccctggaatatgctatttaatttaagttcattaacatttcttttagttagcaatatagctagggttaatgtcccaataacattcagtattccacgtgggtcttggagttaattagacaaaaatcgtcatactacaagactcaaatgtgtagcccctggctacctatttggttagagcgcagctatgtagagaatcagtaaaaatgtgaactaaaacgaaaacaatatcgctcgtaagcaatgtcatcgtaagtccctatttatacatgtcccttgtttaattctgcttttactgagtgaaagcgaaagtttttgaacttgaactgtatcgagttggttcttgaactcggaaaacatatcgagtggagtggcctaggacaagaagcaccgtcgagcttcgatgctggagcggaaggagaacatgggcaatgaaatcagattgcgctatgaatggaattataagctcactaaattgtgtgcaatgttaatgaagtgtgtatactctggtttggagtactatgcaagtgtcacaaaaaaaaaaggcatcagtgccgcacaataaaaccccggtaacatcgctagcagtggccactactttgacctctgcaatacgtgcttgtctgaaccacacacgttctgtatccattatcagctccattctagagactagagagctactgcctagtgccgtctgattaagaagcatcaggaagaaatatcattttttattgggaaaaagaaagctttattaaactcagtaaatttcaatccgaggataccatagactaagaagacctatggcctctacacagctagggtgtaaacaaccacactcacacacatacagaaaagaccagtcaaacctagctaaacatggcgaactacgtcatactccattgtcttcacaacagaccaccaacatagcaaaacttaggtcccggctaagactctccgaagacaatgccactccaaggagaacatgatacgcacacgcaccatcgttgtcgtggtcgaaccaccgaagaccagaccaaagactttcaccacagagagtcgatcattttccatcaatcagtgcctccatcaaaaccacagactcgccttgctcatatgatccaaatcactttcgcatgcagtttgttacttaggctcactttgtagccatcttaccatagagatgcgcttcaattaatcttctctttatgctattactgttatttagcgggctataaatattttggcacaattgtcgttctgttgcatatagaaagagggaacatgccgatataccttccggaatccacatagaaatatgtgcaggaatagccgttaaattcttagaaagcaccctagttttctcgagaaaccgttaaattctgtaaaagagcacactcattattctctattttggcagctaaggatcctttaagactcagttttcactgttcgaagtcttggacaagctgtctatattgtgttgcgttcatagcaccaaataattgcaaaaaaattgaacactgaaacacaatttattcggggaaatttagtcatatattctcaccattttatacaaaggttacaatacgacctaaaatatattgctagattatttaattgg

SEQ ID NO: 1251 - DNA, 2154 bp, Zea mays
  misc_feature (1)..(100): optimal_loci_136231_G1, chr4:23195381..23197534, Cluster 8
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(149): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
atacacatgggctagttggacgaatcaagctgaaacatcagacgcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacaaacacacacgcggttatactaggccaccataatttcggccccagccgacaagctaaaaaatgaccaaactctaacaacatttagaatctctgtaatttgggtaacaaatcacagcattagctaaatcatcctaaagacagaagttgattcatccggcgactcagatctatgtgaagcacatatttcagatatgagcaaattttgacaaaaaaaaaacaaattggtagcattatgacactacttgcagagtatattgaagtatgcaatctataaattggcagaaccatgtccaaatcaaatcaggacatgtttggatacacatggctagttgatagtttggctaaaaattagctatcatcctaaagacagaagatgattcatccttgagaatcggatctatgtgaagcacatatttcagatatcagcaaattttgacaaaaaaaaattggtagcattacgacactattgcatagtgtattcaagtatgcaaactatgaattggcagaaccatgtccaaatcaaatcaggacatgtttggatacacatggctagtttggctaaaaactagctccagtcaggcatgcctgcttaacaactggttggagacttggctaaaaagttagccgacctattagacccagctaaaattagctagctaacaactaacccaacatagcctccgattatgtccagaatttgtttgtacccacacacacatggttataccaggcgagcataacttcggccccacatcaggcgatctgaaaaatgaccaaactctaacaagaggtttagaatctctgtattctaagcaacaaatcacagcattagctaaatcatcctaaagatggaagttaatccatccttgtgaatcgggtctatgtgaagcacatggcatctcaggataggcacagtcacatgaaatgggataacttacgtagcctcttcaaatcagaagcaacaccatggctatggctcaagtgctccaatcctccaactgaccaccccgccctgccgctgagcacactgcccgtcggctgaccacgccgcatgcccttgccgccgccgggctgcagggcccacgacgccctgccgcgcgctcgacggcccgcgtcacgctcaggcctgcccctggcgcccagcccgcgctggcagctgcgtgccctcctatccacccgggccgccgcgccgcgccgcgcctgccacccccacccacatcgcatctggcgcagccgacgccgagatggcctaggcgcgcctgctgctgtgcggtggtcgtcgtactggcacgccgccatgccgagtactataacaagcaaaggtttgcctggagctttctcgtatggagagatgcccccattcgattttaaaacgtctagtccacatttttttttctatccaccttcgttcaaacaatagtgaaaacagacataaatgtaaactatattcatattactcaataaatatgtaattaatctaaaacaaattatattttgagatggagaaaatgctaattttttaaagttgcaaaggtgccatcggacaagaacaccaatctctctaataaaaacaccagacgcacttgaactggccttatcccgttaaaaaaaatgaattatattttaatttatagatagagtaccttcagaaatgccaacgccagatgaaacatgagacaagactgtctgctgattcccagccacggactgctcaggtccttgtgcatttgtgtgcgattctatccataccaccgctcttgtttatttattatatatacgctggtgtaagacgccaggttcagttattatattgaacaggtcaagatgatttgttccgattccaacacaaaataatagtcgtatgtatgaacgtgtctacaaaaaatttccacttgatttcccagtctcccatgacgtttgtgtatgagtccaccttccagtctagataatctaaccaggacgtccacgttcaacgtcagtggagtgaaaagcacgt

SEQ ID NO: 1252 - DNA, 1629 bp, Zea mays
  misc_feature (1)..(100): optimal_loci_153894_G1, chr4:139979597..139981225, Cluster 8
tatataagattttcatagatcatatttgcttcttagacatatattcaacccaaaccatcatgacatgctgcacaattgggctaatctgtcacataccctggcccaacattagtaaggcccagtccagcaatcctacagcctacttctttccccatcgttaggacacaggaatgcagtagcagtcagaatagcgcgggatattcagccgaacaaagaattcagatgttcgttcgaacaaagaattcacatgttcagttggtaagtcgtcgcttagcctgaagccgacgccgacttcacctcaagggaagcaagcagacctcgctacatcgcgcgatgctgtcattccacgaatttgtatctgcgtatgactacatatatatctccgaaattccctcgaatttatctgttatattcagatcgcaatatctccttaccctgacagccgggttggattgagaaaagaaaagctttacgaagcgttctatgcgtcattcctcggtcctctggcctccagtagcagtagcaggatcaggatcagggcccgtttggggacggagatgctgatacggcggcaccgcggcagtaacttcaggcctggtcgtccggggactccgtggaggtaaaacccagtgctggtagtttctcgtgtctgctagaataacatcaccatcaactaaagcatgcggagtcgtacagcaacactgtaggcagcgaacggctgtacatgagaccagatctggaacaaacaaggagtcagagtcatttactactacggtgaccgaccggcgatctgaagcatgaacagccacacaggtaaaaaccatcagagtacattcggagttccctgcactgtcaatagagcctgcgagaatactgtagcacaaggctcgatccgggcgagatctggtctggtctgaactctgaccagatcaatcctcggtgtcacaacacagccacccggccgaaggtgaaaaacaaaaactggatcccccaccctcacagagtgaggtcgtggtactggcacctcctcaaccaggtcagaattggagcacagggcggtggtggtacaatctgtcatgcctcatgcgccggtgctcgccccagcctcggcagtttttattgcgaggtacaccactgctacaggacgatcagtgactcaggactgtatactatactactattccaatgaatgcgaatcgttgttcttgcgtgggaacaacagtcgtgcgtgcctccttcgctactcgagtactcgttactctctcactccaattcccagctcagtttcaccggccgacaatcactctccaagaactagagcagtactcaccctgtctaaaaaagaaaagaaaaaaattatttttcaagaatcaaacaacttaaatttttatcaaaagtatatataaatataataatatttatgatacaaaataagtaagtactattaaatagattgtgaaatatatcttttagtacatctagttaaagacataaaggttgttggaatacactataagtgaattactcatcttttttaacagctaagcttttgagtttattagttgttacataaaaattaatatggtaacagagacagaggtcacgagttcaaatactagctagcacaat

SEQ ID NO: 1253 - DNA, 1640 bp, Zea mays
  misc_feature (1)..(100): optimal_loci_157567_G1, chr4:160105626..160107265, Cluster 8
cgggcgggcaggcaggcaggcgtggtcgccgcgcactctcggcagggagaattgaagggacccagcccttgccccttggccttggacacacggtgacgatgcagcgaacctgggcgcggaggagagagagaggctaggccagtggggaccggggaaaggaaaggagcagcagccttgggcgtcgagagagaccggcggcgtcctgcgtgcgctccagctgccgcgggccggggatcgccaaggcgcatggcgcgcgacgatgcatccgcaacgacctgatgtgaccagtgctgactggagagatgccgtgctgtttcacctttcacgatgattggatgaaggatgctcgtcagcagctgagattgacgagaccagttagacgagcagcatgcagtccatcggcacaggcgacgaaagacggcggtgtttgggaacatgtatggagcgaggcagcgagcatggaggtgtgccgcttctaccaacttctccggcgacaaattcggcaggaggtcgccagatgatgacggtcgtgagcttcgtgatagtgccttggcaccgaagaaaccagaggccggccggactcccgtgcgctgcacctggacggagaccgacgggtgcagcgcagtgatgggatcgctcagtcatcgctcaccatcagcccgggaagtgcctcgaggctgccgactcggatggaatgggcagccgatgggatagggtcatgggaggtttgtcctgttctcgtctggactaggtgaaacttttagaacgcccacacctccacagcatgtagatagagtacataacagcatcagattaggtcgcagagggcagtattctatgcatgccaactagtgggaaaatatgaacaggatcatggggaaaaaacaagcttccagtcaggctttaaaggtacaatcacagagtgtttagaagcaaagtgtttttagagttttgaggtaaaaccatgctattgaagaatatcatcgtgttttttgccaggatatgtttagctatcttataaaagaaactatgttttgaataccatagtttcatagataccatggtatttttcgagtatttgaaacttcactccgatccaaagtttttatctattactatgcttatacatgtatactaaatatcatagtttgatatactttgtcttcaaacacgtattgttaaaagtgatgtacaaaatactgcgtttgtgtcatgacatcttaaaatcgtagaaatctaaaaccatggttttaaaacactttccttctaaacagtaacacaccaccagtagcttcagacgccggtattttgaacatttgaggagtaacaggagtggccatcacatgagattttggacaactcagtgcttaatcaactcaagcagcgtcatttcaactcggagtctaggaaggatgtgatcagatgaaatgattcttcgttcgtaaattgaactttagccctatatgtaactatgttagtttttgacacggaataatccataggtcggatatggaccatgatttttgactcaaaaccggacccaaaaccaaccctgctacccaaaaaaacccaacccgacatgtccaacagggtggcacgaccaacccgacccgattcgacaataggcacgggtcgggcac

SEQ ID NO: 1254 - DNA, 1420 bp, Zea mays
  misc_feature (1)..(100): optimal_loci_157615_G1, chr4:160282032..160283451, Cluster 8
cgctcgaccgcacaggctccggcaggcggcagcccaggtgaaagtccagcgagaggcgcgcgcgtgtgtgatagtccgccctcgacttggctggcggcggcggcggcggcggcagagcgccggcgcccatacccggcccaggagcacatgcggcgcgtgccaccgccggttgggcggtgcagccacgcgcgcgagcggacgacgaggctcgggaccgctagctttctttattactattttttttaccacatgtgaaatcgagcgctagcctgctcggtttgatgtccctccttctggtcctggcctcctgggtgtacccctcgccttgtcgtatgcgcgcggtgtctatgtcatgtgaaacgcatgtggagtgcatggggcgctcgatcgaatgtgatgcacgatgcacgtttcggaattcggacctacagttccacgcgaagacgagctgcttttggaacgggtttttttttgggttcgtgcgtaacacggtgttgtccgtacaccacgattttgcgcagatggatatgttcgacggtgtacgaaaaacgtaaggttttcaagttggatttgattggccaaggccacacgatcttgctctgaagggccttacagtaggcccgacagaagaagaaaaaaccttacatgaggcccggaaatacttcaagggccgatatttggactgtctggttgattggacacccatgacgatgccaggctattttcttcggggccggattaaaacagtgtacgcccggcccatgaggtttttttttttgcccctcctgtctccgctctcctttttcttttcctccacaccgctgatcaggttccgagttgttcgtgcagcggagatgatggtgtcgttgctaattcgtactgtgtcacacaaacggacccgttacatggcccgattagtcgagaacaatactaatttggcgttggacttgttacagaattaggtattctcgtttgatttttgatccaattagatgcgaacagattggcggcaatagaaagattgtgagtgccatcttagcgcatgtttggcatatctgatatctccggagtagaactccaagttggagtaaatgttttctaccaaaacacctcgactctatagtttttttttgagttgtagtaccaaaaaaaactgaagtaccacttccctgctttgaaaaccagctaaaataaacatagatgtggattttaagtgtttacccgcaagtgtctcacgttacaaaaataaacggttcgagttaataattgagttatatctataaattttaagtacaaaacattcatgaatcattagccaatttacttgttcaaaataatcattgttgtatcttaatcatttttacgtagaacaaataataaactaaatttcgggatggttacgagtcacctgcggttgaac

SEQ ID NO: 1255 - DNA, 1753 bp, Zea mays
  misc_feature (1)..(100): optimal_loci_160672_G1, chr4:179080122..179081874, Cluster 8
ttcaggcaggtgcatgaagggttaggggcgaccattcaccctatttagctccccctatatactataattcagttatttgacttttttcatcagtttttgaagtttaaaaaatcatagactatccacactgctataatacacattgttttcgggttacggtaattaaaggagattaatatcataaagaaatggattaattaaagtatgagggagattggaacttacctcatatgtggagcccctatgtggctaactggctatgtggggtgtgatgtactggtgtaagggggtcattggaggtgtttgtcacctcataatccactggacgtggggtaggggagggttacaggtacgtaggagatggtcttagatgaaattacagtgtagtaaaattttcccatccactagaatctagtcgggtggatgaatcgccagacgctaggacaacaagagcgccaataacaaccgatcccagttaccccaggcccagagcggtatctcgcaggctagcgcggcccactccttctgcacggctgctctctggctattgggaactgtctggcgacaagtcgacaacgcagacccggccccacaacatatacaaccctcaccaaccggtgagcgcctcacccaacactttcgagcgtctgtaggtaggctgaacatctatctgatcggagttaacacgggcatggattacagcactccagtttctgctcgccgacgtcatgccttcgtgcattcatccatgtattcgtcatcatagttacggtacaaatttctgcaacggacaagacgatgaagtcggtctcccagcccaatgctgtttctcaaaagcctgaaggcttctttgctctgaactccccattaccaatgctgtttctgaagtactcaacattgaaaaagagctactatactagtagtggatagattgtgatctacacccaacattgaaaaagagctggctgcgcaacctgcaagggagatgtttgtgggcgccgaaacaacatttaaggaaggtgaacactgaacagagctaaatccaaacttaaattccaactgcacgcgaaaattacattagctctagcttccactccgagacatgtgcctggtaagttagcaaagttttacatattatcactttgtttttctatcaatctagccgcgcatcatattttagagttgttgctaatggcaaactcctgcttaagcacacaacgtgagctgcagggaagttctggtttaaaatcttctcccatgtgtgggtgacagtttgaaactattttgacaggttgagttgcagaaaaattgttgctatgctttatcaatatcatcacttgttgacgtcgatacataatacttcatttgtccaattacaaatcccttgatatgtttgtcatgataaaaaagacggagtattttggcttagcattcttctgtgtatatcatgtacacgtaacatcatactgccctggttgtgggttgtgcagcggctcagttttctgctaggatgtcagtctggatacctatcagtgatcactctttttttcagatggaactgtagtcttacgaagattgatagccagttgtctgagaacactttatgacggtcacatacaagtgcctgacgaccattgcctatttacatgtactatttgagtgactctgcttttcttctgctgtcctttttctgtatcaaatcgaagccgcaacctgatgaatcgattcctttgtgcagggtgttcttgggcag

SEQ ID NO: 1256 - DNA, 1935 bp, Zea mays
  misc_feature (1)..(100): optimal_loci_161119_G1, chr4:182290745..182292679, Cluster 8
cgtagcaacagagcaggaagtgttcctctatcggtgcatcagagtcagaaatcgccttcggcgtcactatgatgatactgacctcacctggcctcacacatcggcgtcactgacgctgcatgaatctacacgcgccgtcctcttcttcggcagcttctcgtcacttctctcccgggctgtagagagctagtagaaaatggcgcggtcgcatggaggagacgccaactcgagcaaggcagcggcgcgccggtgcacgtggtctcatcaatgcgtgagcattgccatatccctttgggattacggtgaccgctgatgatcctgataccacgcgagcttctgatacacggagttgctgtcgctaacgaacttgcagcgcactgccgctgatagccgcgctgccattgttgaccaagaggaacctcatgcgttgcatccgtcggcctcggccatgcatgcatcatcactcatcagtggtagctgggctccgacgatcaccggacaagcaggcatgagccacccacactgccctggcaataaggagagaggtgactctgccgagtcataatccatctttggccaactatatgtaaattataataaataaacacctaagcccctagctaggtataactgcctaacctaaacacttcaatttatagttttattttactcagggtggacgtttgacacgatcttgatactgcagcctcctttttcaggaggctgctggttggcaggtaagcagcagaatggccgtctcaaaaaaaaaacctaaacccattccattatcaggaagcgattccatagtgtagagatgaaatttatgaccaggtcatcgtaatatagttgtgtatcaataaggcaggcaccaatcggtgacctttcatagtttggtgctgtatgaaaataaacctagaagctgcacacaactgcctgatgaatgttagggaggttgacctgaactagctagtgggtggatgtgtggatccaatccaaactacagcgtgttactagtaaatattctccgcctactgaacacgacacgtagaccgtggaaaactggtgaagcgccaccaaacgatcggtgttctttcgcaagaaaatataatgagtatagacaaaagcttttgctgtctgctgatgaattcacttgcgacttgggaatcccctactggccaagccgtgcaggtggaaaacccacatcgaccagagcttcggcggagcgtgcgtcgcctgcagccagacttcgacgcgcgcgtcgtcggtacgtagccggcggtggtggtggctgcttgtcgtttgccatggatggactctaccgctgctccaggccactgttttcggcgtacgttcacggtacgtggccggtggtggacaggacgtacgcaacagagacagagacacagagagagagagggggagcgaagacccaatggtcgatccgatggaacgatcgccctggtccgcacgacgcccgcgagaacgaccaattgatggagattgcatgggggcttccattttccctctcgctgttgccgcactgcaaagtacaaacaaccgcccccgaacacgtacgtcctaacgtccgttcacgtgcgactcctgggaaaaacgatccaggctagcttccctccctcggcggccaaaaaccgcgtctgaccgttggatatatattttttttttggccggtgatgaggatttgaggtagccatcgcatcggtttcaccgcgccactcgcccgtgcgtgcgccccgccagggcacgcacggcacgacgccgagccgagcagtcaccaccgggttcgctctctcggcaaacattgccgcgcatactacccgagctgaccgcaggcatccgaacacggcgcgtacgtggcaggccgcaggggtagaaaaggaggaagagcagtgggtgtgggttggctagtcgcgttta

SEQ ID NO: 1257 - DNA, 1503 bp, Zea mays
  misc_feature (1)..(100): optimal_loci_16772_G1, chr1:93076603..93078105, Cluster 8
ctggtaatagtgctaaatgcctacctaaccatcgcgctactgctacgttctgggaccggatctgcattttttgggatctactattcattttaccccgctttgtctctctcagacttcttctggaagaacaaacaagtctgcacgcagacaccgcagatgtcacccctgctgactcttgttgctgcaatccaagatcgtaattgaggtctgggcatacaccacacaacggtcaatcgttggaaaaacaggtctctctccatcttgcagtagtactgaccgacacatgtagaggaagctggcagcaggctgcacggtttcttgctcgtaaatacttttaaaatagcgcgtatggttccagttccagcctctcgtcagggttcttcgtcggtggttggttttcacgcacacgcatgaccacaccaccgcgctactattttcattccatgatactcttctacccggagtatattcatctctccggatcctaactaactgaacgtacatggtcaaaactctagaccgcgggagctgtatccaggactttctgcagaggtctcaaaatgcacatgccgtgttaccctgactcgatgctacatccgcgtacctaccatcgtcgtgtatagacatctgcatcgattggcagccgccaacaagatgcaggcgataggagcaaggtaggcgatcagggtgagagtgagaccatcggacacacctgctccggatgtatccgctaatcactacatctaatcgtactcagtaaatcttataccttcagtgggagcaaacaaagaaggtgacagactgacagtagtgtatggggcacgagcacgtccttagcaatagaggaagtagtcgtgcctcagggcgacattgtcgtggtcatggtggcggcgagctgccctcacctctgcactccaacagatcagttagggtttttctgtgtgtatgtgatggcgaggtggtccgggaaaggaaagctcccaagacggccccttgccccctttttatagtgtagcacatctgcacatggtgaaggaaaccacaaccattacaattattatgctctcgatcatgacgcgataaaaaagagtcaggaaccgtgtggattttcggtaaggttgaaaacaaatcaacataaaccaatcgccaatgcttagggatacctgctagctaggagcaatcacgatgatgcggtcaaatttgtacatattggctttagggatgtccaaagccatggcatcgaacggtgtgccaagtgatcaactagctcaacctaataaaatagagggattgcatatttttccaaactatttttatacattttaattattgtcttgttttacctctgtataggtggataatagtcatgatcaacctgtaacaactgtaagatgatggagcggctttcgttttagaagatggttacatttcatgagatgtatacctcatatgcaaggagcattggttttagcatttgaaaagagcacagaagatggttacatt

SEQ ID NO: 1258 - DNA, 1867 bp, Zea mays
  misc_feature (1)..(100): optimal_loci_172865_G1, chr5:2762554..2764420, Cluster 8
cgagcccccttcttgatgtcaagggccctccgcttgactctcccgtggagagtcgagcggagactgctacgcgcagaatccaatgtaccctccgtttaatgatcatgtgtaagaaatgtctgattatagtgtgattaaacaaattgaggtcaagttcggcctctgcaccaacaacagtaactatatcatgtggtaaaaatagagcataaggaactaaagcatgtgcgtgtaaacgggcagctaggcacagatatttacaatgacgacgggaatgatttagtgtcagaaatatctcgcagcagatagagcaagcagcagccagtatagggcagtggcagcagtgtataccgggaaatgtttttgtttgtttgtttttccattcattcacgatggatggtcgatccattcatggcgaagggggaatacgtaccctgcttgtctctagcatgtgtcgtcttgctattgatacggggcgcggggtgcatcatgtgcatgagacgtacggtacatgcatgcatggatggcgaaagaaaagaaaggcgaggcgaggcgaggacggcgtgtggtgccagaggagtgacaccgcgctttattagctagggcatgcaggagccatgaagaagctgcatgcatgctcaagcaaggcgggcatggccaccagtagtctaccacagccacatgcatgcatggtgtggccatacagatatagatgccgcgtgctagcgtttggcaggggagagcgggtcgtagtagcactggcactgtagcagtagtgggcattggcagctggtggcgcctcgatcgggcctcgcgctcgcttcagctcaaagcaaaagatagtggggcttgatttggcgtagaaacaccggagaggtctctcgctctcccctgtttccctcactcctccccatgcctcaacaagcgtgacagttgtctcagtactccacagtgagtgagagagagagagagtgtgtgtgtcctgtgtgatcttcttcttgaactataaatagggcaaggcacttggggccattccatcttcattcacttccagcagtagctcacactccgatccatatatatatgggctagtgcggttgcttcgacagagcttggtcttgcgctgctagctgcaaagaacgacgtagctactatacatacacatattcatactcatagataggaatagtgttagacatgtgatggtgagaacctgatcatgcaagcatctgaggatcggagaaggaaggaagggtatggaacagtccttgaagctcaggagggatagcgcctaggaaatcacacatagattggagccacgaagaggaagggagaatgagagagagagagacagagcagctatgctgctctgtctctctctctcactttctcttggatccatctcaaggttctgtctatatatgatgaatcgatccgaagcgctatctatcctgagctccacggcttgttcttaccagttacgtaccacgtacgcgccgccgccgccgccggccgatctcgagctcctcgcgcgctcccagctagaattgccttctgtgtgcgtcgtactccttcattctttcttgttgagatgcaggaggcgagcctgagattgatcgaggtcgtcgtcgtcgtcgtctcgtcgctagtagcttcgcttcaagttcaaggacatcatcgtccccggccggccagtgcgcgtccgcggccgatccaggtgtctcatcctgctggctccatgcatgcatgcaggcatgattactttagtagtatatccgtgtgcaggcggatgaggtgtgtgtgcgcgcgctcaccagtcgcacgtgttatcatgcatgcatgcaacttgcaagagctttgacaagttatg

SEQ ID NO: 1259 - DNA, 1631 bp, Zea mays
  misc_feature (1)..(100): optimal_loci_172953_G1, chr5:3320325..3321955, Cluster 8
tctatttaattttaagcttctatttaatactcagaattggtattcaaacatttgatttgatgtgacacgacctaaactgtagtcaggaaaccaaatacccgccctaagcttatagttgtggtagattgtgactaggtatgaacaaaaacagctagccctaattaatctatctatgctacccttactagcgaagctagagctaggtccaagtaacttgccaaaattctttcttaaacaaagccacgatatatatgttcttgcagctgctagcctcgatcgacgatcccctttcttaaacaaagccacgatatatatgttcttgcatgcatgtgtgtgagtgtgacaatcacatcgtcaagacttttgtatacctgagaacgataggtaaccgcaaaattctgattaaataacacttggattctccaggcataacatgaaagtggaacaggatcaactatatatatgctttttatcatcatttgcatgcagctcgaccagttttcaattttctgtcagggagggaatagaatatctctaggctctagagctagctagaggactgaccggtggaacgaagaaccacaacagcaactcactcatgtccaatatgtaagcgaattaattcagcgggcaattaattatgcttttccacgctgctttcctgcggagaagagagcaaaagtgctgcaagtggcgaatactaagaatccatgaattcagtgtgtgtgtggcccccagaaaaggttctgtattccttggtcgccctatgagagatccagctgtagaatctatcaactgcctttggtcattttcgatcagacaacaagcctacacatttttttcgcgagaatttcagcattcatcaagattagcaagctagctagatgcggtcgcatttgaaaaccgtccattgagatgcgttaagatcttggactgctcctagaaatctactgtaccaggcaagggcaagaggcaaccgtccctgaaactttttttcaattaaatttcttgcatcaaccgaatttagctaactgaactaattaaactttttcaattgttgcgtaaataagttcataaccttttcaaataaacgcacctagaaaattttgttgttgccctttttcatctgaggatgtttaggggtctagtatctgaacaaaagggtagtatccagtacctgaacataaatgactatatacagtagtatgcatggtgatgtgggtcggtcatttattagtttcatttcttaggcgcgtacccatgtgtatatttcatacaaatactgtgctactggagaggcatgcgatgtgctatgaaaaaagaattttattttctatcgttttggtgcgttttatagtttttatgattcttgtaaaaaaaaactaaacctccttgtttgattttttgagatggctgtatatctatacctgtaaaaaaatgctccattacacgagttctgcagtctatcgacagtgcctaaagctcattttgtgtagtggagccgtatatttatcgcaataaatcatgatctgctttgggtcacatgatagaatagaatcagcatttgtggagggattgcctaaactagctacatagccctagctggccaccaagacgcatccgtgctcaca

SEQ ID NO: 1260 - DNA, 1528 bp, Zea mays
  misc_feature (1)..(100): optimal_loci_174632_G1, chr5:13401563..13403090, Cluster 8
ctggaatttggagacgaagcgcgcgcagaatattcgggtcaaatagaatcagctacatactatgtgcattagggctcacataaataatccatatcttgaggagtatcaagagagtaagtgtaaaaaaaatacaagagacatatcttgatgaagagatgtatctagctcagttctctaagtctagatacagtttcgtccatacaacccacataaatgagttatatcatgagagattctagtgaataagatatatgattatatacaaaaatagtttcttatatgtttttttgtattttgaaaaccgaactggagtcttaaggttgcacatgccctggatgtatctagtgtttgtaaaacctgtttgtaaaaccgcaacaaagtttctacattgtacatgcccttagggatgttaccaattttggtagtgaaacgcaataatgaattaagcaataattcaagcggatcagaattaaatgagacgtgtggtgtagactgtagagagtactctacgatatgtagtgggatacttggagcagtaattattactaaacatgaggtgtagtaaacattgacgggataacgctgcacattaaatactagtatcagtaaacgatgcaatatgcacgatcatggtccgagagaatattcggatcaacacatctatctcctgcgtttatatattattaaaactgaacgttaccgttttttgttagtagtgataaagatcgattaaggtaactccagcaacgttggatgtgtataacactgttttgtattgtagatgtactctttttatataaggagaagtttaaaatagaaattacgataacgtaaagtgggtttttaccggctaaatttgaacgttttccctttccttccctggtcctgtacttgcagtattgcactgtcgcctgtcggttcatcgatcggaacgacgacgtcgtcgcgcgcggcactatgggcactagtactttggtggcagtggcacacgttcgtagtgtgtgtcactttggtgtctggagcctgctggagcaagacagcaagtcaggctgaggccggctactcagctgggcgagtgggtgttgctgcgagctttggcggatatcagggtatgcatatatggcaacggctccaaaaacgcgctgctgcgactgcgatgccctgcagcattgcaatggctggccggccggtgcgcgttgcttggaagaaagatgctgtccggtcggcgaaccagcctcgatcagccatgcggttgtgatgcatgcgcatgcttaacagtctggaccctaacacgggctgggtgaagctgaagaggacctaatttttggtagttttgtttgactgaattattggtagttaagctagattagtcctacttttgggccggggctggctttctggcctagctcaacacataattgtttttttttctccatacggacggcgtacatgcgttcaaattttaaaccttgaccttttacttttattcacgtacggtgtactgaacccgccgtagtccggtagaaaa

SEQ ID NO: 1261 - DNA, 1794 bp, Zea mays
  misc_feature (1)..(100): optimal_loci_174637_G1, chr5:13404549..13406342, Cluster 8
tgtgaggtatacgatgaaaatcataaaactaggaaaattagtgttttaatatagtacagatattattctctgaaccaaagacacacaccagaatacaactcacatatgcattgcacgtgtgaagctccgacacacagggcgcaacaactcagctgctttctttacgtgatcagattgctagagtacttcacaaagggacgccgagagagtatcgttcaccaacctggcagtggcagttgccgcattgtactagtgtacaaaagcccagctgaacggtgatcagtggcctcccaatgccattctgtgtaggcgatcacagatctatcaacaccaccaaacccaagccagcacactgcaaaacaccaaaaggattgaagcaagctgccaaatggcacgcgttgcaggaacaccgaccctgcctgattcagagtcagaaatgcaattatagacgagtctatgggcattgtcactgacagaatgacagggcaaagataccacagtttcacgcgaaaacatggccgtggcacgttggccgctcgaggcaacaacttctatattggcatagccagaatgataatattgttgtacaactcagttagagatcgagtcgcacgatcatgctcgcactctctgattagggacgtaacaatctgttggttaataagttctcctttcataccacataataaatagtcaaagaaccgatacgcgaaccaacattcataccgagattcgatctaatatctaccggccatcttttcgactccccgaaccatagccggagtggccatgggcatttctccgcccttgatcagcatggcatctccttccaattctggaggtacaaatctatgttctatgatttctaatggctaggattacgagtcgaggtcttaaaatctaatagtggtatcaaagccatggttttaggctcgggctctaactataaatgacagttttccttaagttttatgacaaaatccgagaaaaacacctcttaactctttgtattcgtgttcctactcacgtagaacaagcaaaaggggagaaagaaactctaacccaacatttccacctttcccaaactctaatcctaaggcagtccataatctgagcacccaagcacacaaagaaagggaaagcagacgttaggaaagcagccatgtgctatatattcgaagacctagcctacacacacatctgtgaaactgtattaaattgttaaatatttttagtttgttaaatatttttaaattacgttaactcgtcttttctagttattacttatagcttcaaatctagtttcatttacgataaagttcaataatcattatccttctcttgattactattttcatttggtatgaatcatgatcggttgtttttctctaaatgtttgggtgagtaatctttaggcttgacaaacgaggatggtgaattcattttttacgcatctcatattatttaaagtgcatcacttgtacacgagcacaaactcgatggcatgtaagtgattttagggtgtgattgacacacaaaataggctattgggagtgacaaacaactcctcaagtctaaggactaaataagaatatttagaaaattagtatatttggatatctcatttaaaaacccattgaagcttgatttttggttaataacatcctacattatttttagggcctgttttgggaactagagatgttctaagggctaccactcaattggatacctaattagttgttgactaatcttgattagttggatgacagaaaatagaatggaactaggtaa

SEQ ID NO: 1262 - DNA, 1540 bp, Zea mays
  misc_feature (1)..(100): optimal_loci_174698_G1, chr5:13804245..13805784, Cluster 8
gtgagtttcctgtgttttgcgtatttgacattcagctacatcattgtagacgacgacggcgcatttgagctgcaaatggcttccatgcagtttagtatgtactggccagtacttctgcacttacaacagcccagagtacttccacgtttgtgttacgtactagtaattagcattcttaggaggcggtgtcactatctcttacaggatagggtaggtcagggcaatgcaaattttttttatgtaatcggaaagggcagggcaagcgttgagcaagcatcatgatcagtactgaacaattggttctagcaaaactaaatatgtcagggttcatgggtgtagtgatcttgcaatatttctgctgcctttactatatttctacatcttaacatgctctattcttctcgtgctcattgtggcggtgcaaattgagttgtttaagagaactcaaggttacgaggaaatctggcattttccctgacccaactttctccgacttccagtggctagtaggtttatgttattttcagtttccctttgtcagataggggttgttggggactgcttcacttcacaaaattctagcctaatgtagtaattttggcatgtacttgactaacaactttttggaaagttgttttttatccatgttttttggatgctctttgagttgctctcaattcgaccccaaaaaaaatgcacgaccaaatctttcccaacgccctcctctttgttcgatcacactttcttttcttgctggaatgtttgctccacctatttattaatgggaggttgctcatttctgtggagctgtggtttctagatacgatggccatggcgttcttcttccagctgctcccagatcaccccggggttctaatagccgcagcccaagtaaacgatggatttctggttacgcagcctcgcacatcaattcgattggtgcagctctatgttgtagccatttttttctcttcaataattgtttgctgaaacctggtgacgagtacagtctctgctgctgcgtggctgtgatgacaaaaaggttatttggttgattatgattcttaatgccatttaaggatcaaattgtgatgacctatttgtgcgtgtctgagccgatgcaatgaagagtccatttttgctgaccgttctgctgatctttctgctaaggattttgcactattgtttatctgattttggtcgtgggatggtaatcaattcggggtgcaagtatccttttatctgtagctggcaggatgaatggcaaagggaccaatcttgaatttatgtttgtcgattggatttctggcatctttggaacatctggcatggctgggatgacaaaaacatacgtttctcgatcctgatacttggttttatcaaggaccaaactttgatgacctttgtgcgtatctgagccgttgcaaatgagtatgttttccttatttattgttacaaggttatggccttctgtgcatctgggttatccagggtggctatggtgacacaaatgttcgtttctcgatgatattagttgtgt

SEQ ID NO: 1263 - DNA, 1564 bp, Zea mays
  misc_feature (1)..(100): optimal_loci_196803_G1, chr5:155106415..155107978, Cluster 8
tttgtattgatgtttataaatagtttgtgagatagtgaggccgatgataatatatgtattgtttgtttttatataattattgcgacctaaagtttatcgaataattacgtgccctcacaccgcacgggtacggtactagttaccattttaatgtatgtgtgtcaacggaggtaaaaaccggtcacccggtaatattttgcatggaataatagcataaatttttcgtggcgcagccgcagccgcagccgcagcctgccggagtggcggtggtggttattacaggagtagctagtgagagctgccaaacagctccttttcgatcttgatcaatgcatccaacagacagtccagaatgtcaattcgagcgattatacgtacgtacgtctatatatatccccttcagttgaaatgaattaataaagcattccgtcaaacgaaccactcctcctataattattataaataacccccggccgctagtgtgccgtgcacctggtccactgccttttcccgatccgctgctagctaaatgggatcggatttggtctaccgcccggcgccgtggacctttctttctctaattttctatttcgcccgcgggtgccgtgccggtggctggtagctactggctagctagctgctgcgcaggcaacacacaaggtggtggcatgtggaatcctatatacggacgcatgcatgcacgtacgtacgtgtacgcttctaggtttaattagtatactgctggtcaaaagctctctcttctcatcctgcgcttgattcatggagtatatattaattagttttgtgcataccacaacaaagtgagagctgtcacgtacgcgtgacactaacacgcaaatattacaaattaaactagcttccgtccaaataagtccaactgtccaagtgaaatgtaggcgggcgcgcgattccgtcgtgctttgtggtactagtacgacgtatgtactagtcggcgaaacgacacgttgacgaatgacgatcgattcggtccacgtacgtttaccgctagtacggcaaaaatagggcttcgtgcatggggtcatcatcaatgcctcccagacaagaatcttacctgacatttgcaaaatcagacgttgtaagggagatttaagcagctccatttcttgttttttttctgaatctaaagatattttgtaagggagatcccacaatgattttatttcagataagggggagtatacacagttttacgggtcggggcgattgcagcgagagttttacggtatcggctagcgatttcctcgttctatacgagttaacaattaactctttgacaaacgtatctttgccgttggaaacagttggcggtgtgttctcgaagatccagccattcctgcacttccaaatgcaccacaccatcgttactatgatttccatgcatggagcacagttttgctagttgggtcttgattctttgtaatgccacatgaaggttcgacgttctaggcggcagaggatcccgattatttgccagcattgcttggcgaatccgaatctgaggaacaggtgcgacacatatgta

SEQ ID NO: 1264 - DNA, 3103 bp, Zea mays
  misc_feature (1)..(100): optimal_loci_200253_G1, chr5:175216246..175219348, Cluster 8
accaaaaacagcaaaacaacataaatgacaaaacaatatgtctaaggataaaattagtatctcaaaaaacaaaataattgacgagagtgggatttgaacccacgccctttcggaccagaaccttaatctggcgccttagaccaactcggccatctcgtcatgctggttatattttccacatgttgtattttatccataaacgattttcttgtgtcaacgcaccaccattccttttactcctctgaacctctgcagattatacagttcctcggaactgcaagaacacgtgagtcgccaatccgttcttattcacttcctgttcttcaatgtaatccggaacgccatctcctcttacactatggtatgtcgtttccatgaggtatataattgcattaaggatatcttgctgcccttttccattgtagataaagagtgtcatcgttaataaagagcgtctcaatcttcagaagatcatacagttcttgattttgggctgctgactatgacgttgctgaactcaataaaacaaacgatgtctcaagaaagacaggcgatctgaaatcaagctgtgggccatacaaattcaactttaagccctgagagaggtcagagttaatttctgtcttgtatgaagtgtagcattgcttaggctgcttactatgacgacgttgctattgaattattttaatttatgtcttttaccagaaaacaaccgtaacaaataacggtatttcaaacaaagtaacaagaaggatttttagtttccataaaatattgccagatacagttacgagttattctgatggttttcagttcttgagaaaaaaattaggtcagacataaaacttttgctggaagattgaaattaaaaagcttagtgcgtacaagaaggcaagagaagacactagtaaagtactgtcactgcgagagcgccaggtcgaactaattacaaaggtggacttttacattagtttacttcaggacactgcaaatctacgttactactgccttcagcaaaacgtgtgacatgacttaattcagtgggtctcgaggcttatcatatgtaaccctgtttgctctagtgtaatctttcaatgccatgcatgtcgtggtcacatattcacctgccaagtatgggcccccatattgcgttgtttctcactggctcttttgcattcatcgcgtatatacatgtgcgggccgcgttttgtttacaacaaaggttgccttaacaggttttaacgtaacagtggtcgtgccggagtggttatcgggcatgactagaaatcatgtgggctttgcccgcgcaggttcgaatcctgccgaccacgtttttttttgcatttgatgatgcacattctttatcgtttttgcgcctcaggtagtcaactttttgtacggtttgcaccaagtgattgcctagaatccagcctatgtaattttttagcatcaggaattatgtagtttctatttatgttttatgaattatgtaatctttatttatggttcacgttattttttatttatgctttatgaattttgtagattatatttgcttaattatgtaatcatgtgtatttattttaataaaactacatgtttatgttgtctaaaagtttgtaaaagaaaatttgatgtgggggtaagatggttgtagaccgacgataaagcaatgttattaaaacactgttcaagcaatttgacctaaaacaaaattttacgacatttaaatgtttcatgcatttaagacttttagctactttggaccgagcctaagtctagaccgtggcgcttgccctactccctgaagcccgatggctagcatcgacgtgtgctgtcgttcgtttgtcgtgccatgtgcgccctctttctccgcgtcgtgtgccgctgaactaagctgctcactctccctccatgtcgtgagtcgtgacccgtgtacgccttgtgttgcccttctccttccgcgtcggtgtagtcggcgccatccacaccgcacaggcacagcccatcctttgtgcctttgcggacgttccacagccggctccgcgcccccggtggctagcagcgacttctctcatgtctcatcctctctactaacctcccaagaacttcgtattttatctgaagttatattatgatatattgaaattttgttgaagatgaaactatagcgaatcgatttactggaaatggtccgaatttttctttgcaccttccttgccgtgccgtgtccgctgtcttggagttggaattggaagcacctccggtcgagcgcggcaagcaagcaactaacatccgggtgacagatggagcggattggcggcctgatcgataggaactatgccccagcgcagcaaggcccccaacgttgtctctgtccattcatgaccccctcgctcaaaactacaaattctacgcgcggcacaccaattatgtccgtgtgccgcggcgtccgtaataaccagccagctagagagcggccgggagagatagagaggtggagcagatggctctgtcgaggacggcgtggatcgccggcggtctggtcgcgcggctgctgctgatcgccgtcctggccttgaccgtgcagtcgaggttctcgaacagaacctactacgacttcaaggccgccggctacaacaacgatctccagagctacacgtacgtacgtcgtcgtcgtcgtcgtctccgccggcgccgcgtggatacagcttaacgactattagtaaactccaggccttgctgaaacggttcttgcttgtgtgtataactgtatctgtatatatgctgcatgcgtgcgccatcggggacaaaaaaaaaaaaaggtacgcggtggtcgtctacctcctctgcaggggcaagcggatgatgacgcccaggcgcccagctcgctcatcctcgacgtcagtatgtacgccgacattgtacgtgcgctcgaccggaccgcgatcccgtaccgtagatatatactcctccactcatgtgccataggtttcaattcgatcgtgatggtgcaggtggtcaccgtggtgctggccagcggcgtgggcgcgggcttcggcgccaccgacgacgtcttggagtacgtcgagcatggctcgcg

SEQ ID NO: 1265 - DNA, 1495 bp, Zea mays
  misc_feature (1)..(100): optimal_loci_201486_G1, chr5:182591393..182592887, Cluster 8
gcgtaccagtaattgtaacatgtgtgtgtgcgcacttttttgtaggtgggtgggggtgaggggaggggatcataattgatatctaccatgacactaaacttgacatcatctatatcaccttaccgtagctgcttaaggtacgtagtgcagggaccagaagaaccgcactacttgatgaggcctgaaatccaatgataagacagactagcttagaatgactaggcattgcatcaaaggttgccgctttagaatataatgcctcatgtaagctccagatgataccatcttggtctcggaaggctggctagttgtaaatggaggagaaagagagaatataaaagagccgtacaacgctttgatcgaatccaatcgtttccagcttcctgcaatcattagattcaaccgcaaccaactcattcctacagtatctttcatcgttcctaaatcatttcattcgtccgaaccgtatgaattttgaaataaaaacggatgagagagagagaatagtcgttccattcgtcagcatatacaagcccaaaccacccaggttcagcccgcttttggcgacgtggatgcggctgaccaaagccacgctggcttgcatctgctgctcagagtgatatgagcgcccacgcacgcactctgatctgtgtcccgctgacggtgtctcgttggtcgctgctaattgttcagcagtaccgttccgtgacatttggtcaattgtcatgctagccacgtacacggttcatagttgtgtttttacatgttaacatttttgtttagtttcttacaatccaagtggtcgtgccggagtggttatcgggcatgactagaaatcatgtgggctttgcccgcgcaggttcgaatcctgccgaccacgtttcaattatttttttgtaaattatatatatattgcatgatattgttatttctgtttccaaattttgtttcaaagaacgtgaactttgttctttttggtacttttcaaagtaaaaacagtgaacctttagttttcagtctcattgcaacacggtgtttctcatgtaaaaaagggtcttgcgcctaaccatccacgtcccgttgtcggttgtcctcttcctcttatttcaactttcagtttcatcatctctctgctacatctctagcatccaatcacctcttttctcgttaagcaccagtgacggctcaactagtagctttacaatttcacacactacactaccatcacagaatcacctaccagaatgagaatgagatcaatgcttgcgcttgattaatgcatgagatcaggatttaatgcttgcttcactccgacaagggcccagttagcagcagttagtagcagccctagtagcactgcaaggagacgttcacgcccccggtagctgcgcccacgggagaatcggccggaggactactggacatacgatttcaggggaagggaaggtcgctgaacgacgacgcactgatgcggcgcgcgtttcgtgctggagga

SEQ ID NO: 1266 - DNA, 2093 bp, Zea mays
  misc_feature (1)..(100): optimal_loci_202600_G1, chr5:188746226..188748318, Cluster 8
atgtggccaagcataaccaagccagccaaccaccaaaaataaaaaggtggtcaaccgcccttctgcccaccgccagtaacgcagacgtgccagaatcaaacgctttcgccgcgctgaatagaaatagaaaacgcaaaaatttaaatccgtataataattgcaaggcgataataccaacggaccaacctacccacccgcaccctctcttgtgcacctccggctcccagtccactgcctcctgccaaaataaatccgtccgctctccagcttggtggcacaatcccatcgaaagctagggtttcaagcctcttccgacttctccttcccttcccttccccaccacaacgcggccgccatagacgcggtaccgcgcgaactcccatagatctgagcgagccaccctgcgaatcatcccctgacgcaccaaatctggtcagaaacggtgaagagttcggacacgatcttaagcgtcgttgatttaagaccacacacaaacacatctgtttgcccttcccccctatttttttcctgtttcggacgattcataagaacagacctgcaaggtttgcagatctacctgttcaagaaccagggaccttgttttggacgcccagaacgaacccttgaccctgcggatctgctcgatccgttttggatctgcttgcttttttctggatctagagagaatgttcaagtcgatggtttatttcgtgaacatctcaatcggggaggttgaggtgtggcccaagggccaggcgagcgcaggcctggccgtggcggcgtgggcgcgagatatccgcgttgaccgcctttccccgcccagcgagcggtgccctccgctggccgtcatgcacaccgtggccgtcgccgcccgatgcctcgtcatggagtccaggccgcccgtcgccgccgacgtggcgtcgctgcctctcgtcgacatgcacgccgcttgcctcagggacaacaaggtatatacagattattcctgacataaaaagagcttcacatccaccgtccaccgtaaaaagagagagagagagaataatctgaaaacatgaaaggacatcacaaatattatatggcggacgctttgatgaaaggaatgttttttagtcttattacatggacaagcttacgggacataattaattcttacatttaggattggaataattctgttagttttacttgaacgatcactggacaaggatttttggcaggattgaatggatgactaagaatgcactgatatttttcagtgatcacaccgacttggactcatgttcattcactttcgttgaactcattcctagctataccatcaattaaagtaaagaatttttaactttactgaggctagatggaaggacttaagaaacagatatttaagtttaaaaattgggatgtctgaatgccatgtattggtgctttggaattgggactcaattctgatgatctgtgaaaactggcatttatttgatactcgttggcttgaatcattggatgccgttagttgaccatagatatagttgtacatcacactaactgaatctgaattttgactcctgatttctgataacaagttgaacattaaaacatataatagcatggaatgcctgagtctgtcgtatcaagttactgtgcagatgtttttctatggcaatcgtataagttaataaagtcccttcacgttggtatcaacatttccatattccatatcaaactttgcctgattttagaattcaggaaatacaccaatgaaatgacagccaattcagattttgcaattttggacctaattttttgccgtcagctggatctccatgccttgatgacccctattttcttaaatatcactaagaatttaagatccatagctctggcgtgcagtgttagatttaaataagtgtattatttaactcttagagatttcaacattcatcttcaccttacacttgctccttcatttccttattattgatttggaaaccacatttatggttctatactgtatatatcacattgaatgctttaattccttgtgctttcagaccgcggttgttgcacttggagatgaagaattgcatttagtt

SEQ ID NO: 1267 - DNA, 1925 bp, Zea mays
  misc_feature (1)..(100): optimal_loci_203239_G1, chr5:192407488..192409412, Cluster 8
aaaattagtagtagtagtagtagtacgtcccactctctgtctctccgaaaatgtggatggatttgcggttcgttgggctgtctgtctgtgtcaacacagaaggacagaggcagactcattcaccgaacaaagtacgccgcaccctgacgtaatattatagtaggctactcgttcgcctactcgtgtttgaactaaaggccggcagtatgattgcgtgtcaaaaggctcatgcgcgcgcgcttttctgccgattcaatttgattgagggagggagacggtgaaattagtatatgtacatgtatagaatccaccggtttaaactttacaaaaactcactccaccaaatcagctcgtacccataaacttcaataaatcccgcaaacaaattgcagccggacttaacacaccattaaaaccaactgtttagatcgccggaaacccttcaatccattaactacttaaatacaatgtacaatattatttggatcttcattcatctcttctcctctcctaccaccatgaccccaccaccccacgctgtctctcatgccgtcgttgacctctcttttcctaaaatcgtatagttagcacgaactataatctaataaaataatgcgatttgaatcgggacctgaggtgaaggttgtgatccagagtgaaactgacataacgagggggagacaaagtgagatcatacagcccacccgagttaaatggttcaggtagtactgtgatgcagtccgtatctatgtattttaaaatttcaaaccaagccaaatcaacccataatcgacgagcgatcagcggcagagcaacgcacgtaatggaaagcccaactaggcgttggaatgtgtaataagatactcgaaaacggacggacggacggacgggtgtgagtgccgatgcatcgcaacaaccacagccagcccagcccttcggcttgctcacgcggcgaccgtgccaaaaaggcccatgcgcgaggcggcctgccgcgcccactgccccatgcgcgccaaactcgccgacctctctctcgatccccgcggccgatgtcccgtgcccctcaaatgctctgcagaaatgcacaacgcaagcaaatgcagctcaagctgacgcaggcagcagaggcacgcagtgctattcactaccgccatgccgccccggatctttcacgtaaaacaatggcaagaaacgttcgtatacggtgaactttgtcactgtttctctgagctcaaactttgtccgtaggatttttagacaggaagccccccccccccccaacttctaaaatcatacaaatttgctcctgcgactattctggaagtagttttagctaaactgacactacgtcagctgtgcaacatagcgccacatcaagtttaagggaggtaaaccagtctatattaataatttagtggctcaataggctacattatttttaaaaaaaatatatattacaaaggttaacacgtatcattgtggtttggacttacgacgagcgattgtcaaataacgtcttgagttgagtcgtgtgtactaactaagacgtgagtatatgtaacacgcttcttggtttgctaatgatccgccggctggtgccactactcgtccgtcgtcctccgcgcgatcagggctagccctggcgggaagcagggtgtgcagctgccctgggcctcaaaatttgtggggccccttagatatgtatagtaggtctataggtgtcaggctttaaaacattttggtccagtccatctcttcgaaaaaagtccaggcgagagaaaaaaataaaccgtccaatccatctgtcatgtgacctatattccctaattcttaatccttgttcctcgacatcgtgacgtcagtcgtcacgcacgcccgcaccagctcacgcgtcgcagttgcaacctattcccaaacagggcgct

SEQ ID NO: 1268 - DNA, 1505 bp, Zea mays
  misc_feature (1)..(100): optimal_loci_203488_G1, chr5:193733588..193735092, Cluster 8
cgataataaagttaaccaatgtgccaactgccaacacacttttcagggtgcacacccacttaaggcccaatcaagagggtccccaccagagggtgaccccataggacagaaagggggttgatcgatacaccccatttgttgcctaaccccctaagtatgtccatctaacataattgccttcgagcgtacctcgatgcaagaaagcacaaatgcgacacatctaaacaccccatttgaagtcggtcaagtggttacaatgtgcaacatatggatccatggacccgcctctgcttgcctataaatagaggttcacacctatccctcttgattcatggcttcaagtgaagagtagcattgctccattttacccttagtagtgcaagatagtttagtgtgggtgttagagtagtgagtttgttctagtttctagattaatctttttggagagtcaggtatagctcttatacccctttttagtaagactttacttcgtttaatatgtttattctttatatactttactaagttgttactttgtacaactttatacttactatattattgttgtgatatatatattatcttatagtcctacatattagatcgatgatccaagacccacacttgtatatgaccattgttttttcatttcatgcactaattggcctatgtagagtagtgagagtacatgtaaacatggtgtttatactagatcttctattagattgccgcttttgctagcatatgatgacaaccatgtttattttttttatatcttatcatgtggtttaagcaagttgttaaaaaggccggtgaggctcccgaaataaggtggctgcttcgacttggagttttgtcctcctactatctcaacgacctcctaaggctttgtttggttacctgcagtttctcaggatgagataaaatttatcaactagacatccaaacagtttgtattccatgtcttggataatgtgctatctgaaataatctcagttatcaaccatacactacattttcttgggtattgtgcactatctagattctgaaaatgaaccggttccaaacgtggcctaagtatacccattatatatatagagtcgatctatttgtggtaattgtacgattaaggtagaaacagcaaatcctttgctccccataaatataaaacagttcatgggcatgacgtacgtacgtatgctggtgcactcaaacctgatacggccgcatcatgtagtactccggttccggtcaaagcggcacacgcgtgaatgaatgcggtacgcagacgagcagccgcaatgatacgccggccacgctcagtcagagcatgcagcgcagggcgcagcggcctccgcagacggcaaccgctcactcctccagtcctccggcctccgcagcatcggcatgcagctgccacatgattgccctcctcggacccctcgcctcgccgagtcgccgggatcaatgcgacgtgatgggctagcacatcgcctatacgttcg

SEQ ID NO: 1269 - DNA, 1929 bp, Zea mays
  misc_feature (1)..(100): optimal_loci_203661_G1, chr5:194563445..194565373, Cluster 8
ttgatgtgataaaacaatataaacacgggcgcgagagagagaaaataagggcctcttaatatattgtagacatgcaaacttggacctaaaggtcagttctgtttgaagagtatacttggatgaaagaaggcccaaatgcaggtaaggtaattcctccctccgatcgcagccaaattggatttggagagcatattcggtttcacgtaggccctaaaagaaagtgcaaggaggaaaaagcagagaaaccgcgggatggtggaacccgtggtactacttgtacttggactcatcgcactagccaagccagcagccatttgtacctggccagtagtcatatcagtggaggcacatgcaccgctgtttcataggatcatatagtctagtttcctttgttttcctttaccgaatagaaaataaaaaagatcgatctttgtctctctggagcttttgtaaaccctcccggggtgaaaaaagcttttttggaaagcatgtgcagcacacaagaatttcatgatgattttacatgcatggctctctttcttcttcttcttttttattatggaaaagcagtgctacctccaccacccctgctctgtttcagtctctccggttccgaacaactgcaacccggccggaactgagatggatgggaacgtatttggattctaaactggaagtgtgaaatatatagcgaagaaacacaggtacgtagtatgtagtagtttcccaagaaactgaaatccacgtgggaacaaaaaaaccgataggccttatctggttggtgctctgtctcggaccagccatgaagtggaagcaaccgagagctgcaactatctcttgctagcgtgctgaggtagtggcagcacagcacgccgcaggctgcagctgtaaaccaacagagcggccgaaatatccatcaccacgattcacgcgccaactctccaacaagttgcgagcgtcgccgacgtcccccgctcggttacccttcttccctccgcggcagctgcagcaccgtaccctgcccagcactttctcgtcctccaccagttccgcttccggcttccgccgttcggagccagccaatgcccaatgctgttgtgctggtggatagcttggctagcactccaatggatatggatgaacgtacggccgataaggactccctagtcaggagtcacctgaagccgggacaggcggattatgcatgtcagaatcgctcgtggcggggcatcctcctttggatcatgctaggtggctgtgtctgtgtgtgtttgtgtgatcagtccactgttcattgctcgttctggaacctgaattttggtggtggtggagtccatgaaattacagattggttcggaatgactagacgtcgaggggtgcagtggccgtgcaaagtgacattgcaatagcctcaacgaagtggcagattagacagttgccgtgcaacaggaccgaccgtacaagcagtactccgatgtcgtccgctccgtttgcgacatttctcgtttgtcatgtttctttctgcagcaagcagcgaaattggtcgacaccagcaagtatagagtatagacagtagtatttttttttatccaagtgcacgcgttgttcaaaaataagggtttttatagcatgcctatcggtcaaactttttttaaactaaactagatttaaagttatattagaaaacatatgtatttctaaataagttcttttagattcgtcagctgagatagaaactaattattttagcccacaaaaaaattggtttttcctgttacgttgcttctgctgctgcaaattaaggcactatttgggaacaccgtttttccaaactgcagtttttcaaatactaaagtatactttagtaatgacattactacagtttacaatgcttcagttttcgtatacaacagtatccaatacattaag

SEQ ID NO: 1270 - DNA, 1483 bp, Zea mays
  misc_feature (1)..(100): optimal_loci_203772_G1, chr5:195132053..195133535, Cluster 8
gttataattactcagtatttaattagttattatttgtaaataatataaatacaattagccaagtactgtcatcccatccgctttattctatccgaataaacaggaaaaataactcgtcatattcatctaaccaaatatataacatagatattcatatgacatcactaaatatatatgcatggagtggagccatataaccaaagacacagctacagggctgaatggacgaccgcgtcaccgtcaaagctgaaatgccacccaggttcacgcgaagaataaaggccagaagggtgttccgaccccagactttccaaaagggcaaaatggttttctctgctacgataacatttaaaaaaacggaacattggtgacaacgacgatgtgccacattcacgggaggtgacctgccctggtgcccactgcccagcacgactactgtgtactgctcgagaaagaacacctcgaccaccttgcatttagctgttgcgcctagcttgctgaagattgcagaggcacgaggtcgtcggctgaaaactgctctctagcccgttcgctgatgtcaagctctctcccccccccccccccccccccccattcccttcgtcctgttcagctgggctatccagccccaaatctccgcatgctgacacgggtgccggccgctggtcggtagaaaccggcagatagcataggactggagcgccgccgcatatgttatcggtttgtataatgcaaagttgcaaaccgcaactcttgtcgtgcgctgcgagcacggacgttgagaaggcatcacggtcacggatgattggtcctgtgagagggacgcgagccgcccggctcttggcagccacaagagcgaagttggcaccgccggattggccggccgccgctctcgcgtatgctccaggcctgaagcaatctcaaggccgccgttgtgacaggtgtcgcctcttcatgatacgtatattctgtgtcccgaggtgaagccggggactgggtaggcgaagagaaggaaaagaatgagaaaaaagatagagaattctaccgagttcactgtttttgacccaaaatattacctaacccgaacaaacttgacaccactcacacaacaacaaaaaatagaggccaactcaacctaacctcatcacactaggcaagggtcgagtactgggcgtgccaaacgacccaaccttgatccgaccagaggcggacccagagcaattaaaatgagagtgagggcacacttataaagacaagcaccaagacaccagagcgggggcatctaatttgaattgagcaggggaccttatgatgaaatctagtctctactacttgcaacaaagaaatgagcgagtgtctatgccatcactcaatcatacataggtctgcccctagatccgacttgagcctgacctaattcgacgtttgaacaggtctaatatatgtattgcttgttttcatgtaatcgttatgcactaatact

SEQ ID NO: 1271 - DNA, 1839 bp, Zea mays
  misc_feature (1)..(100): optimal_loci_204491_G1, chr5:199393768..199395606, Cluster 8
ctctgcagtttagaacaatcagtagaaagaaagattaggaggaaattttgcttaatgcacttgctattgatatttgtttatttgtgatgctaacaggacttcacaaacactaacaatcaaactacaccctgatattattctcttgtttttgcggacaatacaccaagaggaggtgttagcgttaacacatgtaattgatttgctccaaaagggattcaggtaagtaattgtgtttcatatactgtaaaaaaacataatcaactttgcacaatgacttattttgtgaactagagtaaaatttattttttgtatgttgcatgcttttgcaaactcataaaaaacttatttgtgagtagctaaacatgttccttacatcaattcatatttcttctattttgtaaaactcatacaaaaccaacaccattatacaactgcataaactttggagaggacacaatttcttacttatatttatgttccaacgacttaccaatatgagctagtgggtcatgttggactatcaagaatccacaaatcacaagaaactactctagtgtttggtaaacatttatatcatcgattgtaggacccatgacagatctaagaacatctagtgtttggaaaaaatacaaggcatcaggcaaacaaattaaattgtgtgcaagaagtacataaatgggatataaatattaggtgcatcaagtacataaataatgatacaagttctgtcgtagcgacacccatagtgaagcaaatgtagaattacaaatggataaagtcggttatatctttacataaaaaagagagggtattgctgtaatagatatttcaagccaacaactactacttcctaaaaaagaagagagggttcatactccatataaatactagctccaactcgcgtctgatgatgatataatccgatttttatactttctgttgtacgagaatatttgctagaaatatgtgacctatataattcctgtacttgaataatttgattcagaggatcaaatcttgtgcattcgcctatcaaatttggagcaagatgcaagacaacggtgttgcgcgctcactagtggcttcacgtcttcttgctcaacatcaatgtgtcgataagtgaaggtggcaactgaatctagaggaggctcaatgggggcggtgactgcaaaagaggctcgagcgagtgacggccttggctggatctagagtgctggtggacgaacgaggtggaggcgacgatagatctggaggggtgacaaatccggaggaggacgagacgagatggggaggggactgcgtgtccagccttctgacgagcgttttttgtccccgtgaaaccggactgaaccggggtcacactttctcgttggttggcttccaaacgccaaaatagctacactggtattttcttgcacgagggcgatataacttgggtgaaggctgaaaaacccacgtggtttttgggctcccaaacgaaccctaaagggtttccctggatgatatggtcatctaagatccgatacgcaaaaagtaaggcaccatcgtttttattctaaataagcatatgctcctctattaagcatcaagtcgatcatttggatcacatatatacttaattaatccctcgacgcacaagaaattgcatcctggttggcagcaacgaagactaaactcaccgatcgattcacacttttatgaagtttgtagtaagctatgtggcccagatagagattttagcgaagaattctctatcaaggcttgttcagttgcatcgaataggattaaggggattaaaatccctttttatttaactttgattagttgattaggaaggga

SEQ ID NO: 1272 - DNA, 1466 bp, Zea mays
  misc_feature (1)..(100): optimal_loci_204917_G1, chr5:201693435..201694900, Cluster 8
tagtaaacttatttagagatagatggtaaatattttttactgctttctataaacctgatttgtgatgaaagggaccttgatttatgatgtaacgagttacagggtaccgcgccacactaccctccaatgcagttaagtctgacaaccggcacaagctcttgtggcattctaatttattgtatataaatagtttcaataagcgaacaaacatttagaccatcggcggactaaaataattcctctaacgatagacgacaaacttcgcaacattggtaatgtcaactaaaggtccgtttggaaactttgtttctcaagaccagtttataataccacgatttaatatatgctataatataactatgatatattttacattagtctaattcaacacctgtttagagacatagtattttagttgtaatataaatgaagactgtagctatgcacagccaagtttttttgaccccaaaaatacaatggtattaacaaaactatggtttaatacaaagttcttacgtgtgctctcaaatgtcttttagtctaaaatactatgatatctcaaacgtcttttagtctaaaatactatgatatgctcaaacaggccctaagtaacccgaaccggcgaacaaggaacagtaacaaaccaaactgctggtgtgacagggcatatcattatcgccattgcacatctcatcgtttaagtgccatcaagctgtctactgcaaatatatttcaattacacgggatagaagcataattaagttccaacaatggggtatcatgaatcgaaagcacaaaagctagaaacgatctattcagaggcatcttcagccgtcatgtagtgaagaatgaccatagcttcttgctgattgattgacttcgcctctctgaatcatcatcgtcctgctctgctccaagttcacttccagaaggcgtcatcattagcacatcaggcagtgcaacttggccatccacgatatcaccatcttcctcaccagcaccctgggcatgggcatcaccaacttcagactaaaacaaaacgatagggttacatttagatctgggctctggtgatcatacgtgctatacgcttatacccatacaagcacaaatggcccaaatgacctatgtatcgaaatactgaaaatcaattcaaagattgcctgaaaggaatgtgtagctacagcattggcagtacacgtgagcagtacagaacactgcagcaaagggtattattacctgcgaaaactggtgcaactgggatgcgccatattctgcagattcagaggctctcttgctctctggggcaggttcctcgtcaacctttgatgttccttctgtgccatcagcagtagcttctaatgtatgcttatttcctgccttcgcagttttctttttgtcagcttgagctgttacagtggcagcatttgcgctttggaacaatgcaacacaaaagtattagtttg

SEQ ID NO: 1273 - DNA, 1825 bp, Zea mays
  misc_feature (1)..(100): optimal_loci_205050_G1, chr5:202412582..202414406, Cluster 8
ttcccgatacccgatcgattccgtctttccgtacgtgcctgcatgctcaagcatatatagatagaatttgtcgtaaggtgcagtgtcagacgatgtccaactggttacggtcatcaacatatattaatattagttaactaatggcatcatcacggacggatccgaattgggataattactagaggtgtggagacagacaacatataatgactacgagacgtcatatacaaatacaaatagacattatatatatacttgtcaaaaagtgcaagcttcgtcgtttgatggacacaagtctgagttccatatatcggcgacgagagaggcgcattgcgtgcgttcgtcgagtcgaatcgcgtaccgtcgatggggcgcgcgacaggccagcaagtgattattatactagcttcggtactaattaactatagcttggccgcgcgctgattgattactgtacagagaagcaaagcatccgatggcggccggctaattaaaaacctgtggcgggctaaagacggattaaagtagctatagctcgcatgcaagtgggtggggagaagcgattaaattagattagctctgggattaagataaccccgagcggcgcgctgtctcttcgccggacatgtgctcgcccccgcgcttgtcgcgtttccatccaccaccgtaccgatcgatcgacggcccgcgcggctcatcgatcagctcttccggcctctgctgtcgtccatggcgcccgcccggccgcgccctcgatcgctctcgttaatttggactttgttggacagcgacggcggcaggcaacccagccgtagtaagcaagcaggcggccggcgtccgttgctttattggatggggctccatcgaaaggctagttgtctgcgatgacctaatcggggctaggtgcacgcaatccggccggccggccgcaatcagaggccgcattatttcgccacttgttgcgattagtagtagtgctttgccatttggtcgtctaccccattcgcatcgcagccttcagggtatcgtttcgtaataaagtaatacgtatgttgttatcagctttatccgcctcaaatgtcaatgttaatttagcaccaaattgtgcaattatatatattacttattgaagacttgggctacttattgcggtccatgtatataagcataaactgtgcactagccaacaatcctcgcctccggtcatcggtagatgcatggtacaatgatacagtataatataaagggccggaaaaagaacatgcaatgatgcgccacgctgttaagggaaaacccaaggtagacacgtgtcgaccggaggcgaggagccgccaggttgcacttgcaccagctagcgtcggtagcgatgccgatgcggcatgcatccgagtgggtcccggcctggccacgtgggaaagggagcgggccgtcctccggactctggagggacggcgcccacacgcacacgtggggggcggcccctgcgaaccgcagcatcatccagcgctggctggcgtccggcctgttctggtgcccgtgcccgtgccctggccaggagacgtcgcgtcgaatctttcatgctgctgccatgggccttgggccagcgacgtgaccaggcggcccgcgcggccacgtgatggtgccgggtgatctccgcgccgcgccctttccgttccgcccccggtcgctcgcgccccgtcccgtcatttgacactgctgacccgcggattgctgctgctagggcaatcgtcgatcgtgttttcaatcgcggattgctgctgtagcttgtagatcatgcaatcgtcaaccgtgtattcgtgttgct

SEQ ID NO: 1274 - DNA, 2362 bp, Zea mays
  misc_feature (1)..(100): optimal_loci_205661_G1, chr5:205827685..205830046, Cluster 8
gcatagatataaataagattgttggaagagaatgttagcactgttcctctttccacatcgtcacccgctgaagacaatactagtaccctactagtaccgacgctgtggcgccaagggcccaaggcccattaaccagcgctgacccaactcattcatgacagaactaagagtagctgtaacaggaacaggatagtactacttgagagagctcacaaacgttgcaaacgaatcgctagtttttataatcctgttcctgacaattcgttcttgtcctcctctatcttcttcttccccgcgcgccgagctaccagcctaccaccaccagacgaggagtaaattcgaattgaatgcgtgcatgaaccaggacaggacaggaagcgcttgaatgcatacgtgcgctcggctctttcaccacgcctcgctcgctctgttgtcacggctctttcaccaggacaggacaggaagcgcttgaatgcatactacgtgacaaaagcacggcggattgaaggctctgttgtcacggctggctcgtgacccttggtcgcaagccatgaatgacgcgggatccatagggctagccgggcagtccctccctccctccttgtccggccagccgggacgcgccgggctcaggctcacacctcggccgtgggcggaggatgggctgttcctttcggtggcgcgtgtcagcgtgtgtggcactggcagggacggcacggcggtctttggccgatgggggtcggtgggcgcgagtatcattgggactttgtcatgccagtgccgccgatcgtcatgcgtcgtcggtgggcgcgagtatcattgggatttgtcacgctagtgccgccgatcatgcgcctggctgggggggacctgcgtcggagcccggaggctagctccagcggacagagccatcgccgtcgctgctcatagcgcgtagcagaagggctgatgtcgtcttcgtctgttccggccggtggtccctctgtcatttccaaacatattgctacctagcactagcagtagcgagtaccgtgcgtaccagctgccggtgcaggtaataacacttgcaaccatagtttgtaggaggatattatattagacggttgccggggaagcagtaacaatacttcaagatagggtcatacttatattaattatgccatgttctaaacctcgcccaaaacacttctttttagcagctctaaccccagctaactactaatttgcggatctgaaacatgacattagacggttgggtaaaacgagaaatgcatgatcattccgtttgcatgtcggtcggctacctaatgtggtgttaagtcactgaccggtaagcaattgctttcccatgattagtgtgggacactccattcgtgtgtcttgactcatgggccatcccccccccccccggtcatcaaatccatgcgatatattttgtttgtcttcttttatacacacaagaaacgtttctgccctaaaatctgtgattgtaacgcctccggtgttagtcacaaaccgaacaacgggtttaaacttttaaacacgagttgtcgagtgataatcagagctttggttcaaaaaaattatttcaaaatagtgacaatcggttatctgaaaaataggccataatttaaactttttaaagataaaaaaccacactcttttgcttacatattgaccttttgaaaaaatgtgcatgagtattaatcatgtttacttcatattgcatcacataagggtgagcacaacctcaagttgatgtatttgtttgatcataagatgtttgttcttctgtgagacgatccttgtgtttgtaagtacgtagtaatgtaaccaaatgttgtttgatcatccaaacagcctagaacaacttaggataaaaaatgagatagagttcacccaatgtggagacacggtatgttcgtcatccccttcacgactcgtctagggataatgaatttgtggggggtgggcttggagtatatcaggaggaaatgcaacagatttaggtaattggagttatgaaggtgtggtaggtgcgtaaactgcgttgtcttgtgttttttggtagctatctggcattgggtatattgggacctagaaaaaaaatgtgctaagtgatcagcaaaatcttctttgtttttgcccatgatctttaaaaatccatctatttcttgcagggttagcttgttttggctttagtgcatttcatgtaacaggttttatatgcccctaaggtatgggtgtccgatccttaacgattaaccggaaaagtacaaggtgtaaatcttgcatgggatacagatgattttgattgctttgttccgagaggaataactttactttacatgatattgttttg

SEQ ID NO: 1275 - DNA, 1631 bp, Zea mays
  misc_feature (1)..(100): optimal_loci_2058_G1, chr1:10816667..10818297, Cluster 8
ggcttgaagtgttaggatgtcacgtatttatataggtagagaggtgggcttatatgacagatctaatctggtacttatctgttattccaataatattattgttaatttgtactaatcatattagacctccaatttaaataaaatttagaatatattctatttaaattttaaattaaatttttgggtgttatacgcgagttgaaaggagtattttttttaatatcttattgcaatatcctaatttatatcgactttacctgaggacttcgtgtacaaacaatccaactaaacatacatcgatacattatattaccttatatttttatttctaacttctgctttattttaaaaatttaaaattcaagtctaatttaaagataggttaaattttctatttcaagcataaattgcaacagaaaaaaattcaacataagtggaaagtatttttattaattaatttatctatttaagcaaatgctccaaacaatacatataacttagtaggtataattcatgtaagatattttaccataaaattatttaagaaaaataattcacacacaaaccaaatttttatatttaatatttatttaaattttaggaaaatagttttagtttataactttattataagaactctttaaatttatatttttaggattttggtgtaaagtgctaaactaggatggcttgttgtgacttcctatttttttgttttgggacgtgacttaaaagaactaaataagattaaatgattttatcacttttctaaaatcaccagactttagttaagttgttgactcagaagaaatattcttacttcttaagaaaccatccaaaaaattaaaatactgatatatttatattagaagacgtacgtcgatctcaatttctattccctttagttcctacttccaaacaaacctacaccgtacgtagaccattcctcaacccctccccaccaatttgtttaactaatctcctagacactcactagccctcgtgtccctgcccatgtcgtggcggacatgtacacgtacgcactagctccgcggaataatgatgcaagtacaccaccagcgcgaacttgcacgcacaacaaggagagtaaattaatagaaacaggagatgaggagaagcagacaagctgcaatggcgcgcacattatcgtaatcatgccctggccctgatggagaaaaggttgcacgggaggcacccgccgcatcattgatccataaactaaactagtcaggttacgtgcgcaacttacttctattcggcagcatgggcttttgtttatgctggaggcgggggcggctgtgtcgtctgcagagctggtgagctttgcaacaactaacccggtcgatcgctaattgttaagattaatcaaggacaatctagtgtccttaatcatgagtatcgtcgtcgtcatcatcatatgcagtgcctccggtctggagttgatgagctcaatcaaatcccttttggagccacgtagctccagcatcgagtttgactcataaacgcgcacaagttgtaatctgtagtgtctccatatttcgaatcgacacccgccgttacgaaattcatactagttttcatcatgaccctgaatttttagaccaagattt

SEQ ID NO: 1276 - DNA, 1830 bp, Zea mays
  misc_feature (1)..(100): optimal_loci_206222_G1, chr5:208920154..208921983, Cluster 8
ccatggcagacattgttttatctgacatagtcaactgcaaaacactaagctctgaaattagatcatttaggtcaacatcagatgagccatcaaaagagaatgttttttgcaaatttggtgcaatattctcttagctcaatagtatccaatgacttcaaggttgtggattccataaaaatccaaatatgtctttcaatgattggagttcttcaaaactactttttaatgaactaattgcaatatcaaccatggccaaaaaataattaatttcaaaagcttttttagcttcaagatttgcttcctcacaatcaatttcatcgtattgtttcttcctcttagcttgatgtttcattggaagtgatggccctacacccaattcggaagcaaactctttgccaatgatcaaactagaagcaaatccattatttctatagtatcttatattctcattaggtagcatcaatgcacattggtcccttctctactaatatatcccttgacttgttatcaagattatcctaatttcttgatcatagatatcctcaataaaaacaggttgttcatcaacaatgacattttctgtaggaggtaaattaaccataggctcttgatcattcacattgttatcattcatgttggtgtcaacattttcttctggtgtagagctctgatcttctgggctattatcatgttgttcctccataggaactatagccatcttattttggttccttgaagttattggattactagaaaaaaaaattatccaaggctcctctctgtgtttctataaacttatctactcgtttcttcttcttccttttctcggaaccagatggatactttctagatgacatgactgtacgctgaaattaaaaaaaacaccgtatagatgagcacgatatgcctacctcctcgcgacaggtacaccctaaacccaaacgaatctgtttgcaggaatgatgctgctgaccaagaagaaggaaacaggacatgtgctagctagggtcaaagaaaaaataggcaaccatatagatgagcacgacgaaggtgcagaccaaaccagaaacgaagccgcagctgcttattagctggagccgaacgccaccgagccgatagctataggcagccgcagctcctttgtttcccaatcgttgatggatggccacaagtgcactgcaggctgcagcctgcagcagcgctgcagcggcactttacatccagggtcaatcgcagaactttctggagacgcccaacttgaggggggatccgacgtggaattgagacagcatgtgcctggagcagtgtagtggagtagtagaatggaacaagcgtcaaaacacttcataattcacagatctgcacgtattgctacctcctcgcgacacgtacacctcgtcgctcttggggccactgttctcccgttttgtctgttccgccgcccagtgccgccggagccgctgccctgcactcctcaaaccgcacacctggcagtggcaccgtgcttggtcgccgttacgcgtgagagcgtcgaggcggcacgccgggacgagggcgagggcgagggcgagagcgagcaagtggtgccggtggggcgcacgtcggcttggggaccctggacccggaccccacggccaacgacaagtggtccgtgcatgcgcgctgacggcgacgcgtgcggggacgagtccctctcgcgggttgtttaccaggtccgcgcgagctggcccttggcctttgcttgccgtctcgagcggctactggcccactagacaactggcagagtacagtcagtagccgagtagcggcgcagctcgcgtggactgacta

SEQ ID NO: 1277 - DNA, 1862 bp, Zea mays
  misc_feature (1)..(100): optimal_loci_206616_G1, chr5:211070037..211071898, Cluster 8
cctaaatgttctatacgcaagctttctaaatgtttgccacacaagattactgtacaggattactaaatgttttctacgggcacgggacgcgcgcttaagttactagtagctattcaatgtggagtggtatcttcttcaccagcaacgactccgtttctctctctctcttccatccgtccgcctggcctcgctctccctctgctgccctctcctcacaagttttcaatgctcctactagatgcagcgtggcatcatgtatgtagagataagatcatgaagactgtaggcttctgatgagctgctgccagcataaagaaaaaaggaatagccagcgctagttttgttgtttcacagtcaatctctactagtaccaccggtagtactagctacatctgttcgattcatgtgtgacacttgataacggggcacggttaataaatttgagaatttatctataaattcgtaataaaaaaaagcattcatagcactacgcttttacacaggacgtcctttttttttctctttccacctgagggctgaggccagccaacagaacaataaaaagggagaacttgatccattccggcctccacggctccacctatcagttcacgaacctccgggaaatgacgtatcaatgcataagattactcctttttttttgaatcaaattcgtggagcttgtcatgacgtatgtacatttatgcatagccgtccaaagtcaatgcacgtcgcatcggtctcccatgtttcagtgccacttctagtagtagttggtcataaaagagaggctgatcctcctacttctactctggagtaccacatccccatgagtagtagtcaatccggcacgcctccccatggggagcaaagcgagaagcaattgcctctggcttaggaaacagactcccaaggaagatggtcaaccgaactcgttttaaaaaaaaaaatacagtctctataggctcgagatttcagaatcttttggaagcacctgaacccttcatgccgtgggttggtggtgcacccaatgacgaactgctctgccatgcacgcgtgcagtggtaggagagtattgtgcgccaaatcggggtgtcatgaggccatggaagtgccaacatgccggtttgcatatggatccaagcccaccagcttagcccaaccccgtagaatgaattcttcagtttggtcttttggttatcgatcccgatatataccattatcgcatgtgccccacattcaccaaggatttaatgccggttcgtctctttccattccagggttgcgttgcagtgctgcgccggatctgggcgggcagaaatccggcccgtttgtaacaaggcaaggcgcaggaaacggaaccggcggcgttgcgtgacgttttttttttctttattgtgtttgattttacatgccattataaaaatcttgttgacacttgatagagattgatccagccatgtatcatcaagggctaacaacacggcctaggttacaattaacctgtcacacacatagcaagcaactctaagggttgatgaaaggcgatgtaaagaccgattagaacgatccattctgttattgtacttggttgaggtcctaaatttctggcaaagaatctggttccgcacgttagcaccatcatcatatatactcccgtagtctggtatatgaacgcaacacagagctgacagcctaacagccgtagccagcacaaaaatactagtgctgtgaagcgccatacgcaaacagtagaagcgtgctagaactagaattgaacttgcctgcttgcgggtggcaggaaaactcaaccgggcctctatatatgactccagctgttcccagtattcccacccaaaccc

SEQ ID NO: 1278 - DNA, 2179 bp, Zea mays
  misc_feature (1)..(100): optimal_loci_2067_G1, chr1:10840663..10842841, Cluster 8
gctttagtagctagaacaaggacagggaaaaggaaagaataaaccaatggaatcagggccagggggggattaatgtataataggtagatcatcagccgtgatccagctgggagcatgcatgcatgttcagttcagatagatggcatcatctatcaccgccggtcaaagaaatggggaattattagaggcggatccgagcaggggaggagctagccgctagcccgctaagccaatgcgtggagatgtggcggcgtcatggctcacatggcttgcataagcgcgctcttctcgcaaggcgccaacccggttggggttggggttgggcgtgggcgtggctagtcaaatttggccgcgtccgtggaagtggaagtggaacgccgccgcccggtcggtggtccaatataactgtccgttaattaatatatactactactatgtataagtataacccccgtcctcctccggatcaagattatttggtgggttgcctgcagctcccgcctcttcagtacttataatactgtgttaaatgaatatcgctagattcatcatgtagtatatctagttagaatcatacatatagagttgtgtgtgtgtatatatattcatcgtagaataattcaatacacatgatagagttgtagatatgtatatattcatcgtagaataatgcaacttatatataacaagaattacaacttggctcctttctggcgcctggtagtacgtacgtaaccggaggctcgcgcacgtgtggggccgcgcgccatgatcgttcgccgacttcctcctcgatcgatcctaattctaacctacgttaatcatctcttctgtattgatggcgtgcgtatgcacctggggctgcagggcagttgtttatgcagctcgtgaagcgccacccctattgtacattcttgcttgctttatttgcgtccagtcatctggtcagtctgtgcacgaaacctgctactagcaaatggcgcgcgatcggcggtggaagccaaaaacgcgttgtttactgcagcttcttccccacgccgtgcgcggctgctgccactggcaatacttacagcgggcgttggaggatggagatggagccaaaatgttggtcttcggatcggagctgcagggtcagtgtcgtcgtcctgtgcgtcgctcgcgcgcgtgtaactttcgccgcgaaagctgatcgaaaaggacatcaaactcaccgcgccatcatcaaactcaaaccctacagctccccccttttgtcttgtttgttgctacagatcccctcgcgcgcgtgtcttgtttctgaaacgcatggatcgatgcatagacatggacatccatgtagagagatcgcatcgttgaggcgcctctgcctagggaactcgagctcttttcttcttcgcgtcgtcagtgaacgacagcagctcacttcctggcctgcactgcccacatcgtcgccgtgcgtcgtcagcgttcgaatgatatggcccggcctaggccaactgtcgcgcggcttactgaacctgaacggtgggtgcagttggagcttggacttttgaagcccttgcgatgagatcgacagaccatcactccgtccgatcctataatagtcggtgtgttttagatttagacacggaaattaattctataacaagtaggaacgtacatgaaacagcaagctaggggagatgcaaagaaatagagctaggcagccaaacaagatgaattttatgtacgttcggttgctccatgtcagaaagtgagcacaacagctattctagagggggatacaacatacaatatacagttcgaatcctactatcacgtcggctattttaggtcggatagagcacgttgcatatttgcatgccgatcttccatatattggctagtttttcggtgccatttagaatggacgtcggacgatacgtggatccagcttgctgcctgggcgcaagtagcgtccgctaattttatggctatatatatatatatagatatgctgtgatatgtcgttgtcacgaccgtcgttcaaacttgacctctaaggctctaatcatggagcaagcgcaaggacggtgagggtgcagctccagactgcacgtacaccacgcaacagacgtagcacccaaatggtgctgccagtgctcgacctgttcctgatgatgaacatggacctgagtgc

SEQ ID NO: 1279 - DNA, 1642 bp, Zea mays
  misc_feature (1)..(100): optimal_loci_207364_G1, chr5:214518413..214520054, Cluster 8
cattaggtactctcccacagtttacagctttgcactgttcgcattagaatatactactccacatgggacatgaccgacgctctctcccttctctgttctcctgtcccaaaccatcttgtcttttttttctctctgtctctcttttttctctctttatacatactttcattcattcacatctcctagtcgatgcccattaaaaaaaggtatatatatatatagtgttcgataaagaggatctctgatgtagccagcctgaaaagaacctgggaacagtttcatatgcaagtgctcacatattcagagacggtcgcgtttgttggaacagagacatcacaagcaagtatgcttctaaggtattgtagagaactaagctagagagagagagagagacttattgtaaggatttatttggtgaataacagttgtattttttgtgtagcatcagtagtgcttggaatgttgccaaggatcggagcggtcagccttgcagttcattactgaactctgtttttttttctgtttctttttctgtatccaacaaagctactaattaaaagaaccatgtatattacgttatgtaaaggccagggttcccactcgatctgattgatttctttaattaatcttagcagttggtcttggtaggaccgggcggaggagtcgaagtctttgccgcacatgcaggcaacgtgatcccatgttttgtattctcattttgtttctcctctcccttgttccaaatacctaatggccctaactaactgatggaaacagtcgctagtggtatttggcaatgaatgatgatgagctagctagctagctagccgtgtattttggttagctgcagctaacaccaactgctttattttggttagctgcagagcactgttacagtgtacagacgagacgactctagtagagagagagagtcctgcatcttgtctgttccaccgatccagtacacgcgcacacgtacgtacgtattcctgagtcctgactacgaaaccgcaacggctgacgccttgtcagcttgtgctagtggcacgtcggattcagggggcgatgccaggtcagtgttacaggggacgtctgcgcgcgtacagctggcggcacccgaacggaaggtaatcacgtcacgtccgttccgtcggggctgccactgcacaaaacctgggcacaagtccacgtcgagggagtgatccgcgctacgtgacagcgacgacggaacaatggctgacgacctcgccaaatcaaatcaagtcccctgcaccagcacccccgagtccgaattctttccatggtttcggttcagccgttgctttttctgccctcagctgagcacctggcagtgtgtgcaacaaggcgatcgagaacgagcattctatatgacttgacttggtgaatgcattcgtggcacccctagctatgaaccggatccacccattcgacggcatccatgtatggcctcttccagcggcctcggagcaagatccaggttcgattcgatcctcgagcgatcacaaagcgctaaaaatctcatgacgtacgaatatgataaatcaccgatcgtagaagtttcaagcacgaacagttttgagacacaatcttagaacctggccaaaatgtgtctaaaatcgtg

SEQ ID NO: 1280 - DNA, 1786 bp, Zea mays
  misc_feature (1)..(100): optimal_loci_208518_G1, chr6:3874129..3875914, Cluster 8
cggggttgctgacagagtcacatgcatgttagaggggatagaatagggtggggaaaatataatataatatatgttagttggtataagatagatatatagagtaattgtgaccataaataattattaaatacagtagagaatatctcttaccaggatggaatattccttttagtgtagagaaatagggtataacgagtgtggataaccttagattcgtataaacctcatttcatttaaatatatagctgtagatgcatgatagatataaaatttaggccgagcttcactttaaaagtttcaaatctatttcagcttcttctatctaaatagatccagctccatgagctctagcttcaaaaaaaattgaaactagaggccaattttataaaaaaaaattgaactcctcaaatggttcttcagaaacattgtttttatacctcctcatgaagctgcactaaaattactcatcatgcaattggttacatgacctaccgatttaaatatatagctgtagatgcatgatagatataaaatttaggccgagcttcactttaaaagtttcaaatctatttcagcttcttctatctaaatagatccagctccatgagctctagcttcaaaaaaaattgaaactagaggccgattttataaaaaaaaattgaactcctcaaatggttcttcagaaacattgtttttatacctcctcatgaagttgcaccaaaattactcatcatgcaattagttacatgacctatcgatttatgtccctttgtttgtccgctaattatgcatcaagggtaattaaggaaactcacagaaattaattgtattacagaagttggagtctatgtacaagccaaacactcttgaatcctgttttaccaatttgttgaaattgattcatagtgaagttggaaaaccgaaactgtaacttttgaagtagtaaaaccctcccaaacaaagcattaatcccattatattttcttcaatggaagccgcgaaaatggtgaaaccaacctttatctggctagacattcaaaaatcaactaattaatcgtagttttaacaacaaaaaaactggtggttttgagacaagagtagctattttgtccaggaccagtcttgcctctgataataaaggcgagcgcgtgtacttgcctctgattacactctaacaatcaggtgcggcggtcaagttggtgcacatacacgcgccgccgccgccgccgccatgcatgcatgatgctgatgcaggcctcttgccgtggccgatcgacggcgcgtgtcaatttactccacggtggtccaatcgccgcacgcttttatttactctcacgcgtccatgaatgcactgggcctactcgtgcatgaatgcatgctgggccacattcgctcgcgtgcacgccggcctgcttcattgcacagtcggcattctggtacgttgggccgcaatacagataaccgccttatcatgttgatccatacgtgaccatgtttactaattttgtatataggagatctgttttactagagagagattggctctcccgggttgtcgtggtgagtcgtcgtgtgtagccgtactctcagtatgacgtcgtttgttactccggctcctatatcgattccatcactgacatttttgtagtggtgcacgccgagtcccacatatcagtctcatggtacggtcgtacgtggtatggctttttttatcgtcatgagctatttgtcacctgtcagcgtgcgtaggcatacactcggtatgacgtgttgtcccgtccttcga

SEQ ID NO: 1281 - DNA, 1421 bp, Zea mays
  misc_feature (1)..(100): optimal_loci_217622_G1, chr6:65268295..65269715, Cluster 8
gtctaattattcaacaggaatcatctctgtttcttcttgtagctcgttagtggaaataatatctatcttcttcatcctaccatgcatgtgacaacagctcacacacctccggatctcatctctctgacgatgcatatgctaaaagattgctagctagtagcagctgattggccctgtaaggttgttgtgaatgcttatgtgttatggcttgctgtaacgacaagcacttattaactatgcaaccaatggcagctgcttaagatatcgctatccacaagaagactaacactatctccggcagtgacctattttaaacatcattctataaatagtacaatctacattgtaaaataatactttgcacggcctgctgaagataacaacagcaagtaataaggtctcctctcggaacgacatcttcagtgacatactaaagctataaatgcttaggtttaatagtgtgcggaggcttatgatgatgtctttgtggctaaattctcgatagccagccggtctttttcttcctctctgctgtgtatttgtttgttttctctctcggtcctctccttgttctctcctttttcactatttaataaaatctaaaatcgtttccctgcagccttttcccttaaaagaagggcgggcgggcaaacgagacgtcgcttgtttttatatatcgccgatcgaacaatcttttaatcagtagcatgcgttctgttgctgctgctgcatgcgttctgttggaatcatgtttcttgtagctttgttagaggagataatatctatctatcttgtggatctggatcacctttttaccttagcttggcaacaaaggatcggatcgatgatgcatgactcgccgcagagctccagaacggccggtggctctctgctggctacggacggcaccgatgcatgcatgttctcttctcctttgtgttttttcagtttccatgcaaggcgaagggcttggcaccggcctcctctactcttcatccatccctataccatgtgacagctcattcctctgcccggccggcattgatgaggtgaggcaaaggaatgggcgaagtggcattgcatgttcgatcggaaaccctcccgtttctgtcgagtgcgcgtgagcgtgacgatatggcaccacgctactagctttcttcctgcaactgtacgtacctcggtaccaaacatcgcgagcgaattcctagacacaccttttcgcttccagtacaatggcagacgatgcggatggctccattctccaccagagacgtagtagtgacgtacggagagagagacgatcctgtacgaggcgcattcatggtccgtattccgtgtcgtacgcgtacgtttgcctctaggcgcaaaataaatctcgtacgtttcctcggcattttctcgctcgctctctcccaccgtaa

SEQ ID NO: 1282 - DNA, 2317 bp, Zea mays
  misc_feature (1)..(100): optimal_loci_222396_G1, chr6:95314003..95316319, Cluster 8
gtttgtaaatatagtgggaaaggcatgcaagagatgtcctggaactacgtacgggtgtcatctcgctctctctaagggaaaggagtgccgtggacccgcccggcatgagcacttgtcaaattatgtcatcagtgcatatatagtcaacgatgcaagcaacttcctccatttaaaattacaagttatttcaattttgttaaagtggtagccatgatatatatgtatattaggatggatgaactgatagcagcaggttgagcagctatttcgcccctttcgaattgctgtcaggtaaagtaaaccagcgctgctaccatgtcgtctaaaatcttatttggttgaagttactctaacggcatgcatgccccccccccccccccccccccccccccatctgtcgctgcggtgcggggatcacgtaccgaacccatgtggatccaccagtcagatgtcgaaccggggcggccggcggcgagaactgtggccggccattgattggtcatcggccgatcgatccgcaagatcagtgcgaaagacaaagcgggcggcagacgtcgacgtctgcgcgcacgccgcagtcgccggacgccgtgcgtgcagtaccagtgccagtggcatgacgggccgtatgcctgcctgctggacctggacggtggatggtggtgcgccagcaggcccaggcaacgagcggccggccagcatccgagatcgagccgatctcggcgaacagtttggctttcattccgcggtcggggtcggggagctagctcgggcgctgcgcgctgcgtgcgtaggggcctcgccgcctcggtcccggctctcgctgcccgcgcgcgcgcgacggggtatggtccagtatgtggggggtggccgaggccgactcgccatgcacaatagtgtaatggcgtaatgcagtgcggtggccaggcccccgccggccgccccgacgatctcgtatcccgccgcagagcgtgggcggcggggtagtacagtaccagtacgtgagcccggcgaggctgagcgtggtggactgacgcgcggcatggctgtgcgtgcgctcaggtatatatctgtatgcctgcatctttttagctagctagccagctagctcgaggtccgttcaaactcatgtaattcttgccaccacgtactagtacgttatttgtgtatatctatactttcttaactattttgttcgtgatacaagttagttgccaattcatatgttgttcaaattcgttgatatatatatatccactttttgcatctcaccttgatagatgcatgtgtgtgtttgcgtgtgtttattaaactgaaattatacttcttattccataggataataataatactagcttgtgtaggtacatatatcgatcatccttaccatgtcgtcgtgacagactttagccatgcacgaaataagttttatatacttctcagtttgccattatttacggtttccttttcgcatgtacatatatcatccttgccaataattactctcgcgtgtttatattgaaccgatcgagcgctcgtaactaaaggtacgtaaatgctgtttttttttacggcattgaaggtgtagtacatctcacgtactgtagtgtattgactacgtacgtaggtgtaataaattgcctagtatagtcttactgctccatatatatgtaagaacaaagaggtatatagacgacagaaaatgtgtttaccgtgtaggccacagcaggcaggcatccgatagatatgagatcgacgagctatagatgactgcggccgggccggtggtccaaccgacttgacgtgacctagtagcttgcctcggtccaccgttacacaggaccgctcctgcactgcactgcactccatcgacatcgacatgaagatacgcgactctggcgcgcggctccgacgactcgactgcacatggcgctccgaggtgacgaaccacaaccaaccccggcccctgactgactgctcgtgtcacgtacgtgccgggtgctgaaacatggtcccgcgccgtcgccgtcgccgtcgccgtcgctggcggtcacactcacaccacacggcatgcacggtggcgccggccttctgcagcttccagcccacagccccacactgccggccgggaacggacgaactcaggccctgtttgggaatgcagttttgaaatactgtagttttgagataccataatttacaattatacatgacataaatactacggtattgctttaccacagtaaaactacagtattgctcaaaaccgagatatgtttggttctattggaaaaacaatgtatatgtagagagaaga

SEQ ID NO: 1283 - DNA, 1630 bp, Zea mays
  misc_feature (1)..(100): optimal_loci_224611_G1, chr6:106739093..106740722, Cluster 8
aggcactttcccacgctcagccagcccagccgccctctcgctttgtcccactgacgcgcggggccctcgtgtcattcgtccatccctctcgtacgcacgcgcatgttccaccttcggtcaccgaccggcggggcccgctggccatccacaccgcacgagcgtgccctgcgctgaccaacaccgccaacctgggcaccctgctcatatcgcagccacaccacacgatttcgatgacatgtggggacatagaacactgtagatcttccaggcgacttcaccaatccccggcaaccaccgtatccatcgtaacggcgtccgtgatgccgcctggaccctcgcatgtggttcagggtgctctcgactgaagctcctggatcggactccgccgtgggcctataaagccaggcgacctcctcgtcaccatacctctaggagccgaggccgccacatttgattccaaggatccctcctagctcgtagtcaggcatgaccataggcaactgatcatgcgcgtgaccactagagcagggaagacgaccggagcccaatggaatttctcgacggagacctctctacaccaccgagccgaggagcgcgtgggcggtgcactacgacgtccctactgcgggtaagattgccacatacctatgcgccatgatctcgtaaatgtgtagcattctgtgttttttggtacgagctataaaacgccaggggcgagctctcgccggtgcgcgccgccatagtagggccgggcgccgctaggatgttcggcggggagagagaagaggggtgatgggttattttggtacttttgttttgattgtagcacggattaggacagataaagtagttggtggtatagacgtatagcttatttgccactatcccttagaatcaccattagggcgtaaattttgttattttttcttcgtgaccacttgcacaatttgcaactaccggctagtatcatcgtcgttgcccctactatttagtatcaccgtcagagctaacagtgtgtgtgccatttattatggaaatgcaacatatttgcgttaggcgtattattatggttcagcctcacgcgattgtcaatatggttgacggtaaaaataggatcatttaaattgtctcgtaattatatgagacttttatagcaatttcatttatacgatcggtgaaattttgagaggttttggatttagggaccagcgcttgtgtacaacacatattacttggacaatcccttttatatcacaagatagttctccgtctaacttggttttataggaaatgtcatgaatgatatggttcaaatgtatatgtgatgtgatgcttaatgtttgatgtaattattttgctagatagtgatagtatagttcttgatgttattatggaggactcaagcatatgagtacatcatggacaagaacttggtgatggagatcaccatgacaattgacaaaggccatactatctcatattaatatcattatttgtgatattttattttcctatgatattgttcgttcatatattaattgcgttgcacctataaatattctattatcatttggtagacctgctaaagtagagtgtcatctattatcttcatctaatagagtgtcatcta

SEQ ID NO: 1284 - DNA, 1419 bp, Zea mays
  misc_feature (1)..(100): optimal_loci_224681_G1, chr6:107107921..107109339, Cluster 8
gttagttgtgtcatttgacctccccctccacacacacacacatagctagtcatagcttctatgaccaaccagacatagcatgagacatgagctctagcatgagaaccttcttctgacttagatgaggaggcacttctcatgtagtttggaccactccacacacttaacaccttacacaattgtgtcggtccctccataggacacttaggttttgtaatttagtgtgcttgatgctaagggagagtggggacaagaagtatgtgagatagggggagagacatagacatggacggtggatcttgctatccttatatgttatactctcatgatacacaattatgttcatatgttgcatacacatttccttccatgcattgtataatactttatgttgtatgtgtatggtaagttctgacatgcgctactctcattgtatttatatagacacttgtgcttgtttatactcttactttatacttcatgctaacgagttttaatcatgtgcttatttttaatctttcactcttatggtacatgttatgaacttagtttgtatgaacttgcactaacatttcatgttttaaatctgcaagttcaaatgtatagcctcgttaaagccacagaaggtttgtatggactttatgttttaagtcacataatctttacactatttaaaccgtacgttaaatagtgtctgtgggaatgacatgtgaggaagagagggatcagtgtctttaacaacaacatggtgtccagcgtataacgcaggttcgagggagccactatggttagaggacgagaagaggccaccaaattttagacacaatagaagaccttgctagaggcgtagggacaagcttggtacgttaaatatacggacaagatcctttacatgaccttgttggagagagccttatgtaacacggatagggtaagtggtcaagttggctaggcctatgtgaagttggacttattgggccaaagtcgcactagatgtccggataatctacaatctacatgctttgtcttgtacacagtttcaactgtatactgtatgtgcacaaatgagttaaatgaccattctgggatccagcacaatcttcatcacgcaggagttatctgctggttgactatactacatcggacttggtaaaaaaatagaacctgattttatcgtttacgtaatgatcggggctgcaacaatttatcgaatacaccttcataccgtatatacaataaaccggaacaaggtcgacgtataaacggataaaccaacgttcattggtaacttctcggccctacaaacttaaggccgcgttcgttttgggcggtttggcctattccgggactggttccaggggaaagaaatgacccggtttggaatcggaccgtttctttgagaggtgttcgtttagatct

SEQ ID NO: 1285 - DNA, 3673 bp, Zea mays
  misc_feature (1)..(100): optimal_loci_231479_G1, chr6:141137593..141141265, Cluster 8
ggaggccatctcctttcccccgaccgatggagcggtggcgcggtttgccagcgaaacccatttctggcccagatgccccgaactcgaatcagaccggtgctacatgaaatagattcaatggtgaatcgatgggtgaagttcttactgggaatcggatgctggtgtgtgccgtccacgacgcggggtggacgggtgatgcttgttgaactttggcgagcaattcgcatcttcaccgccaccatccgagcgtgcctccgccacaaagatgctcggttcgatcctacgatgctcctaagccacatgtccctgcagaatcgatggtgcacttggatttcgccgcggcgccgaccatttccatctcggtctctctcttcgctcttctctgtcccctgctcggcaccggcatgatgactatgcgaggtggtcgaggaggcatcctcgcatttatatcgtagaggcggggggagtctcgataagcttggttacttggtacatctacgagaatctcgggtggttgcaacggccttgcgtgcaaagaactcggaactcaggctagaggacaactctagtgcgcggggtcccacgtggtagaggaacaaagctgagcccgtgtgtgctgacgccacggacccgcacgccagccacaaaatcgcgcctgcccagagcttctagccatgactgttggggtgctaagaagcgatagtaagtataataagactgactaggtggacttcaaacagttccaattcaccaaaatcctacgtggcagggtgagaacataagagagagaaaaagtgggtgcttaataaggaacgaggctcttgcgcattttatgaggagtcaggctctagcgcattttaggaggagcacacgagcctgcttgcagcctactgtgggacttaaggctgactctttctttttttttcggccaatctaaatgattcctctcggggtcggccctaaggggggtagggtgtgcggccgccctgggcccccaaatttttggtccccctaagtatataccgagtatattatatgttatgaatttttagtaattggttttagttagacaccatttggtagtcagctgttagctacaacttgttggaaatctaaaaaacgaatcgatgagtgtcgccgtctttagaggaaacaaagcgtcgtagacttctaatgcgacgtgccagcagtgcactgagtgcgtttttgttaaatgtctgtagccatattgtatagtgtactagtccttatattatatatgtgtatattttcccattctcaaagattaataattgatcattgattattgtatatagagttgaaaagtcagatttttttgtcccaaactcttatcttaccttggcaccaagtgattaaaaggtcaggataagagattttcggatggagtattgtgtgttatagaaattttcgagcatgtcaaagaggtggattgttatcctaatgttaatgtctctattgtatatcaattcttatttattgtgtctgtgactgttctatctgccgaaaaagcgtttaaaaactaaattattgaaaaacgatttgagatatacaattatgtgttcataagtttctatatataagtatgtattatattatatacatacatacataaggagatgagaggggcctccatattagcttttactcaggggccctaaaaatgccaagaccggccggccctgatttctctgtctaacttggagttacctaagaataaatttatcatatgtattgattttattgttggctcttgatggcgtggtaagagcataggatcagttggccttgttcgtataaaggaagatatgatccagtaccggtctctccgctgacagcgtggggccaccatggggctacggtgtgacgtcagttcaaaagcaaatgaaaggagcgggggaaggtgcgtacaggactagctagaggagtaaaagagctgcaggccgaccgacaaaaagctcaaagaaccaaagacgaacgatagaggagacagagacgcactggattcatcagcctccaaccccaaagggcaaaaggtcgaagacgtactcctgtactattcaaatctctctctctctcatcaaccagcaggtcgaacagaggcgatgaatccgcacatataggacggacgggagaactatttcctgagagagctagctggagcacaggagcagtactggcatggcaggggtgcctatcattctgtgggtgtcttttgatatgtcaatggcactgttcatctgtctatccctgcatacgatactgtagaaggaaatcgaatttgcgattttttgattcaaaagggctgctcatcgatcgaggagttcgtactcgcgtactagatttcattctgaccgactgtcggggaaataaacctcacagctcccccactggacggaagagaaaaattaacaaaagatcgtttcagttactttactgtattccctgtttaatgaactctctccccatgtaaacggagactcccctagcttaccatatctttccttttcagtttgtatccttttctcgtttagaacgctcggctaaactggtttcagcagtctgcctgacgcatacgcaaagaaaatgagagaataagcacggataaataacagttgtatactatcgtcatagacctctagattctagatgcatgcatttgtagacatgataacaacaactcccaagatgtagcagtacgtagcttgcatttgagagcctaattgatgatctgtttaaactatgtttatgattcgtggattctgcaggcccaaacagaataggggacattattgattgattatatataataatgacaatctacatacgatgcatattgttcttctaacaaaacaaatataccatattgttaaaatccaacagtatgcgttcttcccctagctagctagcttgaagatatatggtaagctaagagttcgcaaactacaattaatatgcagactaataaaacaaacattattgccttggattgttttggagaatgctactttgagtcacttaccccttcttatatatagaaccaacagatgaaaaaacaaaccattgtaggtagtatactatatattccacacacagcttgatgtgcatatcaaaagacaacctgtgtgctgtcagtttttgaaattctaaagcaacggccggggagcctgtgtatcttcaagaaatatttaagataatagctgtatacagcatctctgctggtcacacaagaagtgtcccttatcttggacgctgagtacatctctaagatacaattggaactacaaaatattctattgtactttatttttaagcttaaaaatgatactacttaatatataatatattttttaagagaagcctattgaatccgtgcactttaccattactataagaatatttatgtatggatatatatttaaagtgttagagttataaagatagttttcatatgcatgcaaatatatggattcacaaacaacacattaatatttaattgcaaggagcatataatgcaggcagccatataatctatttaaatatactaacaaaaagttatccgtcagtacatatttttttcgttttatttatgagaaacattcatgagcaatctctatgtactaatctattaaataacctaataatgctcagcgcc

SEQ ID NO: 1286 - DNA, 1452 bp, Zea mays
  misc_feature (1)..(100): optimal_loci_232941_G1, chr6:148098491..148099942, Cluster 8
gttcagggctaagatctgcatcacgccgatactttaacaacaattgctacagtcttggaccttgtggtgtggcgacgaaggttacaaaattgaaaaaaacaacgtcgacagcaggattcgaacctgcgcaggacaagcccaacagatttcaagtctgtctccttaaccactcggacatatcgacgtctacgttgagttggctactaaatacgaacaagtacttgctactaagtacatatcgactaatgaatggaaactgttgctatgcacgcatgcgcccgtcccctgttcgcctcctttttgtcccatccctctcccctatatgagtatctccgaggcgtgtagcgccgggctggcggcgacgccggggccccgggacatacgcaaggccggccggcccgccgtgcatgtgcggtcggtcgtcgatcccggctgcaaactccgaggaaaagagaacgcaacagcgacccctcccctctccttttcaacgacgtcgtatccctctgtggacgatcgtgctagattggatcgaacaattattcaatttccgttcagcgcgtccaacagtcgttccgggttagctagcttaccctgctgccagtaaaattcctgtgctcagccatctccatccatctgtgtctaggcttttacccgtcacgtacgtcctgcatatatatgcgcgactatatatcattgtttgctagggtttcagatactgctgtggataattacaacgtacgtaacagcaacagctaacgtacgacccgctcatatggagcaacgacaacttctaaaaagaagaacaagggagcctagctaaatcctaaatgcacgctttactttttgggactgagggcgatggctgccagctttgtgcgcggcccgggacttgcaattgcaaagcaaaacacaaagccactgcgagaagccatggcccatgggtctagaccagttgccagggggcgcagtggtgcatgcacattaattcgtttttgaaggacgtacgtacagcatgcccggatcattcattaacagcgcgctaattcatgctgctgcagtgctgcagcgggtgtgtgagtgtgtcctaaagcgagcgactgccctatgttctctcattcttgtttgttttcctcctaaattacataagttagattatggtagaacagtagtaggataaaatatcactttgagattacaaataagctaaaataatctaatttatataatctagtagggaaaccaacacaaaactggccatgactgcttgccgggttgaagtggaagccgcactttagacttctctcctgtcactgctttggaggcaagatcatgaaagatatactagatatatagctaggcttccttgttctgttcgaaatggtatcctactagcaaagaccatgttttttttgttgatgcaggacagaacacagattgtagacgtcaaacagc

SEQ ID NO: 1287 - DNA, 2198 bp, Zea mays
  misc_feature (1)..(100): optimal_loci_233593_G1, chr6:150747574..150749771, Cluster 8
tagttgaccgtgtatcagtttctatatttcatattatacattggtttgatgggttatctaaaatatctatcttttatatatagtacaaaccaacacaagctttgtttaaggggagtgctcgttttttactaccatggtttgaacttttttaattatggaaacaaaatattctagtcttttgcaatctcttgcatacggccttacaaattgaaaaaaagacaaccattcattttaaacattgttaaaagtaaaacatcaacaaatcaagctccctctgttcaaccctagcgagcgatatgtgttgttgtagaggcaaatatcttaaaatagcttattttgtactgcgtccctcgcgcatcgaacaaaacagacgcttagtggaagtcaatgtagacgtgtttacttatagaaaacaaaatattaattcagaaatcatccgttccatctttccaaaggagacgaggaagaaccaaccgaagaatgcctctgtttcatggtacctgcaggttgttcatgttctggacgagagagagagggagagagaaaaaaaagcctcagcgaagttggtcccgtaccgcagttaagaagctgtagtatatagtagcctgcatcgccgatcctggtacgaaccagcgtgatcttggctccgattctcgtgttcccctccataactcttctgtctgatcttccgtgtcatcatcggcttcgtaaatgcgaggcacactactttcatgacgctggtaattactgctgcacggacggtgccactgaaccgcagcgtttacctacatccactcgaagggcattattactagtactaaagtatttgtgccaggtccctttgacagtcctacctattttagggtgggccggttttagatttttaaagatgacacgtgaaggagaaatagaaagaatagtcggttggataaaagagataaatcaaatattaaatatgtagctttgtattattatatagtaactatgcttcgtatattgctaacctttaggtcatttccggtagaagttttattgcacggttttcttcaaaagtgacacatcaacttttgtatctatgaaactgtgtattcaaagtttcatatggatgaaaccgtctctcttttcataaaactctttgtatctctctcatcataaataccgtatcatgtcatcaaatatggtgatatgtcatctcattctcagtaatgagaatgaaaattacggtgagaattgactaaagtaactttagagcaatcgagccagccagctctaaattttagcacatctcataattaaaaaatgtaatctcacggaggggtgcagatcgcactagcaatctagcatcgatgtggacgtgtggtaacggttgacgttattataccatttatggaggggcgcagagggtttttttttaatcagagcgtatcgtggccctggagtatttatttatcagctctaaattttcagttatgggtcgacgatccgttcggctgcctgcactactgcacacatgattagagttaactttttgtgaccggatcagctctatggtacggtgcatgagttctggcgacgaccaacaattcgattaaaagcaagcaatcgccacccgtatttaatctgaccgaatcaccgaatcaatagcctggcagaagatagggctttgaaaccaaaaccttgtcaagaagcagctagccttgaccttctgaagatgcaaagggtgcctctgaactgaagcctcgagaagcagctagcagctgctccctggcctacagcatgtgctgatcctttgttaatgccagagtgggggggaggttatggacacctaaacctttggctaaactggtcaagttgcggaacgaggagacgcggcaaatgcaggcgagtgacccgccaccatgattttggccatgggatctcgctgagttcaacgaagcgctagcgtgcggcagatgaatcatgcatggctgccggctctgcctctgcctagtagctttgatcggtgtggcggagcgcggaccgcagagcaaaacgctggcgacccaggggacaccatgaatgatgcacctagcgagaaacatcatgacgcgccggttcttccctaagggcaactagctactacatggccattaatcttgctattgctgttgctatccagtacctggaatcgtcacatctttatcgtacgtaggtgtcgg

SEQ ID NO: 1288 - DNA, 1671 bp, Zea mays
  misc_feature (1)..(100): optimal_loci_233659_G1, chr6:151038923..151040593, Cluster 8
tattcagcagcggacggacgggctagcttcatggagcatgcatgggagctagagggaggaaaggctgccgggcacattccagcttctatgttgttgtaggacagtaggggagcagtacgctccacactccggtagtgtcgtcgttcggcgtgaaaaggagctagaacaacgacgctctctcgtcaagtcaggatcacgttaactcatgtcagcagttcatgagctgtaagcatcttttaaccagagactactggccgtaggaatggatggagacgtaggtgtttttgattttggtgtgtacctgtgtgctcttctctaacttatgatgggaccaggagggccagttttggtgcttttgttccttctgtcggcaatttcgttgctttttcccccctgagaatagactggtatcataaacattttctacgctttgtctaaggttaaatatcttttcactaaacactgatgctaactagctagcatactggtgcccagtagacaacatctatttcactctggctggatggcatggcagctgagagcaactaactgataacaccggaggacagcacatcaggttcgaatggagcaaattctctgaaatttaattttgtctcctagctaccatatatatatgcctgcaaaaaaagacgctatctggtacgtagtagtataaattgtcgtgtgtctattttaaatctcgacttttcggacaaagtattattataatctacaaatgaactatatggactttgtcaagattgaaattgaagctttttaataccagctgctgatatgtttttaaggtgatttaatttgtaccggccgcggcacctgataatgatcagtagtgcaactgccacgcccacgctgctagctgcaacgcttctgctttgaacgcgaagcgaagacctttccttgttttgtttcctttcccccttgtcactaacatttctcatcaatcaagtgatcgacaggatatcaaagcatttgcagcggcaacaggtgtaggtgcaggtgcatgcatggcatggggccatggggggcacacaactgcggtgcgaaagcaagcgcccaaagctaaaggccaacggcctttcgacgaccctaagcctaatccgcgtcaggtagtgggggttctcgttaagcatatgttcctcttccacccccctttaagatatggccgatctgacgatcagtccctggatttgccacttccaaagggaaaaggggggatgccgtgcaatgcctgccttttgtttgtctagtccgagtggccatctctgttcactccggccggacgcggccgctgtcacacaccaccaccaccgccgcctcctcctcctcccgcagcagcagcagcagtggcgcaacgcaacgtgctttccctcggaaatgacaagcggcactgtgccgaatagaataattgcttttcttgggaaatgcaggcaggcaggcaggcactggcgctctgaaccagagctggagtgcaagtaagcgttcagcaggattggatggcttttgcatcatgaatccctgccctagatttctgcctgcggcgcactgctgctgctgctgctgccgcctgcagctgactgttgcatggatggataaacaattcatcgggactagtagcctttttctaaacaaatttcttttttttacgatgcg

SEQ ID NO: 1289 - DNA, 1607 bp, Zea mays
  misc_feature (1)..(100): optimal_loci_233741_G1, chr6:151566369..151567975, Cluster 8
cctttggatccgctttggtgccgacgaagcgccaagacaagactgtgctgcaaaaaaaccatcgcttgttttaatctaaaacatctgatacggttcgagatcgttgtcagtcctccctccacagcgagaggaggagcgaacgcagcgaaacatctcggcgtgatgacagtgacggcagctagcgccacgttaacttggcagctaaggatgtgtttggttgcttggtctagcctgagccaggctcagtgagaggaccagactcaagtgagctcgtatgtacagagacaacccaaaatgtttggttgcctcatcaaaatgagccaggcccatatgacacattgtttggttctcattttttagcttgacctaattaggttgccgccagttttgatgtgtaaaatgcagctcccaccaaatttcaaaatttaactaattgcaatcatctaaatatgaactaattacaatagatttgaactaaaaatatgattacagcagattctagatgcttttcagattatagctcaaaaatatgaactaattgcaatcttctaaatatgattacacccagcggaccatgatagttccgactgccatgctttgagctgggacgaacatcaacgattccccgcttccccagattgttgtcatttccttcagctgacagtgctggaacctagtgatttttttaaaaaaaaatgaaagggagacaaaagtttagaacccgacgacaccaacctgattgactcgcggtcgcggtcccggccgcgtgcgctggatcatcgtcgatcgaccgtggcgatcggcgagctttcaatcatgccgccgaccgggcaaggaaagcagatcgagacgtatttatgcgctcatgtggcggtgctgtgcatgggcgaccgccttattagtgcctccttggcccttggctgccgcgtcgccagcgagcccatggccatgcctgttgcctggtgcctggtggtggtggtggtggcacgctcgcactggcgcacgcatgttctggtgctggcgcgatccatcggctttcgcaggcgcgcccttccaatcgcggaagacttttctgcctgcctccttgttctcgtgctgtttcgggggtcgacaacggattctggtacggttggtgtgctggcgtagcggcgtagagctggggcctggggcgggtgcgggtgccccaaaaaaaatcatactagctgcgtctgcgtggagcgttgcggcgcgcaacgggggatatactgggagtctgggactgcgattgtcacctcggatgggttgtgacttgtgagggcttctccagtgaagaaaaaaatacacctacacgagcattaagcagtttgaacaacgcgacgcccttcagtccggcgcgcaccattgcagacaacgacggtaagctcctgacagcctataccacatgtccacatcatgtgagcgaatgctggggcagttagcacttggcaccagagtcgacttcgtctggggcagcaaagcccctctgagagtctagttctttggatggcttgtgtcccggagccgaattcagttccaatcaaacaacttgtttggtcagtggtagattgaagggattagaggggacttat

SEQ ID NO: 1290 - DNA, 2230 bp, Zea mays
  misc_feature (1)..(100): optimal_loci_234358_G1, chr6:154159673..154161902, Cluster 8
cttatatcgaagcccagagtgcctgattgagcccaatcatttgatacaatcatgctatggccttgcttcagatttgggtgcgcaacagctcatgtgtaactttgcagttaagcttttctgggacgagcataaagtctgaggcttcttcctggctgcttctatttgaccacttcactgcttgccgaggttgcagttgatctgctaaagtatcatcattttgccttggattccttcgcaagtcgcaactgtgcatactctctcggacagctatcatacctgtactcctgggctacctaccacaagtccttgcctgtttgatctgtaaaagatgtacatgcaagatcacaatgccttaagcacatgtaagaatccttctggacaggaaatatatgccaaccaaagaattactatggcaacttttgcagaggtggtgagggaccaactggaactgcagtgttggatacaattacatacagggtccgggtggcaggccgaggaggcgaggacatcaccgagctggcatgggtcagggaatttgctctttttttctttccctgccccaccaaccgcctttctcgcagagtcgcagtgacctttgtttggttggctgcggtactgtcactgctgctgtgcctgtcctgcggcaggcatggcacgaacgagtgaaaaagagagagagagagggaatctgatgcatttcttgttcgtgtgttttactactttccggcttgccgcaagaaaaatgtcacaaatctaccaggcaacacctccttcctttcgaactttggtgcgttgataggaccgtcctttgaaatctccagttcatttcgtccggcccccttgagcttggaattttgaaagatgtacccgtacgtctcagcaactgtgtgtaccttgtgctcctagtcctagtccttgccgtgcattgtccatgtcatgctaacaagttgttgggagtagcgtacaagcgcgaaggacgcatctgcaatttgtaatgcactgccgacgcctgcttaaaatccaacaatttcacatcactagacagtctgattctctctctcatgattgtcacgctcaaaacggatcatcatctcgttcattatttcaaactcctctacaaacactgtaaaacagcgttatacaaactcgcatacacggtgttgacagagttggcctaagtcctgacaaatgggcggctgttcggcgagttttcaggaccaataaaatatagcgcaagtacgatcaatgctaaatctagagtactctttttcatcgctggcgcacggggcaactccgtcaccgagcgtgccacgccgcaaccgctcacgtcacgctcggacgccggcgccaagctcgaacgccgaggagtcgcagcagcattctacccttcacgtccgcgcgctcgcgacgatctccggtctggcccagtcgtcgccggatagcagcagtgaagccagcaatgaaaaggaagagctggcgtccattaaaaaaagagagaaggtagacgaaggagatcttctgcgcaaatatgggagaagactgggctttgcttttgtttggcatttgtagttctaatgaaatatttatcagcacatatttaataaggatttggaatgtgcaaacgtgtcagtattttattgggaaaaacggtttcgagaacttctgttgatatgattgcgaaaatatagaaaatgagatattgagagaatgaaatttagatgatgttgtagagaacgagatgttttagaatgtgatgtaaaagacaagaaatatttatttaaaagatgacatggcgtatggtttgtgtcaattcgttttttgacattattattaggtgactgcctgtctttcgacccgaataagcccaacaagatttgctgggagtcatgttcattgcaactcatccaacgccttgtgccatgcttgaagcatagagatgacacgagatgccaccccacacactttctcttcaacataagattatcctcactgctgttactctatatttccactctaaaagagatattttagttcagtcagcaagattcttttctctataccaattttgcatgcatccgtgttactctataagttcctttatatccaactactaaaattttattcaaccattttcaaccaccctctccaattttaaatatattttgcaagagagatggaggataccgtggtccttgaccttaccctggaaatatcgtaatcccaatgctac

SEQ ID NO: 1291 - DNA, 2537 bp, Zea mays
  misc_feature (1)..(100): optimal_loci_234495_G1, chr6:154835874..154838410, Cluster 8
gcgctactgcagcgtgaagatgctagagagattcttcgctaggctcggcaaacaaggtaccgaaggtcgttgctctagatatttttgtgaaaagccgatggagtagcaataatagactttgcttatgagctctcatatttgcttttgttaaagttccctatttcttttttattagctaattattagctgaatacattgtaagaacctggctatgctctgttgcagaggcgggaatcatttttttttgttttctaaaaaaatattgtactgtacgacaaccgcatatatcgatatgcatatgatgcaattatatgtatatagtttcatatatagataaatatttagtttatatatgtaggattactcgcttgttcaattcgttgtggcttgttgcagttgcgacttatacagtattttatctctataaaatacagttgtacgtagcagtccgaacagctgcatatatgttagttgaagaacagagaagtagaatatactgagtactctattcgctgatgtactcttcttgttctccaatggtatatataggttagataattcaaaacagactatagatgtatgtgcagttggaaattcggtgcatgcatgcatgatagctactagctgacttgttgcgataaagctaacaataatagctcctcctctatacatatagtataactgaacctaaaataattatggaagtaaataattaatatctgtagtcgacgtagcttgctcatataatagtagtaaaaaaaactatgtatatatatagccctgtgccggccgtgttagcgtgtgagaatgcatatcatatattctcgtgcatgttaagtttgttgaagtaatggctcctgacggaaactcggagcaaaatttgtagtgtgccactgttccgcgtcttttctattatataaaagctgaccagtgaccagcatcgggaggagcccggccgcctagggaagcgagaagcacacacagagaagtttcttcctagagagagagggagagagacaagcgcgcgcatggccgccatggagtacagcagcctcttgcctctggcgctgctggcagggtggtgcgccctcgcggcggcgctagtcctggccatttctgcgtggctgcagcggccgcgccgcgtcgcagaggccttccgtcggcagggcgtggacggcccgccgccgtcgtcgttcctgtcgggtaacctctcggagatgcaggcgagggcggccgccgcggcggtggcggaggccgccggcggccgggacttccagaaggaaggcttcgacgactactgcatgaagatcttcccctacttcgagaagtggaggaaagcctacggtacgtctcctccgtcgaatcctgcggcctgttacttatatatattattattatttggtgcttaatactctctagtaatgccttggattatcatggggtcgccgttttttctcatacaatatgtatgtataggctcttgcgccatagatatatatagagagagagaggacagtattactagtagcttgttgccaccttcaattcagcatgggtatactgctgtcccatctcccatgttaaaggactggcatgttattttttagtagaatttttttaggttttatagcctttattaaacctaattaactcgtagaaatagaaattacaaatactcatattctcatctcagtttgtacatgaacaacatatagatcccatgtggggcggggtacggttgtgctacagcggcaagcaagttgactatattaactagttgtagtttattactgctagtacgaaaaatttgcaaagtcactgcttacaacacaagtgggcgaagaaaataccactgcacccctacgtacccaaagcggggtttgagttgtcaatgaagttaacatcagaaagctagctagctagcaagcaagttaaggaaggcaaaagaaaagcagggagaatagacaaacaaatgcatgataggaagtggcgcagtcaactactataccgggtgttcaggtccgtgaattaccaagaatatcacagacaactaataagaaaggaattagtacataataaaaacctttcaacaattaatatactaaaaagaagttcgtctgactagtaagtaattgctgagagcacccaaccgcctagctagacctaatatacagctagctagctagctatatggtagcggcggataacagaaatctgtctctctatgacatcagcaagcgatgatttttatattccactagttgattctgggtaccacgttgtattaattaaaataaaatttttaacataggagagagaacttcaagtaaaaagataaaaaaaatgcctctggttaaaatgaatggacttaagcccaccgtcttctctgttgttagatccgccgcatgtacacctcacgcatagagcgtaagctggctgtatctgcgtatatatgcggcaaagctcggcgccagaaactgtccgtgtctttgtgcgtgttatgtccagcctcaccatgcatggccgttgtgacacag

SEQ ID NO: 1292 - DNA, 1657 bp, Zea mays
  misc_feature (1)..(100): optimal_loci_263135_G1, chr7:157171136..157172792, Cluster 8
taccctatcaaatttttactcgcgaacacgcggataaaaggtctgtttagacaggcgccgtaggcgccgcagcggtgccacacctacggtggctgatttgggcgccacacccgcgacagccggagtgtggcgcccgagccagcccaccaaacaggctcaaaatgtggctgttgtcatctctaacggcggcagtttgtcctgccgggttcaggcctccctccgtttaattcctgcagcgagccagcgtggagttggccgaactcttgtcgatgcgcatatgcgatcggctcgcgcctgatgccgcgccgtgcaaaaccgacgtagccgccttggaccgtcgaaagatccccgccacctgcgcatcacgccgatccggaggacgtggccgtgtacacagcaaaacttttgagcatgcagccatcaatcaaacggccggacggatcgagatccatggcgccgtgcgactctggacaaaatcagtgtgtgtacgtgggtgtgtacaggtgtgccacctgctgatgtggtgcgcgcgtacggagacgatggatggttgaacacagcgctggaggcagtagagtgcgactagcgtgcggtgcggttgccagttgggcgggccgcgggcgtgtctctccgtgtgcagcaggggccaggtttcttccaaagatagtactcccgtcctagtgtatttgttagctaaagcgggaatcaaatgtcaaaaagtttgccaggagtgtaagcagggggcaaaggggagagggaaagcgaccggacaaggaaaatgcgaccagtgagctagctatctttattcgatttaattattaacttggtccaagattatttaacatgtatcaaataaacctcaatacccagaaataaataaagattatataactggggctgcgccgctgcgctgaagaagggtgatacaatcgattgggacttggactcttgccgcctatgtttgccacctgggccgatcagatttctgtcgtgggagtgaaagacggatagacgatatacatcgagggaggaaagaagtacagtgggatctagtttgccatctactatgaaaatagtaatgacacagtatggcacaaagtcccaaattcccaatcatcacaattctaacatacccaaaggatttattagtcatgtttggaacacgtacggtgtttattctgagtcacacgagacaactatttaccgcggaacttctacggagttactatgtcacgaatcgccaaacactcttgatgcggtaaactaacgatgttccgtagagacgtgtcgtgtctctccctagcctacggtgtctacgtcgattgactttgagacgaagatcacatcacaataattgcttgacacaagacacacctccacttgtacaagccagtacatgcggtgcattacaatattcgattaaggtttgaccattcaatacacacgtccctgaccaaattaagctagagatccagaggacacacgtgcactttacttgtaaaaactaccattgcataatgaatggcattcttaatggctactaccctatccgaatagtgagactacaactcatattaatttcaaataaatatgactatttatttacgatatctgtcttccttattttatctctatctagtttttaaatgagtatttg

SEQ ID NO: 1293 - DNA, 2112 bp, Zea mays
  misc_feature (1)..(100): optimal_loci_264245_G1, chr7:162666555..162668666, Cluster 8
agactatggttaagaggctagcagggacgagaccatcccaaggcttgggaccttggaggcgaacgttaagaaacttgagatagaatttatcctgattcaaatattacaaaaagaaagagtacacatgttgtgggatgcctttgagcactcaatcaagggcttgcgcgatgcaggacttatggccattgtgtggggctcccccacccgagagaggggaagcgtgaggtgcctggtttgggttcatccaatttgcaaccaaactgacaaatgatcaacggacatgagatgacaaaaaacagcccttcatataattgtcgatgtgatgtcgatgttgaagagctggaatacgaacctctctataaaacgtaacacccctatatagaggaaggtggagtaaatataaactaattatataagacagccagttcacgatacaaatatattaagtctaaataatctataaccaacataattttactgcagaaaacatgtactaataatagttgtatagtagacaatagattcagcacgtaacccatcatgatttgtataattaatgttataatgggctcattcttctaacgggtatttccgaattagatatgcacgtttagttagagattaacgtactatatcgcaccacttctgtctacgaggtccacgtttcgtgacccaaaatttattggtctgccgacgtgcaccgccgcaccggtaccacgccacgtgagcctttttttttccttttttttttgggtgcttcggggacagcggcgcctgcgtacacgcgctcctgcgtcctctcgaggtagcagtagcacacctcatcggcgactcaaaccgagtaccgaacaccggcaggctgctctagctagtgcaaactgccaagtggccaagctcgatacatgtagcttttgttgattggtcgttggttagcaaagcacagtcttacccgcttccaggagactggagacaaccacgcctacagtaatggcttgcacgccactcgtacgtagtacatgcaatgcaaacgaagtcaacaatacgtacctgacagagttgcgttcgcagtcttatccccggtatccggatagcaacctgacaacggcaaacatccccattcacatccaccacgtttgactgttcatttcctaggccatgggtccaataattgccccgaacaaatggtgcacgagttatcggtttctccgatcccgacatctctgcacgtttcatggccgcggcggtacggagtaccccggcgccacacatgacacacactacacaggcatgcatacagcagcagctcgggataagagcgtttggcggcaagacgacaagcagccgagaaaagagcgtactgctagctacaggccgacggccaaagggcgcggcagcaccgcggcaccggcaccggcacggagccgtcgcggatcgatcacgagcctcaagatctcctgtacagttctcctactccagcacggtgccagtgccaaactttgcagcagctgcacgcgagcgcgtactatacgcatacgcctatcatacaggagcagagcagagatactaaaaaagctgctcgtcggtccacacggtgcggtcaggaaagcggcgcccgggcctccggcagggagacccgcatctgtgtctcggccgcgcggccgggcggcgattcgggcggccgcgcagttcccacttcccagccgcctcgccggcccccgccccagcgctcgccggacgggacgaaacgttgaccagcggcctgccgctatcgcgggcgctggccactcgcagtccgacgcggccatgacccgcgattcgcgcgtgatccgcaccgcattttcgcggggttgaccggcccgcagccgggctagaaaccgtggtgcccttttggactggagcctgctgcagtgcaggcaggcagaggcagaggcgacgtgctgcggaggaagcactcaaggcgaaggcgaaggcgaaggcgacgaccgacgtgtcggctagtgcgcgcgcggtcggagtctcggaagatccggcaacagtgacgacgatgtggatcgctgacggatcgacaggtaacgcacgcagagtcaaacgcttatctgaggaggcccgacc

SEQ ID NO: 1294 - DNA, 1642 bp, Zea mays
  misc_feature (1)..(100): optimal_loci_26433_G1, chr1:160853131..160854772, Cluster 8
tctaaaacacccgcttaaattccaccaacgctacttccgcctagcagtccagcacagcattttgtgtccgaaaaaggaaatccactccaactagttagggcacgtttcacgaactttgagagtgcatcatttgtattttccagatactcctggaaaaaaaaacacatgtatcaccggtgctcatcggcatcggcctttcgttcacggttactttgtcggaccgaaatgaccgtatttcgctgctaactgaaaaaagaatttcgtacggattttagatggatttcgatttaaaatatataaaaaatacaaaagtcaaattttggtcagcaaaataaaatccagagatgactgcaaattgtgaaccctggtggtgtagactcgacccacaccctcgcccttacgcaatgatgatgacaagcatgatggcacgctcgcctcctctttcaaccccccctaaccctaatccagctgttactcgggcacaggcttccaggagaccggaatgatgacgcttgcctcggcggcatcgaggacggagccgggggcgtgtcccggagggggtgctgcattctgaattcttcgcggccaccgatacgctttactacgtactgctgctttcctctctgaaaagctcagcactgaattttagccagagctcgcccgtgcgagtgagcaactgagcatgcatgccatgccatgcctctgtctctgattactttatcattggctgctagctagctgctactgtagcagttagcagcaccacagcccagttcagccttcttgggtgttgtttacgttgtcctcacagtctaatctgttcttttgctacactgtctgtatgtctgtctgtctgtcttgtagcctgtagttgtgtgcaagcgcaacaggcctgcatcagtggcgatgttttggatcgtccagaccgaaaaaacggcttgagagatgagaagcgcgagcctcacagtcacaggcacaggcagcccagccagctgatgacatgtttcgtcctcacgcagctcatgcaaaagccctgcagcaagttccagttcgcaggccggacggaggagcaatctttttcttcagaaaaaaaatctcaggagtgtgtgtgtatgtgtgagagagagagagagagcgtcgacggacggggcgaacttgcaggagaggagaggagaggagagcagactagcagaacagagcaggcagagagagcccagagaaggctagaagcactgccctactatttgtcttttcggttcagaaaatgctgttctggctgggcggtgcccggtatgtatatgcttttgatgagaagctagctagctccactccactccactgcacgcagacgcagtcccggccaattgcttttcccgaggaaaccatcgagatgagctaagcctaagctagcccagccgccttttccccgtcctgaaaatcatggagtaattggtggagaaaagaaaagaaaaaagagcacccccgcaaaacccctggcggagctacgtagccttttgccttcacaagtatgcaaagggagacgagatcgagaggaggcgaggccacctttctcccctacctacaaagcttctactgttccagcagcagcctcactaagcatgacgaacgcgcgcatttctgc

SEQ ID NO: 1295 - DNA, 1801 bp, Zea mays
  misc_feature (1)..(100): optimal_loci_267690_G1, chr8:4790784..4792584, Cluster 8
aagcagaggagagagaaaaacgctatggttaattcgaggtttgaaccaatgatttcgttggaagaaatttgaagcaccaagtacatacatggagcaaactctggtcgcgccggcaccaccggagcagagcagaccagagcaccacctgggcggctgcccgtcgcgtcgtcccaccgccggcagagaacgaaccaaccgcggcgcgggcggtcgtccttgctccctgatcgattctgtcgcgcgcggatctcgttcgatcctcgcaatcatggaggatggagcggaggcgagagagagagagaggacggcgcgttgccaattcgaggacagctcctcctctcgcctcctctggctctggctgacgcgaatcaatcggaatcggaatcagagcacaggctggctggctggctagcgaggaaaggaaaggaaaggaaaggcccatgatgtggcatgcatggcttttgtgcttagacagattttcctctcccgaaaagaggtgtgtcagaggacgaggaatctctgacgtggaaaacaatatcaaaaggctgggccctggcccgtccgtcagctttttcacactcactcgcagtcactcacatcataccgtatctctttcatcccggacacgactttttattacctgccgtggtacctggtaaataaaatatacaatataatataatcggcacctagaagcgttgtttgaaatggtacagctaccacaatacatagagacacaaacactgtaccatttatagagacaaaaacaggattaaagcccggcaaacagactaccgcatgcatgtctgcatcgattctgcacgtactagctgctagcgaagactgtgaaacgcatgtgccgcgtggcctgcgtgcccacggttccatatatatccgacgtcggcttcaaaaaaaaaagatctctgcagatcgatggcaacgacgcgcaagcattattcaagtgtgtgtgtttttttttcttcttccagaattgcaggccactgaattcgacctttatttacttcccttcagaaatggcatctataaagcgcccatatcaaacagcaagcacatcgctgtcccagcagcagcgcctgcgcctgtgctctctcctcttcttcctcaaccctcgccgcaacaggagagctctcgatcagcgccgcccggcccacctcgcccgcggcctaacattaggctcggggactacggtgcagccaaggatgacttgccgatctatcgtcgatcaacgagcgacgcctctgatgtctgatctcgacatctatcgtcgtcagaccatcatcatctatcggcaagttgttcttggctacaccgtggctcctgctcctgatgtaaggctttgtcgtctgcggcgacacgtacttttttttcccctatcgtcgtctgatgatgatgatcgagctgagggtaatttaaggaaggtcaatcacatcaaatcaaggtaacatataatataggactagtagtaggagtttacgtacgattattcattctacagcatctgttcttcttctaagcaatcacgtaacgtacacctgctagctagtatagtgtcctgatttatttagcaactagtacgtatgtactatatataacaagacgagagaagtgacaggaaatctatagcagtgataggataaagctcttgcagattatgcgtgtgtgtggcactgctgctgccagccagtgccaaggccgccatgcatgcacaaatccgtcgtctccaacttcttgcagctgagccagcggctcaacatgtaacactctgccctatccccccccc

SEQ ID NO: 1296 - DNA, 1471 bp, Zea mays
  misc_feature (1)..(100): optimal_loci_269387_G1, chr8:13291814..13293284, Cluster 8
tgttattgtataggttagggtcaaaactaggcaacctaatgggtatgatcagataagaaactaaaataactggagtaccggacagggttataagacgatgggacggccaaacaaaaagcataatgtagtcatttacatggccgagccgcacgtaattgcacaaaaaaaggatataccagtgaaatactttcacaaaaaaagcaaaaagcaaaaaaaaaaaaaaaaacggggcctcttgatctcctttcgtatggtcgctcagaattcagaaaccgatctgctgacgatgggcatctcgcgcgcttcatttgaattatcaggtacgcgcgtttccaggcgtttgattatggatggtcgcctggggctaagaaacactgaggaaccaccattctcatttccatgcgaaacatgaccccgcgcacgtactcgtatcgtattggttgcccatctttcattttcaggcttcagcaaacgacagccccgaactgacggcaaccacatgtgctcccgtgacggcgatgtgctcccgcgacggcgatgtggctcccgacgttcgccatggcgtggccgcggcccgcggtcggtctggactccgggctggcgcgaccggcggatgctggccgcgtccctcgcgcaggccgccgacgcctgctggctcgatcaggctcctctgttacatgtgattcagagtttggactttggagtagtcacatgcacaactgttaccgtgccaagtctgaaggtttgttgtcctcaaaaaacaagtcttatggtagatagggttcagcgggaccggaagtgtgtccatcctgtcgtttccattcttttcttttctgtatccgccaagttatgggaagaagaaaaaaggtgtatcaaaaaaacgtataatagatgtagccgtgtaggcgtccattcgtgcagtgttcacgtgtgaaaaagaaaacgacgtgtgtccttgttccggcctgcactcgcgcagtggtcctgattgctgaccgacaccgaggtgaggcgatcgagtggcgggtagccccggcggagccttctcgtgcgtgcacgtgcgccccgtgcccgtgagcgtgcgtaactagtactacattgacagttacagacgcgatgcatgtgcccgtgtcatgagtgaattagcaggtgctgcttgttgagtactagtaatggcctaatggcgacgccggactactgccccatttggttctttagtacagatactaaagtttagttataagactaaatttaatccctctcctaagtaaaatatggcctaatggtgcaaacggcctttcagcgtctcgggcagccggacttgcgggcgcacgagcacgacggcgcacacgtgagttgtgaggtagtatgatgagttgcccgacttgaacgtttggttgccggctcagattatatatattattgcctggtgaaccagcatgaactttcttacattcatttgaacgcggcc

SEQ ID NO: 1297 - DNA, 2115 bp, Zea mays
  misc_feature (1)..(100): optimal_loci_2781_G1, chr1:14388912..14391026, Cluster 8
tcccaactgctgttggaaaacaaccatacaatgttctcgccaccgacgctactctacaactatcattcgcacaacaaggtgtgatatatacccatcatcgattcgatcgatctcctctatacacgattccatcttggtcttccattattaaccactccatatatgccaagttgcaagcaaatatgtatacaacattaggtttaagactggtcaggcccgtcgcatcaacgaaaaagaagatcggttttgtttcttagcttatggcacaactatataggtgtttattttatagaataaaaatcctagtttaagccatcatgcgtatgttataagcattagaagttagtttattattattagaaaaaatatatacactagttgtagatcatggcactactatatccggttcttgatgaactactgtatactcacatagtcatgttagtttgtatatgcacaccttttaatttttaattctatttattttgtcctttcatcactcacataagctaattttttatgttgttccctgatggctataatctcattttcgatgttcaagcaattgccttttgtttatttgatgctttctattgctaatttatgcttgctacatatctacatatgtatacataataaaaatcatgtacttaaaaagaaaaatgacttataaattaaaataggtgagagaacttaattctatttttattgcttcatattagggttggtttatcattcctctcccttctctgattcgtggtttcatttgtttgatattattgtttcatgggcctagtttagtaggtgtggatctagcgtggtggctagggagggtcttgcaccctctacctacatgttgtccatagaatccccatgaagcatctcttagatttctaactatggatgaaaaggagaaaagatgacaaggaaaaagtgaatgatgagaaaaatgaagatgatggtgagcaccccctcttgcatgatcttggatccatgcctgtagtttagtaagggatacatgtaaaccaacatattattgttattattattaattatatgaaggctactttaaattgaccaatagattgaaacatttaccacaatatttgttctcctacctagggctacatacacctacaaccatgtatttcgcacaattacgatctatgtcattcctcctccctatactaatcatgggatgacctagggagctacatcgatatggttgaaacatacctaaggcccaacccaacaaatcaagcaatagttgtaagaagaaaagaaaactcctttcacatacaatgtttgtattcgtctagctccatttgtgaataatgatgctcacgacacattcgacctgtccaagtgcgaaggtgccatggattgatgaggatagtcaccgacgagtcaaaaagattcttgaagtgaacaatgtgtattccccatctcgccccctagtcctctttctccccagattccaaattcgtaacctctatatctctaattagatgtttaggccgttgtagagggcaccaacgcccctatttgttttcttatcattgcaacattgacttgccccttgctcaatagttgtggaccatagagggcatgacaacaactgagcatgtaatctccacacaagaactcaacccaactcttttgaactccctaaggcacaaaccataacctatttgttattcaaatattcaatagatcaatttaccctaaaattagtttagttaatgtagaaaaagtaggtagagagaattaaggattttttgttaaatggaagaatatgacataataaacacttccacgtccattggatagcgtaggatcaagaagtaatgtgtatatttatttgttgtctaaacttttcggcatatttctttaggattgattaacaataaggtagacaatcggagaagatgaatgatcatggaagctaaaaaatactataagacttcccttaaatctaatacctaattgcaccttgttttaagttatggacaaaatgctactaattctgtaaagaatcttaatctaatgaacctcaaactttttagaataaactagataaaatccttgaactaacccaattggatccaccttaat

SEQ ID NO: 1298 - DNA, 1545 bp, Zea mays
  misc_feature (1)..(100): optimal_loci_285693_G1, chr8:118836388..118837932, Cluster 8
ccgtgagtccaataattcttcttagtattgaacatattttctttgtgatggatatttactctatttatttattgtttgtaggaagtcatattcccacaagatgcaggatctatgcaacttggtcaatgactatccaccaatggacatttttgcatatgaatgcattttatcgtacacgataatctgcaaccacaaattgtttgtcgtgtggtatccaaaaagtttacatgcatacatagttttagcatttttcattgagtatcttctgctctctatttgaaagaagtgaagttcttccaatccccaaccttataaatcatgttttactgttgtgaattgttttgcttattagatgtagaaatttttgttttctataggaacatagttttttaattgcaccccaaaatatgctagcttatatattttggttgtgattaggagtgtcgggccactggctacccgctttttttcccttttttcctttttaggacactttggagacaatagttcttatggtgctctatctatttctattttagtaattttagatttgtaatgaattgtttatttgattgagagatacttaatgtatcaatgcagccaggaaagcaggcttcctactgagtttgaaattaccaattgttgtcatccttgtgtttcggacaaggaaaatgttcttgttgttcaagttatgagatggagtggtggctcttatcttgaagatcaggatcactggcggttgtctggtattcacaggacgtgctcttactatcaaagccacatgttactcctcatttaaacatgaattaggtgccccatgttatgggtttgtcaagattcagcataataactcattagttaattttaataggtagaaatgcacatggcatttggctatctccataaacccaagataaatatggatccatttatgcttgcactctaaaagaatatggagcatcagctgtgaacttttcttctattagactgatagtatttcacatactatactaaatgagtgtgagtccactgttctgttctttaacctctctctaggaagaatccatggtctgtattgttttgctgaaaaggggatgtgctaacttgttgagattacacatggtatttacatttgtatatgttttgtccatttccatttcttaaataaaatatcctttgtagatttttatcacagtttacttcttcaaagcaaccttggatgaaaattccagtttagctgatattgaggtcgctctgatcccaatcttggcaaggtcatgtgaataggttagtgccttagtggagattatttgatatgaccttcaaagttcaaacatttcttacagtaataattgatatctgttactcagaaccacattcgaaccttgtatatgacttaaaggtttttaataaaaccagactccactccaccaggtatgaccgccctaatccccgtcctcaccttcatgccatcagtattttcatgttagtacactaactgcaccctcatgtaggctttatgtgcgctcctggacaagcaattgc

SEQ ID NO: 1299 - DNA, 1799 bp, Zea mays
  misc_feature (1)..(100): optimal_loci_285825_G1, chr8:119586280..119588078, Cluster 8
ctaatctctgtaagcgtagagcctcatgggttcagtggcaggctagtgccagggctgcttgaactaaggaatcatggccagcatagtgtacttgctaattgttattcaaaaactgttttcttaggaaaaaaaatatttatgcatcgttttttttcctttttgtaaacaagaaagttaagcatgttacattataggaaccagcatactacgtgtattaatttttattcaatggctatttttttatatggcaagatatctcatgtagatggtcagaagaaaggaaggatataagagtgttaactggtccctaacctgatagattattagtaaatactagtctatcttgcatgtattatgcatttaaattatctgatatataaatggcttgtcacaagaatatattattgttattcctgcctgtaggaaccatgtagcacaatcgagttaatactaaacaaaatgcaaacagttatatggtcttaatcttataaactttagcatcctatcattagattaagttattatttcctatgtgaaagatctgtacttgtagataacttggcactcatctttagagctgcaaagaactgtaaaaacacataattatcagcaaaactaaagaagtgatactatctggttgatcactggggggaaggaaatagaagaatgtgtggatgtacaagttatacacccagttatctattcaggacagccccctagttgatacctggcctataggttcatccgtccccctagcgcctaatttccagacaccctgcctgtgtgtcaacttatcatggtccattatatgtgttaggaaccacctcaccatcagcatgtttggtaagtagcgtttggggagctaaacccagactgcttgatttctgatgacccaagtttggccttctgtagtttagtagctttgtcatatgactgtacaattctgaacagtgtttactaggagttggtatgacattggctgctcaaaatggtctcacacaaccataacaggatcatacagtttgggtctagaaaccttgtccattgtcatgggtacaccaatactcaattagtttctcgtccaatcctggtcatcagagcgataaaaggcagagtaccaaccaattaaaatcagtcatgaatagggcaatccaattgcacaagctactcatttgttgaatggagtctttgtccagacaccatgaacacacagattctcaattccaaactatcgccttggcattgattctttttctaggtgtccttggcatgtattcatcctcaagttgcctgcatatttccggtgagctatgcttttcatcaatatgcatttctcatcaatccacctaaatctttttttcttattcgcattgccggcatccgaatctcaatattcctttgttgtgcagcaaataagctttctgtggctttcacagaacatatgctgccagacaataaaaataaactatcgcggcggcgactatcttacgcttagtgatggttactgttcggggatgctcttttagcaactagtctagtctagtggttatgtgatgctcttgcagttcacaggcagcgaggaggcacctgaaggattcattcttgatatggtatctaatgcaaacttgcaccctatattttcttgcattgtttatagctgtacatgtataatgtgtgctgatgcgtttgtgctaatggttggatttgtttgaaggaaatctgtggttaaagtaaatcaaattgaggcgatgaggcgaacaactttgatattctttgcttggagcatcgctggagcatat

SEQ ID NO: 1300 - DNA, 1473 bp, Zea mays
  misc_feature (1)..(100): optimal_loci_28771_G1, chr1:176062139..176063611, Cluster 8
ccttgtagagtagtagagatatattgagaacttcaatgagtatctttgggtaattgaaggcattgattcaatcttgtctcagttttaaagaacccacaacctaaggtggtaaggccttattaattttttttccgagattgatgtctctcatcatgtcccttctctttggagatccacaaccacattcaacaaggtagaaatcttgctaaaaatttgtgggatgcatatatactcatttttagtaacatatctacacatccactctagttgaagctgttgatgaaaggaataaacacaatatgtgcagctgcactactgttttctctcatgatccgtgattgtaaaccaaccatctactattttccacctacatatatgctcttttaatctatctcgcatctattatttcaacaattccaaccatctaggacaaatgacatgtaacccactcccttcttattattagtagggtctctaagaacaagaaacacaagtaaaaaaacaatgttacgctagggatgaaatgcatgcactcgaggcaatgacagcacagaaattacgtcacccctaccccacttagatcacgacatatccaaagagtcccaaccatgcttaaaaaaccctccccatgcatccccatttgttcccacttcattgcgcaacataatcctagctagctatttcctctctttcttgtgaaacaaaaacaaatagaatggtgcacactagcaccatccgatctggatcgtcctacgcgttgcattggctgttagtgtatgtgacgaagaagaagccagccatagtgctagccgtggtggccatgctattcgtgacgggcacgtgcatggcggccatgtggtactgtagcttcgacctcctcctaacggtgttctgcacctacctgtggctgctgtacgggtccctctacctgtggcgccggctccgcgcatgctaccagcacgcggtcctccgccgcggcctcggctacgcgaccgtcggcctcggcgtcttcctgtcggcgatcttcctgtacagcttcgcgagcgtcatcccgctgctgcaggccgtcggcgtctggctcttcgcgctgctcgtagcgtactgcctctaccgggtcattgtgctgcacatcgaggaggaagaggaggagaaggagggcgccgtgctagtagcacagccccacaaacacgctgtcgtcatcaggcctctagtttgatcatgtttgactactgtgcttaattagttgtgtacaattggtgttgtttgttgtatatattataatgcatgcaatgtaagtcggcctgatatatatcatcctgtcgtcgtcacttattagcatatatattcgtactaataatgagtaatataatcttgtatatatgtcgtctatatgctataatcatagtaaagtagtaaaggagtattttgtcgttacttattattggcatatatatatttgtccaaatgttttgc

SEQ ID NO: 1301 - DNA, 1952 bp, Zea mays
  misc_feature (1)..(100): optimal_loci_289301_G1, chr8:139100796..139102747, Cluster 8
tatatatatatatatatatatatatatatatatttactatttctcctttccgccatatattctacatctatcaaaacaactggttttaatttgaatcggcttatacagtattttgtctcgatcaattaaagctacagtagttcaaacaactagttttaatctgaaacgaatagtcagagtgtccaacatagcactgagattacatgacccgatgttattattgaaataccatgccatgtaatctcgacgttgttgatcataggaccaactgtgaacctcttaaggcctcgtttggctggactccggcttcttttaagaatagctacaacttccgttactttgaagaaacaactcctctgtaggagtcaatatatcgtttggcaaaacgcttgctcctgtattttttttaattgttgcagtcaacaaaatcggttgattgatacattcttactgcattgcattcagagaacaggcaagtctagtctactttgctgaaccaaattgatacagtgatgtctgctgctcggtgaacctaactactacttggaactgcttcctgctggtagttgttgctagttgtttcctgctgcttcaagtgcccgtggccagtgaccggtggtggcgatggtccgacacgcgtgtggggagagaaggcacggagccatgttggagctacaattcggggctccggctcctgagatgagatgaaaactggctaccgctcctaagacggagccgtgtcgtttgggagggcttgacaaggagctggagccagagccaccaaacgggacaataagggcctgtttggactttggagatttaaaaactttagcattagtttttcagcttcatcataaaacagctccagcagattgttaagtggattccaggagtgtttgacttacatatggactccagcttttaaagtacaattgatttggataagtttccttaattaccctcgatgattagtgggttgtcgtcgcgagagtcgagagataacagaagttgtatgttgcgtaaccagttaccagtgacatggtggataattttcgtacagcctcataaggagatataaaaacagtgtttttgaagcaccttctaatgagcttcatgaatttcataaaacttgtatctagttttgatttttttcaaagctagagctcgttgagttggatctatttgggtagaagaagttgaaatttttgaagtgaaattatagtacctaaattttatagaaaaaatgagcaaaaatattcggccggccactgccacccagatgtgtactacacacgaaagggacccctactcggccgcatccggggatatgtgaaccagctggccgtttcttgtaccacgtacctgggcctgccacgtcacgtacggtcaagtcatgcggcgcgcgcgtattcatagcgcaggaaaggctgtaccactaccagtacaaatacagcttccattttgtggtggtatatactctcacgagcgaataatacgccttcgtacgcaaatgatgggtgggtgcgagcctggcgcttttggacctactgtgctactccgtcagtattttcggtcccatagtccatacgaacagtaaacatcacacgccatgccatgtctacatgcatacatagcatacatacatacatcatcatacacgcgcatcgcccatcagggccaggggtagtaggagtagggtggtgccgcgctaccgttctagtacttgcgttgtttagatatggctgtaccggcttcggttttaaatggcgcttgcaaatcacagttcaaactggtgaacagtagtgctcatctagtactgctcaactcccctctgctcctctgctcgacacgtactagcaatgaggggggcaaaacctgttgcttttgggatgggtcgtgcgtgtgacgaactcaagagcgacaaaagcggttggtttttaaaatcgtgtcaa

SEQ ID NO: 1302 - DNA, 2121 bp, Zea mays
  misc_feature (1)..(100): optimal_loci_294101_G1, chr8:163377908..163380028, Cluster 8
cctgatcgaatcagttccccgaagaacttttggaacgacaaaaccgaatcaccagttgtaatcatttagtgagaaaggacgtgcgactaagcgagtccaactcatttttttcactagcaaagattgcacactaaagccaagcaagtcattaaatcaatctcagatcggagttgcaagcagcagacttgcagagagagatttgactaaccaaaattattaacacaggagaaacggacgcgcacgcacagggccggcacgcatcacgtgcgacgtgtacactgataaaaaaaatggcggctgcagggttaaggtatcgtatggggggggtctgcgatccagaaaacgacatggcagggggaggggggggggcaacctgtacatggatgtcaataaccagcaccgagcggcgagtgctgttcgatctggtggtagcacctgtctgtggtcagattcgtaatggctgccattttgccctggccacacaaggaactcgcctgccattttgcgcccccggccacacaggcgcatgtgagtgctgcgttggcaccgcgcaagtggggcgcaccagtattgccgtcgccgaaaacgaaccgcacaacacaacccaacacggcaacacgcccctccccgaattcacagttcgcttgattggttaccagcttgcacaaagtcaggctcccgcgagcctgaacgataggatacacatacactcgttctgtgcgtaccaactaatacaacaaatagtctcaaaatgtattgtttttatatccgctcagatctcacgtgcaagcaaccaaacaaaatcttagatagaatcaacgcacgcggtgatctagaatgtgatgatacggccaaccaatgagacggagtctgaaggagaagcactttcatcatcttcctccgtcgcctgcagctctacgggggttgcagtgcagggcatctcccgccatcgaaggaagcaaagggttctggttgcatcgcagtatgatcttcgattgcttggtaggtggagatcgtaatgagaatacctggacttgacgcatgcagtacaggtcatagtgccactggcactggcaccggcaccccatgttacgcactcttcgctggaatggaatggaatggaatggaatggaatggatggataagttgatctgcagatatatgaatggtgcctgaaatgtggcatgcagtattattttttttaatccagattgatgttttcgagtgaagttttttttcacaattttgaaaaaaaaaactgcagtattattaaatattgtagtattatattcataatggtgtttggcaagctagctaaaatctctgtttttaaaattaaagtattgtaaatattgtagttgttttaaggtattctagacttaggtctagatctaagttttcaaaactgaaatattttaaattgttgtattgttatgactaaagtatgttgtagtatttttcaaaaactatggctttcaaaaactttgtttctgatcttgtgtcaaagagaccttccgtgccagaatattagaccgagtgaagcaggaaaacgttgaatatacttagcaagctgagctgctttggataccagcaggtttgtcagtcgcaggtaggatgataattaatactgtaccatccaccttggcgccttgcagaaattgctaggctcgtgtcgcctgaatgagaatgacccactgagaatgtcgatccgccaacgacgacgtcgtccttcacttcatatcgtcaaaaagaggaagaaaaaagagagagagagagagagagagagagaggaagatgtacacggcgcggaaagaatctcctatctctctatgtgcacggctcgagggggcgcgagccatgaacgcgacgacgagcgatgagcaagcagacatgatgctacattgctacgcgttgaaggatgcaacaggataccataggggatccagtaaaaccttactctgattgatcacgtaccaactcttgcaagggtagcccatggaacaaagacaataaaagataagtcacctgaacttcacacatgtccaccttgtcagcaaactgagggttcatcatcttagcaacattctacagctagttcaccagactgtacaatttatagag

SEQ ID NO: 1303 - DNA, 1415 bp, Zea mays
  misc_feature (1)..(100): optimal_loci_294172_G1, chr8:163908934..163910348, Cluster 8
cagttgatctgcttcagtgacgtgagtgagtcccctcccgtctcgggccgatttgcgtccccaacaagtatctcaggccggccgtgcgcgcccgccgactcatgcatgggcatggcgacgactgacgacgagcacacgcagctagcggggggtaataatatctgggtcgggcgggttagggttcgctttaccgatattttttttgttaggtaaagacatcggctgctgactttgagatactccaatcgttaaaacgtacggcgggtatctatctaattaatccgttacaacagagcagggaactcgatcgattattgtcagaaacggcatcgcgtctcctctacagctggagcgaaccgtcgcggtctgggcattacggggagaagccgttccatacttccatcgcggagcctctcctcctgggctacggctaaccatggcaggcaggcagcctcggcctcgaaaaagaccccgacggagacgctcctcctcctcccctggcctaactcagctccgaaacttaaggaggacgcgtgagacgagatgcctcacgaacctggaaaacgtagcctgcgtgcgtgtgcagtgcagacccgtgctagctcgctcgctatgcgtcttgcagttacccgacccgaaagttgccagcctagggtgctgcttatgcaaatctgcagaggtcgcatcgttctcatgcaccccaacatatataacgtgtgtagcaatatatgctgttttcccgtaaaagcaagaaaattgctgatttgaaacgaaggctaggcttatatccagtgaagaagaaacaatctgcatcagagagagcaaagggcagaggttcggtactactgtcactactacttcttcccatatgagattatcgtttgagatattagttagtcgtcctttctcgatctgtctctcctcctccaactccatacaagattcaaatcaacaacgaccctcactcgctaggtcaaccgatggatcaggcggctcaaaccataaatagaggtagatattctagccgcctctagctgtacatctctagaaatcaggtgggccgaatcagaggcggacccaaagtgagccatgcccctgctatttttttttaccctttatatacgtaatagtcacttaatataaaatatagaaaaattaaggttttgggtgagccaaacagcctgttgtaggccttctcatcggatcagcctagtccacccgacttcggtccttcttctcgacctattcctcatatctatatgtaatacgtccagcctcattcttatgtattattatatttcctgatacactatccatatgtttggttatctgtatttgctggtgcttgcatcgtgggatgcaatgagttggtgtttagttgttgtcaacctgactctactcgtgcgaggtgtgtg

SEQ ID NO: 1304 - DNA, 4180 bp, Zea mays
  misc_feature (1)..(100): optimal_loci_294227_G1, chr8:164020781..164024960, Cluster 8
cgtagttgctgtgaaccattcgtaccttgcacaattgtgcgacagataatcgtcggacggtctgatgaatacagaaaaggctagccgagtgctaacaactatgtcccaccttggggtaataaataccccttcaatcagacaaaaaaagcatgttcgattgtgatgagattatccgtgtgattggtgagcctcgccgcgttttctaggtatctacaggtgcagtgtatgtgtgctcagtttctaggatgcagcgtacaaaacacgaggcaagttatggtcaatgcatacgaggagtctgattctataaccacaaaaatatttgtatttaaaaaaacacatagaatcatgctatgagatttaattttttttaattcattacaaaaaatatatggcatagtgtgtctaatattaatttagtgtcacgttttttgtattttaaataaatctgattaaccgaaaaagaaatctgattgaagacaactctgagactagtttatttagggccgggaaaaagagtgagtcgtaggcgcaaacaagttagaagcgagcgacgatatggagcttgcggccattagcttaattgcttgcattattttggagatgccgatcagaatcagatcgagatgcggagtgtgaatgaagcgagcgcgcagaggaggatcgaatgaattgatggcccccgttgacccgcctgccggccgtcctgctggcgccccctggtgtccgtctggctggtgtaggtgggtcgcaaaagcgagcacgcgatcgaggctagctagcttgtgttcccgccgctgcaagtcgcgtcttccttcctccacttcagcggagtacggtgccgcgcgtgaaagactcttgccgtagactttggtggccaccgcgcgtacccgatgagtgtagtaggagcagcactagtctcctcgttctgccactctcaaattctgcgcgtacatgcacgcttgctgcggtgatatcatcaaccggccggaatatacgtcgtcgacgacggtggtggcgcggcgtgcatggcgacgtacgtacgcgcctctcgctgcatgcgatgcaaacaaacgcgcgtgcgcggggcgccccgtcgtcttccggcatctatccatacagcacgcacgcacgcaccttctcgtcgtgtcgcgccgccttaggtttcgacacctagctagctagctagtcgacggcgatcgacttgccacgtagtacgagagagtacgtcgtcgtcgtgagtcttggtcggcagctggtagctaggctctcgcgttgctgccttgcttgttgcccttttgttgctctttgtggtcgatcgaagatcaggagacgtcgtacgtacgtagcatcgccggccggccggccggcggaataatggcgggcaaagttttccagcttctctcgtcggccgcccggctagctggccgagcaagacccatcgatcggcgacgatagatcgagcaacgacgacaaccgaacgtcgtccctccctcgtttgacaacaagcattcgtcgatcgtcaaagatgcacgcgccatggacacatgcatgcatgcattattggccggccgcggccggccggtgtgtggcggtggtgcttcttcttgttcccgtccgcggtccgtctctagtttctcttctcttcgtgatccggtccggtcgctgaaagcctgaaaccacagacgaaagcggaaaagggcagagcgaaaacttgacgcggccgggcctgcatttacttccctccttcccctcgggagtgtgtacgtgccggccggccggcggtgacatgagatgagagctcctccggttggagtggatcacaagtaaggttcccgcgccctgctgcctgctggtgactttccagttcgacgaatcgactacttttggcttggtgtggcggcgcggccggcacacgcgtacgatcgagctgtgtgacacacgaattaatcaccaacagtgtacacgcatgcatgcatgcggcgcgcacgtacgtgttccacttggctacgtcacgtcagattggaaagctcgcatgggatgcatgatgaggtgtcgtctatgcatgtgctccaaatccaaaatatatacgtacgtacgtagtcgtttccatccatatatattgaacgtcacgataatacacatatatagggtacggtggctggacacatgtatgtatattcatcacacggtcatcatcaccgccctttcttgatcggagctcgatctggtttgtgtactattgttttaatttctgacgcgtggtttttttttaatgtgattgggtcacgcagtatctttttgtagttgcgagtaaaaataataactcaccctcacgcatatatatctgcgtacgtgcttcactagtcatgcatacctgcggaatacttggatgacttaatttgattgatttcaaaaagaagaagaagctagcctggaattctatcagatttggtgccggcagaataatgtcaaggaaacctcatagtagtttattcgatcagtacgcagatgcagtaccacctgctttgaagaacatcgcactaataacagaagcagatgagcagttggagacttggaggcgagacagaggccagtttcctagtgctactggtgcatcagttctagccggaattggcggcaccgcgtcatcccgtccgcctgaaacttgctcgaacaaaaccgaggagagcgagatgggcttttgcggtggcgggccattccgacgctacgccaccgaccggtcactcctcgcctcgcgccatcaggagtggacgtaggcccaagcccactacgacccaggggcctacaagagattcagcgtgggcctgcccttgctcttgctgagccgaatatgtacccaacccagagacagagaggcaggcaggcgaaactttgggcctaggttacagggaggctttcggctccccgcttctctgttgccaaggcccagccgagcacactttgactgttcgactcgactcgagcatgctgcagcttctgctgctaccgaatccgctcctggtacgttacagcttctgcttccttgaaggctcctggaggtgactggtgaggctgtcgtggatcgctgacggtgccttggcccgtctcgtgcgccgatcgatttgcgcgctccaagtttcaccagactgtcgtggatttgcgcgctccagcttttccggtcagagttcagacaggctggggcgcgggctaaaccgccgcaacagcacgatatcagcgagtgcgaattgctattgatgctgcaaaaggactcgaatatcttcacgggaaagttcagccttccattgtccatagggatattagatcgagtaatatcctcttgtttgaagacttcaaggcaaagatagcagacttcagtctctcaaaccagacttcatggttgtccagttgcacatgagctcacctcgggcctacggatatcatgccccagagcaagaacccttttattaaagtaactacttgtgttacttaactttagttgtgctttctgctttggcatgtattgtccaattaattttcgagtaggacagcaagttggatggtgtttgtttctaagttgtctgattaattttaaaaagtatgcctttttatttctgaagtcgaacataaaggaacacattagaaaccaatcacatcctcaactttctggcacttcacatgaacagtttaatttctttagcctttgctcattggatttggattacatcattacaagccatcttttgccaactatataaagtgtgtgtttgattgagttgtgatttctgaaaagctattgtgatttatgatttgtgaaaatttgttgtgggtcgtggattgtgaaaagtcgtaatctgtttaattcaaacaagtatagaaacctacctcccatctctatctcccttgaaacaactatgaaataactctatttttaccatttaaaaagcagaaagcaggatccaatgcgctttcaaaattgtattacccaacagtagttatttctataaaaaaaacagcttccgtttcctaccccaatgatagttttttttttgctttttgaagcaaaatcagttcccaaaaacccaaccaaaggcactcaaggtccacttttgacaatgttagttattttgttttgctgtagttctagaaaaaaaagtaatatgaaaaccacttgcttctccaa

SEQ ID NO: 1305 - DNA, 1581 bp, Zea mays
  misc_feature (1)..(100): optimal_loci_295514_G1, chr8:170057581..170059161, Cluster 8
aatattgctttctgtatgccttgtttgggacgacttcacttcaaaaattgcaacttctgtttttcaacttcaccataaaacagcttcaatatattgttaaggtggatttcaagagtttttagcttgcacatggactccagcttctataatataattaatttgtgtgagtttcaataattacctttgatgattagtggactatgatgagttggggagagagacatggataagtagatcgtgtaaccaatggggtggtgggtaattttgtgtagcttcatgaggatgtatgaaaacaatgtttttaatgcaccatttgagaagctgcaaaaaaatcttgaaactaccctctagtttcatttttttaaaagctacaagtagtaaattcatgaagtgaagccctcccaaacccctcccaaacaggcccttacaagtatctcaagtttaataaatatttcaacacacaatataaatagatattattagactgattatgatatatatttatatatttaacatattaaatctactttaacaaaaaatgacaagttaagaattctgtctttatttgtatggagcaaatagataatataccataatttttattagtcagttgcccatatgttactacgatttctatattcagaatatttataatatttattctttgttgcacacaaatggttgtgagcccaaatgattacaatctaggcgtgggaggggcgggacggttcgaacaccagcaccggagatgacgcacgaagggagaaactcttacttaagctcttgtttagacacgagtattcacctcaatccacatgtattgagatagattagagtaaaacttaaactaatttatacctgaaactatttcaatgtatatgaattgaaggtgaatacgagagtattcaaataaggtctaaatacagtagagatatacactccgaatctatcacaccatttttgaccataggccaaaggccactagctagttgctagtttagaaacttaaatccttttgagatcccttcttctttttcagtgtgagaaatacctccagaaatacctctccgtatgtgcctcctctttcttccaaattagccctcgaggggcagagacgggtcaaaactccactgtgagcacaagtagtataggctatagcaccgtactgcgtagtgtactgtacaggagtccagccaacacacggacgcctccgatttgatatttgattgttgcagagatggatttgatctgtatactgtagcaggtactcctatctgatattctgacgaagacggcggggcggtcggtggccgtacggtggcggttggatgcgcctccgagtccgagcccgcacgaagcttcgtggcagcttccagttcctcctcactgtcatgggatgggcgcatggcagcaccctctccatttgtccagtacagctatttggagctgccgcgtgcacgtggagacggcgcaccgctcgcggtgggtcgatctgtcagtgttgctcacgcgcatcgcctgcccgacgtcgcgtgtactatactatttatgatatgtagtaggcaggcatgtagcatggca

SEQ ID NO: 1306 - DNA, 1536 bp, Zea mays
  misc_feature (1)..(100): optimal_loci_295531_G1, chr8:170138567..170140102, Cluster 8
ggccggagcgtagcaatgccaacttgattgcgttcttcagaatttggatcacaaactcaacacacttagcctttagagcatctatctcagcatgcatttcaccctccactggcccaaactctgaattctgaacgtggtgtgtaaccatgtgatcaaaaaggctgcgtcgccacaacctgctttgaggatcgccggagattcaactgacaggactgccaaccggctctccgaatgacactaagcacaaaatgctgctgcttttcaggtgctgtcatgtgcgtgtgtttcagaaatcgtggcacccatcttattcgtctgctttttgacctttgaatttagctagctctttcaatgaaagaggaaaatgacatttttatacatacacaacaagctgtaccgtaatagatgagctcagcattaggtcagggtgatctccgttgatcattcacatcctagagcttgaaggtgatcgatcaggacgccagtcctgggtttcaggaacctcggaaagcgtggttggttggtcatgagtatacgtttccattttgcgagtctgtactatagatccaagacaatgccaattgtcgccacttaccgaacgagtggacggcagccattttccagctccggctccggaggtggcggtgtgaatgaagaaattcagagacttattaggtctcaggtatggtcaggctgcactccgtacaggagtccaagatatcagggcggcgccgtctgatgtcaccgtgacctaatcgcagatgtaatgtaactcggctggcgcttcagcttcacgttgaagccggccggtctgctgaataatgcgagtgccggcgaacctgggcttctgtcgcgggcacggctagaaagcagtacacgaatccatgcctgtttctccgcagcgtttgctgtctgtcgatcgtggtgccctgtcctgtggtctcggggttttaatggcgccgaggcgagctgatggtaaccgcagggacgagggtggccagacgtggggcgagcaccacggcgagggttacccattcctcttgttattaacgcggcgcctgatgttaccgtgcgtccatggacgcctattaactgcctcaaagaaggctgaagccgcgctggtggtggagacatgctgcgaaggaaggaagagtcctggctcctgagcgcgacggccggaacgtgacgagccatggattcagatctggagtaccagtggctgcaacaggttcattgcatcttgaatcgtttggtttgagctgaagccgtgcatgcggccggctgaatggcgggaaacgcttcacgtcgtcgatagatggagatgaagcgccgggaaatgatctatatctatgcgcgctgccaggcgaaaccgctgctgaaaagactagaaagttgtgcgtttcttttcaggccatggatctgacgcctctcccgttgagattgaatggaatatcgaatctgattgtagggcttgttcacgtaatctggatcagagcacctgatttaagccaaattgaagcccagatgaagtggccc

SEQ ID NO: 1307 - DNA, 2145 bp, Zea mays
  misc_feature (1)..(100): optimal_loci_295565_G1, chr8:170204575..170206719, Cluster 8
gaatagtgatgggatgatccgtaggacgatgtgacacaagattttctttttccattcctttccgtcgaacaaaatggctgcctttgattcggaccacctttcgaccaattgtgtaaaggatattagcagcagccagcaaacacattcggcctataatctttccaagtgctgaagaaggcccaataacacctgttgggtgaagcagagcccatcaggacgatatgcatgtttccattaagcaaagtaatctatcccccggccccgtagtcttctatgggaaacaaatgtaatactgaggttagatcatttgccttttccatttaattttaaaatttgtgaacaaattatatggtgagtactttgataatagttaagttaaacttagctcttcaaaaaggtataggctatgaatcctaacctaacctagggtaccgtgtaatagaatcctatgtaagggtcagtgtactatagaaaagtacagttctgattacattcagaacctttcctacataatgcacatggtgctatttgtaaatagcgatggttagaacgtatataattaaatactgtatatcagaacttcttaccaacagttgagatggccgagttggtctaaggcgccagattaaggttctggtccgaaagggcgtgggttcaaatcccactctcaacattttttttagttttttttctcacttcatacatatctgttttctattttcagttttccaacaccataaccgtacaataaatcggtttcctattttatagattttgttaattgttctcctacagacaaaaaaaaggaagagtgtatggtatgtgacgaatggtagaaagtgctactgctagtttcatgcttgctactttgctagtcgctctttaattaggcgtcgttgtgagagactcagacccttgttccatcgagttttgcaggtccatgcagttctttgcagaacactcttagtcttattatgttgtgttgctcagccattggacatgcaccagcaagcccagaataaatactgtcagaaagcagctagtagccatctagattcgattattttcattccgaaagaaacctgtttctaatgcttcgaacaaaaaaaaatactgtcattattttgtccgcgtggctgatgaatgagcaataatgtgtggattgggatgccaggagctcaacgtgcaatgcaagccattctgccattcgtgcagtcagtgtgattcaaacaatgaggtaaaaagggatccattgatgcagtgtatttacgttgtgctccaactcatacccagtgaaagaatgctttaactaatttctccttgtgtggaccacatgatcgtagcttataggtaagcaagtaagaagagtagcgtcttttggtttagccaccatagaaatcaattgcttgacatatcagagaaaagcggccctcttatgactatgaacatagagaaaacaggaactcagttggaacattctcaggtctgaagagccttcaagaatagtctagagtagaaaccattaaaacattatttgcagtgaacatgcgcttaacctcttctttaagcaatgcatcgtactatttcagttactaggatttgaaggcctcttgttatttatgctcggacactgaatgctggcatctgtggacatcctcttgtagttgtgccgcttgctgctgttctgaagaagtgttacagttttttgtggtagcttacattaagagttaaaaattgtggagtcatctaaggacatcctcaccggaacttaaattgttaaactccaatgtcgagttatgatcgtggtggttattcttttggaaatctcaagtaaaaacacatatatgggagtacggtgtggtatccggtagctccaaaagacctttacaggcgtcacgtgtattctaatctgctaatctgctgcttatacacctgcagtgctttcggatacgcccagtaccagttgcaaagaaccacttttgaacctgtaccggtttagcctgctgttagcctgttaaagcttgcccacctgttgtctgcaggatatgtatttggtgtttgtaaggtgtggccagaactatgctttgtgtttggctgcaagatatgtattttggtgcttgtaaagtacatattttgtattttggt

SEQ ID NO: 1308 - DNA, 2065 bp, Zea mays
  misc_feature (1)..(100): optimal_loci_295581_G1, chr8:170236261..170238325, Cluster 8
tcgagactcacgacctgctctagccgacgattttttttcagccctagtcaggactgaggacacctctcgcccttctcatcattcataagagggctagacaaacaaatgtttttttctttaaaaaaaacttgtcgtatacgttacaagccaactattaacaagctgaatccacgccgttgtttctaaacctgtggtggtacgacgcacaagagcaatcagcactgacatggtgcttagatcaccacgagctatactatatacattaacgaaaacaatggtcatggatggtggcaacgaaaggaacagaagctgaacacaaggacccgaaccatcgtccctagcctgcaaacgcatctatctcgacgagtcaaaaaggaagaagagtgttgcgaaatatcttcacactgttagtctcgggttttttttttaaaaaaaagaaaaactgattcctgaacggcaatctggcaagtatcactgtcagtctgtcactgcgagggtcgagtaatgactcgcatcttgcttttcttttggactggtcgcagcttacagcctccggagtccggagcgatcagaaacctgtcgtttttttttttttgcagccgcaaagccaaagcgggaggcggcgtgggcgccgggtggtgctgcgcggcgcgggcagcggccactcaaacccgtgtgacctgtgctgtgcccacgcgtttcagtcgctttcctttcctgttccccggtggttatcccgcggcccaccccagcaccgttcgtcgaaccggaacgaggcgctgatccggagccacgccacgccgcgccagttcctgcagctcgccgaacgtgcaaggcatgtgggagatgggagtcgcccgccatacgcgcggtctgaccggcccgcgtcatgaaccgcatcattactcgagcaagcaagcatgttatctgctgctgttcatcgtcgccgacagcactgcgacgtggaccacggagactttgtggcgcgcgcttgcttcgttgagacgccccagatttcaagaactcgaaaatgaacctgctggttactccctgcggccgagcagtcgagcttggtacgcgctgttgtcgacgatcagcgcagctgcagtgctgcacagtgaactagctaggtttcgcgactaaagagtgttttcggagactcgcagtgtaaagctcacatcagagatcagacagaacggaagaacaagcgtgacctgtgaagatagaagaaaggggccatcccgaggtcgaatgccaccttggcgtacgtgccgagccgatactctcttttaccatgctcgctttggccccgcccaagccttatcctttcagcagtcagggcggtctacatgttgcttatctattgctagctgacaacctcaggcttgtcaacctgcgtccctctcactggaaactcaagtgaacgtcatcgtcttatcctcctccaagggacgatgaatacgagcgagcttctggcgccattcagaaaaaagtgctgtctgctgttgcaattgatgaggtgcagttcgtggaatgctgttgcaattgtattccaaggcgctgaacattgaaatagtgtttgactttacctacgttctgcgtattattcaggatactgcatcatcagccgaagtagacttctctgggccctgcgcatttaggtttttaattcaagataagtaggagtcgttttctcgttttctgagctgcttgtatcatgcaggtttgacgcccagtacagaatatctctcgagtgggggacaaaatctaacacgtcagacgtccaaaaccatcactcgattgatatttgagacaaaattctactcccgcagttcacataagaaagcaatttgcatttcaaaaaaaagtcaaacagtttaggattttgactgaatttatgttaaaaaaagcactagcattcattgtataaaacaggtattattgttacattagttatagaatatagttttataataaatttgtatggaaacatggatgctattagtaatgattataaatttagttaaatagagcgcgacgcaaaagcgtgcacccgtgcgtccac

SEQ ID NO: 1309 - DNA, 2318 bp, Zea mays
  misc_feature (1)..(100): optimal_loci_296212_G1, chr8:173613635..173615952, Cluster 8
tttaaagatgttcatgccacgtcattatccagttacgtagagatgaaagggcacctgaagttttagtgaggtataagatttgctcttgacattgcaatgtgtctgaatactctatcaaatatatattgtttatattgtctatccttttgataaaattctatgtacctcgcagtttgcaaaatattgaccgaactgaaacaggtagtgctacacttttttatactcatgtagaaaaaaatatactcattactcgcttgttcatcagaatggaatgattgttctttttgctgtggaagtatatctgttttcagataacagttttgtatcgattcagctggatacaattcaaacagcactatgaagcttgtttctgctcctctacaattgaacgcaaccaaacagagtgttccggatttgtttccttgttcaggagactgaattatctctgagtgcaaagctaagccaatcattcatagaaatttgtcaccaaagctcattaatcattagtttgtaattgtattagtgtaagactataatatataagtggctgcatgtattttatacactatcatacttcggtaaggtagcatgtaggaatatttgacctttctggaagcttttagagttgggtcaaaatgatgtgtgtattctttctttcttttaattgccatctgctctctctttttgttaccatatttatacatacttgtttgtttgtgtcatgttttttatggtcacagggatatgttggtattgtaaatagtacaaactgtaattttgtttaagtgctattttgtgtacaagtactgcttaatatgtgtctgaaaagattttattttttgaagtgatttccaaacttgaacgggaatcattcttattctttgaaatgtcttatagcagttattgtttatgtgacattgtactgttttgtttcttaaataaacaccattttacaaattttgcatcatccctataggcctatagggcgcccgaaagggcgccgcctgttctagtctgaataactccgagggaactgaagcttggtttgttcctcttcctctccacgtacggacgaatcagcgagtcacacgtagacggctggggaaatgccgaaatggtgcgtacatgcatgctatcatatcacacgggtatatgtatatgagactaaactaactaactaaccaacagatgaatcttctgctcctttcgccttcccatgatgcgttagtttttttattggatgataatattgatggattagttagagggtttatttattatatattactcatgcctgtatgatgatttagaaccatatcctgcttactactttgctacttaaaaccatgctaaaatacagccaaagtagctaataagctaagtataggaatatgatatgacatgctagctagaatatagtacatgtcgaccatgtcgtgagctgaggtccgaaaggagattgcttttgctgtggggccggggggtccgaccgctgcatgaatatcaatatcgatctcgcaaccatgcccccccccccccccccccccccccccggccaggagagtgctaggtatctacttggcggatttagaattgggattatctgggcgaatcgaagctcgctttgttgctctagtggggtgcacaatcagtacgtagtttcgcgccgcttcggaaaagaagcccggcccggccgtatgcacgacggcgtcgaccggtgggcgccgtgctgcatgcctcggctcgatcgactcataaaccaattattattaaatgcagaaaaaggtttgcatgttcacagactataaagattgtcaaatactactagtactaaacatggtccgtcactaatgccgatgaatcaaagagctaccaagatcaccaatcacatagctaacaaaaagttccaccttttaatcaatctgctagctgtagaccaactggtgacaaacgagctattcctctacttaattattacacattcacatgttcatgaatcaaatcttcaggttctggtggaacgcctggcctctagcttgatgtgatgaagagctggtgctgtctggttttgtaatgccaagtaggccggggtgcgtgtgcatggagcagtggcgcggtagctagctcgacatgcggattactaaaagggacctttaagcaacagccaagctgatcgatcgtaggaaagaaagaaagaaagagagaaagagagagagagaaaagagaattggttgggcgcttgcatgcatgtgtccctttatatattagctgtacagctagccatatacgtatacctgatgcctcctaccaatatatat

SEQ ID NO: 1310 - DNA, 2124 bp, Zea mays
  misc_feature (1)..(100): optimal_loci_296288_G1, chr8:173931223..173933346, Cluster 8
tcgtggctagtgtgcctagcacgatgtaatctatgtcatggttttttatgtgagcccgtgctgggccgtgtcgggtggcccatttacactactgtcgctggtgtagctgcggaaaagaaaaaaaaggcttgtgacggccgacgacggggcacgcgggtgggctagtcggcggcgaggatgctggggggtcgccgccgccgctggatcctgctcgagactctgctgccagtgactggcgtgctaggccgtttggtgaaagtaaaagcgaaacgaacgagcgcaattcggattctgttccggccgctatgcaaaggtcggccgctgactattaattctgtcaatcggctcttcctagacacgtgtgtggctcagtgatgcgactaatcaccgtcccgtcggtttctggctggggcacccaccacccagtctatctcacgcctcgcttttgttactcccaacccaaccgataagagctcttgtcgtttatgccaagttcaggacgtggaccatccatcgatcgtggaacaagttgggcgagcatgcgtgggcaaatatctgcgtgttggaaattagctatactcccaattaagactccagcttgcatgtacgtacaccagccagctaactctctgctgatgcagcacctgtggtgctgactgctacatctgttaagttcagtccgcctctcgtttcagataaactctactggtttccttttgcccatcatgataaactctatactagagttgttcagcgtaacaaagctataccgtctttaacacatgtttcttttaggtgcggatctttttttttttttttttggtcccgctcatggtgcttacttgattctctgtcactcttacggccggtcttcccaccaaatctctctatccgatccggccaggttccaggaaagaaagaaagaaagagtcatgatctcaggggaaaaagtgtaatctaattacagatgatacaggcatacagccgctgtctctacagatgagatagtctgaacactgtacagactgctacttgtcctggtgcgatgccattgtactacctaatttagccctgctagtgttagcctaataaggttagattacacagtagcagtactactaatcatgggtgggaagcatggaattgttcttatcttttgcttttatccttaatcttcgatggccgaatctattcctgccatcgaacggttcagattgcaccgccgccggagcacagacaaaacaaccgattccccactaaaacttggccactgctaaaccaaaaacaaaaacgctagctcgccatgcttatctcgctctgcccacagccacggtgtacgcgggagacgcctcgtttctctgcacattcaaaatcagccaccgggagggaggctgcactgcactgcactatcctatcccacatggaaatggaactcgatctggaacaatgctctcacggtcacgaatccgccgacgaattaatggatgcctgatcgtccggacccatccagtctagtctagcagcccgttgccgtcactctcctccggcgacccaaccgaattttctcggcccggtacagcgacgtcgccggcgactttccaactcacccgccgcaactttcgcgtcggagggggcagcttttgcgtcggacgggcactcgcggctgcctgcttttcctccagcagatgcagatgcagatgccaagatctccaagtaaaacaagtgcgcagagaaccgggcggcgggtctggactcctttttgggcgacggcgacgcgtccgaccgcctcccttccttccttcctccctctctctctgacgctgacggctgacccccggctggctgcctggctggtgctgcggtgttgacttgactccagtgagcgtttgcgagtgaggagcaggaggacctgtgcatgatcgactccacaccctgctactgggacaaatgcgtggtctggtcgcggaaaagaggcgctggcgcgagagtcaacttgcgcacgcgcgcattctacgactggtccttccttactcgtactactactctactagtaaaaaatgacaacgctgcttatccggaaggatgcggcatcatgttcacccaccaatgttctttctttcttta

SEQ ID NO: 1311 - DNA, 1514 bp, Zea mays
  misc_feature (1)..(100): optimal_loci_297874_G1, chr9:4773378..4774891, Cluster 8
cgaacctgttttaggaagattttagatttggattccatttttgaccagtgacgtgtaaatcgaaaaaactagatgtcttctccttcttttctatctctatttttatctactcctataaagtaccagtttagatgatcgtcatgtatcacacgcgaagtacatagaaatgtatattttttacttcccatttcccatctaacaattagataagtcctatctctgccacaaccagataagataagttacactaacaaccaaataggtacgctcttaactactccagtaaaggaacatccgatcgcctatacctgtccatatgcggtgacgtcgaacagtgcaacatcagacaagcacgtgctgaacagcctgactctgagcacgtgctgactacgacttgaggccgagcatcgagccctatcggcgaagccacgttaagtttcccttatacacaggcaccgggataaaataaagttttattaatagctaccttaaatttaccatgtatttatttttaaattgtataatttcctttatgtttgatagagtgtgtatcagtgttatttttgaactggcatcgcctagcccctgtcggctgccgccgagtccatcgtcgaaccgaaggaggtcggggtggaagacagtgagacgggagagggaggccctagcgtgcacgatgtgatgttttaaacagtgcatgttcaaagtgacaaaaaaactattatatttcaatcacaaattttgaatttctttttgtttgctttatccagaacctcctatgtgctatttcactgcggagaatcaaagagatggaccgttggaaccaagagcatggttgaactcccctccaaaattgttttgacatgttatattgatctttctgcagaggagagtgaatactatgattagatgcaacatgaaaggagaaacaaaatgcaggaattcagtgacagggattcaattttgactaattactcaaccatgctttatttcattctgaggctccgccaactctgtgatgatgttgcattgtgtcctttacacgtgaaagcatgattttctgcaaactctatcgaaggtatgcccttttttacccttttatattaactctgcatttttgttaccatgatattgtatgatcatagcatgcttttcatctaccctactcaatagttgaaataggctaactcaaatggatgacttgttacttaaaaaaaatataaggacaatttggcagggctccttggaagtgattctctcctctcaagccaaacaaaatcttacatagattcaagtggagagcagacaagaatcacttctccatttacactgggagctaagagctaaaaaacctgcttcacctggctctccattatttatggttgagatctgaggagaatcaattgtcatcagctcccaaccttgctcccttctatgaatccactggaatcacaccatcggaaaatcaagaagcaaagttaactaaatgagtccatgatatgtcacctattgtattg

SEQ ID NO: 1312 - DNA, 2022 bp, Zea mays
  misc_feature (1)..(100): optimal_loci_301840_G1, chr9:24044103..24046124, Cluster 8
aaggatgtatttggattttctgactaaaattaagtctgtgtcacaacgaatatgtcaattatgaatattaaatatatgtttaattagatttaataaatttatctcgacatatgtggaattagttttataattatctatatttagattcgtaattgttatttaaacattcgacatcacgtgtattaatcttttggcggaaccaaacacatactccacggacgctgccgcctgccgccgccaacagtgccgggcgtttcctctgaccgagcacgccgagccgtccgccgtccgcggcggaatttatacgcttctgctgtaccgctgccaccggcatttatctcgtagcgggatactcctctgtcgtctcctctgacgagactgtcttcgtctcgtagcgggtaaaggatcggccgcgtacggcggagtgctagcagatgcgtcgcgtcgaggagggcacggccagccgggctgcaaggggaggagcaacgctgcaagcctgcaacggacgaaaaagggctcgcgtgtaagcttgctcctgcacacagaaaagaagcagcaccagcagcagacggcaacgctgcttcggtgtcaaacgatcgcgtgtactctgtacaagtagtagtatgagactgagtgtagcagtaccatcggattctagtttttgaaaccgagcaaaatttgtcccaaaccgatggcgttcggtggtggtgctgggcggggcgacctcacctcgagacacccaggacctcatctatctcggtgcgtgcgaccgctgcctgcacagtgcacacctgatggaggagtttgtactttgtagtgggcagcgccacggaatggaagaagagaagccgacaagcagcgcgcatgctgtgcgtgcctgcctgcctggtcgcatcggattcctgcgcgcgccttccgaggcagcggagcctgcccgggggaggggacggggaaattacgcccgtgcccgctgccagatggacaaaggccacgcgcccggcgcgacgacgtgggtccgacgccgagaacaagtgcaagggccacatcgtacttttcagataaaaaaatgccttcactagtcttctcttattataacacattgtttatttggtcttatttcattttatttctaatacgaaattaacttaaaatgacaagtatttgtaatctaaaattatgatatttaaaaccgtcaagaaaaatattaaagttcccatgtatgatgcaatccggaaaaaatagttttggtcatggtaaagaaatagaaagtatactcgtatgcataatttaaaaagttagattttgttgtgcagaaaactcatattcctggtatttgttccatatcgtttttaagttaatttcagattaaaaataaaaagaaacaggaccaactatataagaggtgctaaaatgcgagagtaattacattaatgaggggtgttttctatatgtctttactaactagagacattttctagatggtcaagttaatgagtggcatcagtcaaattttctcgacgtcggccgatattctttccacttgcattacctgccgaatttggtccgctatagatccaatcaactgactaacaatcaatcataagtaggtctttagatgcttattttagatcattgtttttgctctttgtaattatttaaactatattatataatctaatatgattatctaaactagattatataactgtgtaaataaacatatctaatacgattatttaaactagactatataatctatataaaataagctagattatatacttatgtgagaaaagagacatgtcttaaggccatgtttaatttctttagtcatctagctaaactttagtcactaaagtaccctattttgccaatggctaaacatgactaaaaatcattaattatatcatccctattcaatagggcacatgaaggaaggtgagagcagatatagtaaatattattttagtcacttttagttacctttcggtaactagaggactaaaattttggatgagactt

SEQ ID NO: 1313 - DNA, 2861 bp, Zea mays
  misc_feature (1)..(100): optimal_loci_313453_G1, chr9:98349349..98352209, Cluster 8
tattggactcattctgttgcagagaataccctaacatatgcttaaaaaacgccatcaactatggctacttaagttgaccaagcttgaaaaggttttgcagggaaaacaacgtaaaagaaggtgactgctgcaccttcagagtaatcaaaacaattgtcttggttgtcacagttgtgtccagctagtgtgaggctaggagtccgtcacaatatttttcttgccaagtctacttgtggtttgtgacaggtcaggtggtcagctcttggttagttattttcgtgtggatgttagtctctgttagtctaagaatatataactcgaaaatctgttagtctaaggaatactgggctactaagtttgaagcaccaatatacttatttataatgttggcagattacttggtgtacaatggtagatttttaatctcatttcttgccatgtccacattccgcacctgctaattctaagttggtcacttaccagttgtacatacatgctcaattctgtttaagaagcagaatgcacaataaaacccagatgttcagaggatcagagcacatgatacttgtgcttgttttgtagcagggaattgatgctccccgcagtttttttgctggttcaaaacaaaatggcttcaatacggaagtggttcttcatgacccaatgcaagctttgtcctctaaatttctcactaaggtgatggaattacactcttttcagaacagctcgcgactgttcaggtctgacaaaacctaccagttctgatagttacctcacagaacagctcaccttttcttttccttttattttttttccagattctttggtttacaccttgttgagatcagcataaatgttgtttagaaccaacagtcaagttgcagtcacttgccatatggcagtattaaattgaagattggagtaaagattgtgccaccgaggagctacctcaaccaggtgagaattaggttcttaagtcaggttcactgaacaatagaattcctatgatgtcaaaatctggaaggatacattattagcttcagggtgctgaaataatcactcaaaagcagaaaacaggaacgtttattaggtgaaaaggtttgttaaaaatcgtacttgataactaccagaacaactaggtcagtaaaacagcattaacaatggttaaccctcgagaaacctggtgtgctttttcagagaaaactggtacaccccaagtacagaaaagtcccttgcgccaactcctcttagctgtaccacacggtctgaagatggttctcctccatccaatgttgtctaaagtgacaactcaattctctatcaccttttatcctccaacaacagaaaacacaaaagaagtcgcagaggccgtttgaagcttagaagtttcacaaagtgtccatttgaatatggactatggagacatatattgccatattccacttgaagtgtgtgtgatatacacatctgcatgattttttttgcttttcagaactacttaaaaaacggattcaataattcataactgttctccacaaattggcttgatctgatcatgaattatacatggtatctgcatatataaattctagtatcttggtacagttgcatacatgaaatcttgtagatctcccacaatttgcacaattgaaagtgaagtatatgccttgggaatttttttactttctcagaacgacatctccaccatctcttgagaatattcaggttcacctgtcttgttcacaaaaatcagtggattgacagtcaaagacacggtaatttgtaattgcaccgcactggagaatgtaagtggtacaaagtgcccccgaggacagttgattcggcaccgttggtctaaagagatgatctttttgggatcattttccaacaagaggtccaatgaattgtcacaaatcattggctcgttcttatctaactggaggacatttgtcctgagaggatttgatacccctaaagttcttctgtcgagaagcttgatacccctaaagtgatgatggctagagggggaattcgaacgttaagggaaagaaaggatgagagctcacagacaaatccttgtgatccatctaagttggatcgaaccttttgccgggtaaagcttgcatcacatgttcttaagagcttggaagctggtgattcaggtgtaattaaattgcagtttaagcgaaattaattaaaatatgtcaagtctgatttgtattttgatggacttagatagcagtcgaacatatgcacgcagaatgaaataaattgcaggcaacacatcaaactacacgtcaaaaaacaaaacaaaacaaaatcgtgcccatcagaatccagaatctgattgccaacttgcattgtgaaggcatggaggacatgtcattgcagcgtgcacaagaggtgactaatgcaagattgattggtcatctaacgcgacatcgtgatcggtcgagaggagacccaggcccagggacatcgggacatggttaggttacattgctaggctggaacacggttctgggctacgagataccactatgcatgaaatggggacaagttcacgggacaaacgtgttcctgatcaaacttttgtcggagaaaataatagccttctccgagtttttataaattctccaattaatggtccattgtgcggctaagagttttaaacggccgagagctgagggggtatgtagctgtagaatatgttcacttggtcgaaaacactataccgtcgacaaccagaatgccacccgatccatttgtgggtgaaatttgctttccgttttgcagcacggatgtttcgggattactagggaaagaacagtcaatgaacatgcattttttttcaattttgc

SEQ ID NO: 1314 - DNA, 2590 bp, Zea mays
  misc_feature (1)..(100): optimal_loci_321807_G1, chr9:142446811..142449400, Cluster 8
ggtgaaaggtggatgcaggacaggaaagacgccgaagaggcggacggcgagacgggaactgaatggttgagcgcgtagtactggtagtagcatttcatattcggccagcctaggcacgtgggtttccatcccggggacgcggcccactaggcccaattgtgttgcggcaactcttatgttttcgttcgtgttcactggtggaagccacgcacgacaaatcgtcttggtctttcctcgcaggagagagagagagagatgggtgggaaagggagctcgccgacaggaagctccgacgaccatctctatgccttttttttttctagctacatatcttatcatactatctagtatatgctagatctagatatatatgacagttgctattgtatctagataaagctagaacgattatagttcgaaatagagagagtacatatgaatatatttttagaaaaaaaaaacatctacccaagtctaaaactgcacacaaccactttttacaagatttccaactagaatatcggataaagttgtgtgccatgcagagagacattctcctggcttgtcaagaagaaacaaatgatgggatgaaagagatttgatggatgagcacatgtattaaaaatttccttttcagatagggggactggagccaggtatcgcttccattttacaccctgcagattaccgttaaaacagattcctaacagtcctctcggttagcatccaatctgcttcaagctatagctaggttgcaacttgcaaccgttaggtggctcgtggctgctcccaaagcttgcaaataaacattcttcaggctagagcatcaaaaaaaaaatccattctcaagctaacaaagcgactgaagtgggaccatcatcacatcgctgcagcttgatctgagacataccatctcacaaggctgacttgtggtcccacgcacctcacagggctgattgcatccatgagtgcgggtaaagtgtcctacccacacccagccacaagatgtgggtcttttctgcaccaaagggaaagttgaagcggcgactttgttctttgccaaaaggaaacactacatgtgtctctttatttaggatctcccttcatcagcccgtcatctctttaactggttacctttgtggcatatatggggccctggctgtggctctgcctcggtggagttggccttggattccatagtctgaaaaccaaagcagtgacgcacggcaacaggttgtactattgttgaagatggttggtctgtggagagttggtttacgactgatctgacaattgacgcactccagtgctgatcctctcattccggttccatccagaggcaacctaacaagcccttaggatttaactgaagtggaaactcaacagctatgttggttcaggaagcagatgagcgagcttgcgcggttctaacctgctgcaagaaatggacctaatcaggttgtttagaaaggttcagaattagggtcataatatccacagcctgtactgtgtcctatataacctaccttcctgatcagtgttttggtgcgttaggctatcttttggtggatggactagctgggctatgttttggtgggtaataagagcctcatttgagaggcaattagttgtgtcaaagagccaaaaagggagggagggggagagagattgtataacttagccgattttgtcacacaaaaaagggaaggagtagaatgcataacagagactagactgttgaaaaggagaaaagggtggcgttttcacctgcctgattgaacacttcggctctttgcttttataattgatctggttttggtacgtgttccactgaatagtacaaatagactgacctcaacgtggctcgaaagcgaagataagatcgtttagatacaagatcctatctgcgaagctcgtacaaagatgtagctgaacgttgcttgtttgcgctatgatggaggaatatgataatggcgaacaattgcggtggtcaagatgcgctggtactagtaggtcgggttgctgtgacataaacacatctggatgctgatgaaaaacacatcgattgcaatgctctccatgatgttagtgactgctcactaaaccacctgtctcctcaccaaccaaggaatcatgatctcaaagacctattagagagggatgccgtgcaaaaaagtgtacattgtaggactgatctagaacatgtagtagctgctggctcctgcagcagcatagcaacttgcgaatttttcaagcgacaagaagggatacagcagcgcattatttgtggctatacatactataattaactatataaataaaattatatgttaaaaaagtcagaatgatttataatttagaaacatggaggttcacacggtggattggtataactttgtttggccgaattgaagatttggagccgtttgtggggcacaaggtggtatgtgttgctatgtcataagacaagaccctctagcggttgtacttatgtactagacctgatcatgggcaacccgatccgacctgatcaatgcgacaaacgggtacgaaccatagtttttgacccgcaacactccacgggccaggt

SEQ ID NO: 1315 - DNA, 2961 bp, Zea mays
  misc_feature (1)..(100): optimal_loci_322317_G1, chr9:145161477..145164437, Cluster 8
gataggtatttttgttacactaaccaaataattatttaccaggataacccaagaatctaaactatcccattattataatctacatcagcatagattgtcaaacacatcgtttcccattattatatgcataatctagaatataataactcggttatgatccaaacaaagcgtagattgtcaaacatatatcatttccctccaatttatatagtttagcaccaataagttgtactattatatatctaggtatactacataaacctagttatatataatgtttatgtagacaaagaagcacttttattatgcctctatatctctatatgtagtacacacagagaacacgtttgtagatagaagcctcctaggtcataaaactttatttgattataaaaaaacaacacagataaacttgacatataggcatcttattctcatgccaatttgttttttccttggacgaatcgacgtacgggagaaagccggccacgcgaaccaaagcaaagcttgaacaagggggaaagggtgtgggtgctgaaaggcggcaagatcgtataaacacgggaggcgtccaagtgaacctggaaaaagaccatccgattccgcgcttgcgatacactaacactactatctatcgacgtgccattttcaggaccaaaacagctgaatgccgcctggacagggatcaagattccatccgatccggtggctcgactagttgctcgaggatcccaaagcaacaacgccgaaccagcgtgacttgttgaagtatcagaattcagaacgcgcatcagcactgatcgagcaccagcagcatcggtcccgcgcgtatccgctggtgccgtcctcgtcgacgtcgaccctcgacctcgcaggaggcaaaagcacgggagcaagtgccccgccgcgcatatgtccgcggcatgtcatgcactcatgccctgctagtgcccggaatcggagatcccactagctagctagccccgtcccgcctccactccgctcgggcccacctctagctccccgcccttccttccccgtggcatccaccatcgatcgaggtcgttgcgttgcgttgcgttcgacgagatgcgtacgtgcggctgggaaggatatttccgacgccgacgacgcagttgcgttgccgttgcagttccagcgtgacacggctcgtgccggtgagcgcgcgcttcgttccccgagaactcggtgctcctgccgccgccgccggctatagctaggcggcgaggtctcgatcgccgataagttcgggggtggacgtggattccagcccagggagcggcgtactacttatacgtgcgtgcgtgctcgctcagtcgctcgcctgtgcatgcatgcagacgatccggaccctaatctttgaggacagtgagaggctgctttgagaggatatgcatgcatatatgcaagcatgcatcatcggaccggccggaacaatgtcgccgccagaataatgagccaacagtcgagttcgtgacgaatggcgccgtcagtagtgctcagcagcacccagtgggaataatgggatgacatcagtaccacagaggtggggtgggggggacaggttccaacttccaagggtcgtggaagcgaagtcacctccggatggagaaagaatccctagtactagtagtaggctagtagctcgtcgccggccgcctttagttagtttgcatcgtcagacgcagtgctggctgccaatgcttccaccggggggaaaacacacacagcatcagcttcgtcatgaaactttcatgacgattaccgcagagccaccagccttatgtttgtcgagtttctattggatttggatggatgcagagacatactaccggcgaagctactcaccaaaaccaaaacgtacgttgcacgacgacgatctcgctcggtgaaaaaaagatctcaaatgcatgcatgcatattgactatatattattcgtgctacatgtttttgagtcactcgttgtactcgtacagcagaacagcaaagccaataataactgaaaaaatacatctgcaattatatccttctggaccccttaacgaacatctcaccaaccgttcgaacctccatgtggcactcgtgctgggtcgctagctcatgtctgtatatatatagtgtatagttccgaaagcctcggttaattatcacgtgttgtgacgctcttcttgtagtttagcgtccgatccaaagaataatcatgatttgatgatataatttggttcgaacggttgaaggtttttctatagcagaagatcatgtagtagaaaataagctatgtttgctaagcatgcttttagcatgtggactactcgttcataattattagtcgtggcccgtgggggtcttaaagtggggggcgtttggggtacagcctcttcacggctcctagagctgttttaatttagcgcttcttgttctattttatatgcccagacgtcctctcgccgaccgcacctcgtgaaaagtcccggaaaatagcagtgactcaagttttttttttgcgctagtggagtggagccgaaaggcccgaaagaagtggagtttacctgctgagctgttgactagtcgagagttttaaagcacgattagcagaactagagatgaacacattgcaaattaatacccgataccccatttcggaaccaggagccaaaatacctaaatatatatccgaaatgcccagctacaatttcgaatagtaacgataataaaaatcaaaattatttcgggtagttcgagcatatagtttctttttctttctttctttctttctttctgataaagcgcgcgtaagctcctttgcccgtccaaacacgtgaccctcctgagcctgtgcacgtctcgtctcgtctcatctgatccgaaacgatacggttgggccgattggcaattccctttgttttttttttttggttccattgcttacgcacccactc

SEQ ID NO: 1316 - DNA, 1833 bp, Zea mays
  misc_feature (1)..(100): optimal_loci_32236_G1, chr1:197795350..197797182, Cluster 8
atcatcacaagtcacgcgaaacgcaagcgagcgcacgcacgtgtggcaacctccatagtattttatttatctcatgtgaagagtagagaacactcccacttataaagtagtcctctcctatctagatggatgatatgatactaaagtcgcgtgtctatctctacgcacgaccttgacttgcttattgaattaggccacacactagtggacctaattccaccacgcacatgattataaaaaaaatgacagatcactagatcagaacccagaaccgttcgccccaggcgaaacttcatccaggcaggcggcagtacctttatccgccccccatgtggaatgaaggaaggagatctgaaccctggacacaatgtcagagactcacatagtacatgggaaaagctgtcggttgtttcttgcgaaatcacccgggtgctccgctgtcccaacctttttttttgttttcggtgcttttacatcattggcaccaatgcgccatgtacgacctgactgaccctaacctccccagctgccgtgattttttttcttgtggaggcttggatggacggagaggctggccacgttgtgggctctgcctgttttgtttttttttcttctttctggttgatctatctatctgacccagtccaggctatggtatatggtattccgtatttggtaggtcaggtcaggaggaccattttggcaccgagcggtttggtgagcagaaacagaaaaaaagtgaccgcatcagctgctccctcactagtcccgtatgcggacacgcattagcaactggagtgcagtagtagtatgatactgtactggtggaagtcacgtgataacgcagcgctgtcacatgtggactggacggggttgcccgttccttgttgtctccatttagaagatggtgtatgagcaggtgcagagacggctctgtaaagccagccggttgagttgggagggagcatgggatgggattgatgcccttcctgccagccaggcgcaaggaaccgccacgctcgtcacgtgctgagcgaccaccaagcaacagatactatgcgggcccagagcggcagtgagccatcagtagtcaaagccaccaaccgataccgaaataaaaccaactggtgcacgatgatgacactagatttgctccgtggctatcacccaatccgtctttagatagagctggtgacgaattcaatcaagactgctttctctactcatgcgggccactctcgaatttagatattaattagagtgtcatcatggctttcgggttctcaccaggcgcgatcaggttcaggcccagcagttccctcccatcccaatgagccaccgacaccacccttcccccccctaacgttcaggagctgcacgggtcctttcgggttctacaacgaattgcttgactgaacagtggctacacacgacacgatgtggcagcagaaggttttcgccccggttgcttccgtgccttactgccttgccttggtcgtcagtacagtacaggatcatctatctcgtcgcgcccggtatttgggctttactggcatgattctggcgagttatggccatgacagcaaaggcccaggatctgttggatcggttagcccgcgttcgcttctgctgccgatccccactgcatactgcatcagggaccgctgccgtgacgtttcaacacaaagatcgtcgtcgacgccttccactcttcagctgttggcagccatgcaccgcgtcggacaactatttctgtgggttgctgaaatattcagtcaactagtcaagcagtttgtttcctcctaccgacctgctgtcagcaagccagccaaa

SEQ ID NO: 1317 - DNA, 1587 bp, Zea mays
  misc_feature (1)..(100): optimal_loci_323153_G1, chr9:149384148..149385734, Cluster 8
cgtactaatcaccgcaacagacatggttcgcctcaaagttcattgtacagcgtaactttgtcgcttgtatcgaacatttcgtttgccttttggccgatgcatgaaccttgagaaaacgcgttaattgtcagctagctctgtctttggttcattgcagaactctgagcttcatcagtaggcagtagcgctgcgtgcgctctgtaaaagcattggaagagatacgagtattaagcttcggagaaggccatgttcagctaacaaagccatttttcccccgttgggtaaacaacagccttgtttgtacaatgtacatatagagcactagcacaacacaaacaaagtcaagtgtatatctgagaagtcataaaaatactgaaacatatgtcaggcatagggcccaagctttaaatacgtgtaaatgaagatcatggtcctgataatgtataatttgtcacttgtcaactgcttatcctcctcaacctgttattaatccaagctggtttacgtcgctttacagatcagtatggtctatccacacaccttgttttttttttcccatcccgtggtcattttcatgctttattagtgcatcgtgtggtattgaccattcgtattttcttatgcatatcctgtgacggaggaggctggaggtagatagcacacccataatgccgaggggcactgtcaggtcaggtcaacccccataatatgtgtcgcgcgcaatgtcaacgcggaggtgctattaattagactagacgcacttgcgcagggttgcccactatgttgccacgccgcgcctgcctgccaaggtgatgatggcccatcgcgtacgtagctttgagttgacttcgttcgtctttcgttctgatctcacagagagaaggctggagacctggggaaaaaagagagaggagcgccatcatggtgtgctaagctaatggaaggattagttcaaagcttaaaaaaggaatgtgatccgttgaaaaagaagggtttggatgtccaacaatccaacccagggagttgggcgtgacgagaagattcacttggcaaagaaaggctggctaaccctcgctcgtatagggataatgtgtgtataatcgcgtaggctggtataggcttgatcgtgacagtacagtagtagcttggtaagctagcattgacctatgctatgcaagtgcaaaataagccgtctggggtttcatttgctttgttgaccgcgcttggaattggaacgcgggactgctgctgtgctggctatggatttgcagaggctgtgtggctggaagtgggtggagtgtgagccagagaacgctgatctgatcgaccacttccacttgctcggttgtcacctgccaaactccaaactcactatgcgcatccaatcggaacagctctaagccgttttactgtacctgaaactctgaagaaagggaacccgtgcatgaaccctgctgccttaggaaacccgtgcaagcctgcagaattggtacgctgaactaggcatgtgcctgcgttgcgtgccattctggttcttagcacaaccaaccacggtgcctccgcccgggcgagtggagtgggccggcg

SEQ ID NO: 1318 - DNA, 1592 bp, Zea mays
  misc_feature (1)..(100): optimal_loci_323848_G1, chr9:152262288..152263879, Cluster 8
actcctcggttaccgccgcttcgctagcccacatgcgcgcaggcctccatcgtccatggtggttgcccaagctaagctgccaagagacaggccgggcgtgggggccatgtgaagtgctcccctcgctcgctttgcagcttctgaaattctccgactatccacagggactcggacatcttagagcccatcatattcaagactagggctagaggacaaagctgtaaatcaactatgaactagaagctaccaccggtggataaacttagcttactatggacacagtgccgactctaggcctaggcggggtgggtaacctctagggcccaaacaccgagaggggggccaaaaaatgtttcctacaagtttttggataatcacgagccacagaagtgttacacaagttttgcagatttttttttctcatgatatcccatctaatgttggtatcaatgattttatcaatgaattttaagacttgctagtaactttatcggatgttttgatgtcagtaactgatattcttcagttcattatagttactgagattcttcagttcattatagttgtaaattattatccaaatatcggtattgtatataggattttatcgaccatttctatgatcacaggctcagctgaaagaagtttctcagagttaaaaatattaaaaatatatttaagattaacttatcacaagaaaaattaaatagcttagctatatgttctatcaagaaatatacattaaaaaatattgatctgaacattgtccttacattttttgtttaaaaatgctcgacggagttatttattttaatatatatatatataatctaaaattgtaatttagattactctaaattttattctcacttaagatattcaaaagaatttactgttatttactattatataaatgaacaaaaaaataaattacgtagatgtataaaaaaacagaaggaattttcttttattgccaaacgcacaaaagtattgcgagctggaagctcgcagaagaatccaacagaccaataagtgttttaccaaaatcctttgatcctccatcaaatcaaaatttcagatgagagggagccatgctgcatggtactttaggacagcacaataatgtaagccggtgactgtgaaacaagagcgcgctcgacgatgatgatcatgcggtacaaattaattacagattgctgcggctcgtgttcaatccgctggatggttatcattgctggctggcaaacgctgaaacgcccgcgtccccgtccccctggcttcttgggccgcggcgggcgcgaacacacacgagtccattcgctcggcagcccagacacccgtcgacccggtgtctgaaactcgcctagatcagctcgggatggtttggactgtttcttaaatgggccgcgccagaaaatcaatcacagaacaaattggagatgggtcgattggttactaaatttgtttctgccgtttgacagttgacacaaatgtttgttgaaaatacgtacaacaatcctattgtcaaaagctgcatgtgaagatgactatcaatatgagacaggaatgaccgattgcatgaaagcaatttt

SEQ ID NO: 1319 - DNA, 1614 bp, Zea mays
  misc_feature (1)..(100): optimal_loci_325492_G1, chr10:5390203..5391816, Cluster 8
aaccacctaattaatgcaattataaaaaacacaatcttttgaaaatgtagaccactaattggagatgtgaaaatgaagcccataaggaccccaagcattgtttgattaagagcataggtggaaatgaagcccatatatatagggattcttttgaaacactgaggttgcttttttttcctcagggattactgctgaccagtatcgtgtaagtttctcaactactgtcagccccaaaaacaaattcagaacaagaaacgaggatgaatataaatcatcctctttagcgatgatatcgtgtagtttatgtcggtctgagttagtattctcttgttcatcgtgtgtaatattacatcatgtgttcatgcaagataatatactttttatttcgtcgtcgcgagacatttccaccgatcaatacaccaaatcagacaccggcggctttgaatgagtgaccatgcattaaaattaaatgcgcgcaagaaagggatcagagcaggccgggcgagcaaggtcgacccgcccggcatgaacttcgccgtcggcggcgccggcgtcgtggaggggacgcacgaggcgtccaaactcggcactcaggtcgacaagttcaggagtctgcttgcttgtctggcacggcgtcatctccaaagaccgcgtggatgtcgaccaccatagactgcatggctcgagcaatacgcaccatatatgcacgagattagcatgcagtaccgggcctatctagcaccatttccacgagattagcagggcatcaacacagttaatcgtcgtaatctgcgatgctgcatgtcgaccaccaaacaaacaaacaacctagctggttttacgtcgtcgtgcactcggtgcgcgtggtggccgacacaacaagcagcaagggacgacacgcgttgccgttgccgttgccgccatggcatggccacgcggaccgccggagcagggaagaaagaaaactaaacgcgtgcgcaccgcacgaccacaaaagcacatcacgcgccccgcctggtgcatgcacgctctgcatggcggcgcctcctgcggaaaaaaattgtctgcagtctgctgtaaattcagcgcgctgcagtccgcccctagatggatgccatgtgtgcactcatagccatcaacgatggagaaacaaagtagccaaaactaagacgatcgcctcctagaggttcggctccggctacaagcagctgctgccacacgatgtagtcaccgtcgctgcgtcgcagcattttttctccagccagacccaatctcgcctacatagccgtctctttttttctctagccagactcaatctcccgcaggagggagttgttgtgtcgccgccgccatgctcctccaccactacgatgtgtttgtaaactcatggaatccaaagttagaataagccttgaacacatatggttttcagtctttcagatatctgtttagtctgtcagttctcgatattgttcagttcagtttagtgttttagctcctgatagtcttgtggaaaggagtcggctgtctgtcattgtgtaaagaccaagagcacataatatccaatagtatattatttgaggtgcacctaatgctgtaaaaaattgtattcca

SEQ ID NO: 1320 - DNA, 1890 bp, Zea mays
  misc_feature (1)..(100): optimal_loci_325727_G1, chr10:6541331..6543220, Cluster 8
tgaagtttgttacttttattttacctcagctggtacttcaatctccactgacccaacatgcggtatttgttgttcctcttcttcacgatcccaagaaggagcatttaatctaacatcaggaagtgatcgtgaggtctaataataaaccctaagacttcaatgtataatcgatcaacaggaccttgatcagggagcaacaacatggatcgatgaccaagacatgaatggtcacgatgaagcgaggagcagccacagaagttacctgaggatcgacggtgacggcgacagaacagctgccatgccgcctttcccgtccgtgacgaagctgtccaggaagccctatggagtccgtccaggagccgattccgggaaccggacgggagccgagccgtgcgcagcagaagtgcatcgcgagcgcgcgcggtgcgatcgtccgatcccggacggacgtcgatgtgcgggggtgcgcacgccgctctctgtgcgcaccgcgcgcacaggatttttttcggcccaggttgggtcgtggcctcgtggggagggggagtaggcgactagttcgaccaccgcggtccacggcgacgaagcgaccgacacggcggctgcgcggtggggtccggagcggtatctcccgtcagcctcgcggcggtctgttctgctcgctacgtcgagttcgcttcacggcatctggtggatgattcggtggggcccggccacatatcgagaggagagagaggtgggggtagcgtgtggtgtgggtgcgcgggcaggttgctttacacttctgcgaatgaaagaggggggcaaaagagccaaagagggcaggatacccgtgtagtgttgcccacaaacacaaaaaaaaaaactccaccgaagcttcatctatcggcagctggaaactgaagcggtggcccgccatgtgcccggcgcgtctctgtccgttttaccggttcgtcggcgcgccgcgagaggcgcgtgacccacgtcacgcagtgggagtggaaacggtacgctacagagcagagacgacctggctgggtgcaaaatgggtggagctgcgaaggcaatgtatgaactttgaataactgtttttttttcgctacataaataattatgctattttacggacagagaaaactggctgatggtatctggaatatgatattctaagaaactagtttctagtttttcttaatacatagtgactaccctaatagagtattaaaagtaatgcgaccatctgtgccaagtagtagatcggcatggtggaaacaagtaaaataatggaacgcaagctaagcttagagtggacacaaagtcactcctatatatatataatcatatcgtagcatagctatacaatagtagccgagaggtcgatgaacgatgatgccggcttcttttgggcataggaaacgtgcggagaacggctcatcatccaaggccgggcgcgccggggcgggtcgtcatcatcggttgtgtttgattcccggagcacgccagagccgggagaagcttcgggggtagacgtgccatgcccatgaggacctttgggagtttgggcaattgggtcctgcgacactccagtccagcgtcgacaatttgctttgctgtaccgtttggactcgggccttgtacgagtgcttcgtgcggattctccgttcccggtccaaccgatccatcgacctgggcacctgtcgtttccgttttgggttctgcgagtgcgaggacacctcgaccgatcggtttgacgatttctgctagcgcccaacaattaagtcgtgctttctggtcagagtctctaggctagttttcctggcatgagtttccagatgcatggtttctgatctctaggctctctgtgtatgtgtcgcgtgcaattttcagatt

SEQ ID NO: 1321 - DNA, 1777 bp, Zea mays
  misc_feature (1)..(100): optimal_loci_337002_G1, chr10:77190041..77191817, Cluster 8
gcaggacggttggcagcgagaggcgcgcggccgatgggggctggcggtgcacggagcaaacggcgcgagggggaggggcgtgtggaacagggacgccgcaccccgtccccgaccgttgagggaacgggggcgggaggacaggacagctgagctgcctgcaaggcatggttggtggggcccatcgtcggctcggttgccgtgcactgcacgctaggcaacgtcctcgtcgtcgtcgccggtggcatggcatactgtcccaagacgacggacggtccagagagacgcctcaagacgtcgtccagagatgcgtgcgtggctctacctactactactactgacatgtcagggccggtccgtcgtgtattattgtaaggtgtacacgtacggtacagtgcatgtcagggccgtacgtagaaaacgtatccagtccgctgcttgctggtggcatttggtgtgcagtgcatgcatgcatgcatgcattgatgcatgtacgtacacgtacgctcgcctcgcctcgctcgctgctgcactgacggtctactgcccgtccgtcgtcgaccatcgcatcaatgcagcagcaagcatcatcgttgtatcattcttgctctgcaccgccgccccaccggcgcagaaaagccgcatgcacgctgcactccgatcctaagtgtcaaggcggcaacaacaaggacgaggatcagatcgagcacgcacatcagcttgccatcatatccggaagcgtgcagaagatgcagatcgtgttcggcaggctaggccttctggttccttccactcaaagtgaccaggctgctgtgtactactgtgccacagtgtcacacacacctttggagtttctgaagaagtcacgctgccttttctgcgtaaactgcatatgcaggccctaattaagggtacgctactttaggtttaggaacaagggtttctttttttctcgtcacacgaaacctcatgatcaatgctgcacgactgcacgccacgacgtatgtttggttacaagtatgtttttttttgggggcggccgggggtagctgagcgttgactgtatatagaatgctattttatctttaccttttctaagtacgtaattgactgacagaggtcaaataaattgaaacgtacatataacagcaggggagaacagtatataaaatacgatatgttggcccttttttttctctctctcttgtatttattaatcacaagtcaactggcgcgcgcttgtttttgatgttatacgttttcatcaagctaaatcaaatggttttatttgtatacaaaatatggcaacatgttctaccaccctaatgagtttatagatggttacatgacatagtagtacatagatatcatatagcatatccagaataaggtttgcttctgtaatgacacataatatttagagacaaaatgaagaacatgcttcgtctgttgaatgttgtgttcaaaagtattccggcctacacccaatataacagtaggatattccaatcgtagagcgaagttttggtttatttgaagttctagctgcatcgtttacctagctgtgttgcggacaacatctactcttgttgatttttgggatcagttctagttgcatcgtttaccttgttgtgttgcatacaacgtctactcttgttgattcttgggattgtgtttaattctggatgaatgtgggatgaaagtttagttgtatactatagcaaatgtactaatggaggtagtactataagctgagatgagaactatgatcctttttgtt

SEQ ID NO: 1322 - DNA, 1981 bp, Zea mays
  misc_feature (1)..(100): optimal_loci_338340_G1, chr10:84025720..84027700, Cluster 8
accccctcactggtttggaacccaaccgctgtaggttagagatgaagggatcttgaataaaattcctaatgattcacatgggatatatgtcttacccaagggtccatctgagaaagggtaggagaaggataaaatatccaaagaagagagggataatgctgaaaatcgacggaatccccttctccatctccaaaacctaaccctccgtaccgtttgttgctccacaaaattgctgggcacttctagggtaagtcacaacacaccttcgctaacatggtgcgctcaacccttctccggtgattctagtcgagatgcaacatcttggtgcgggacgccagggtagagcctgaagctctagtcgaggttatcaggagaatgtgtagagaagaatcgaggaagatggccctaacaaggtgaagatcgatgagtctctgaaactagtgagaaagtggaagtatggaaaacccctcaacaagatccctttctacttgggaacaacaacaacgaaagattgagaccgaagaggaaaaatgtggaaagggaagtgcatttgaagggagaagaccataatatttgcaagttaagaaagagctatcctgtaaccctaattttaataaagttgattatgctttctgccacttgaagaatcatttgacccatgattgtcatcttcgttatccttgtggaacttgtggttttgataatcatgtggtgtttgattgcaaatgatccattccctataattttgggcctgagttatgtgcggttcaagcggaacatcagagttttttctttattgaagagaatattggcaacaaaatgactagggagaaatctagcactattgctatatctatggtgcaagggatggttgatgaaaaatagattgagtgagagtttatgaatcttctgaagaaaaacgtttggagatggtttgccacatctatagggtataataagtttcttatgagattccctggtccaataataataatcaatgacttggactattttagacccgtaagaatgaggactgtaaaagctcaaataactattgatccttggtcttctacgatcagtgctaacgatagtctctagagaggatggttcaggataagggggatccttgttgagcaaaggtctataaaaactataactaaagttgcagatctagtggggaaagttatggaaatagatgaaaaactagactccacaatgactttgttagggccaggacagcctgtagggatattaatgttgtccctagggtggtcaaaagtgctctgggtcttttcatctatgatttcttttttcaaagacaaacacaaagggaggaaaatgaggagaatttgggtgctactgtgaaagtggatgataatcctcataactttgctaaaaaagcaagagttgaagggcagatatggaagaaactttggggaaaagtgggatctcagtcttctggatccatgaaacataactctggcaaggaggaggagcagagttataaaaagaatattgtgtaggtctcatctgataagaaaagtgtaagtgcgatggagaaagggaaaggaattgtggaggagcattattattctgaggggatgtagttcagccaaaatttggaatgcaatgaaagggctcaaatcactgatagtgaagatgatgaggaaagtgacttgttaggtgataatctgctcaagtttggcgctagtgctggtggatccattccctaggcgaggtgtaatacacagaatgcaagtagggatggagccattaaaaatatgttacttcaaaaaaatgggggtaaaagttctgttgccattgaggaattaacaaactctgatcctaaagataacaacaacaagaatgaacctatcattggtagtcaagaaaacgggttggttaattcatctcaaggtattgataaatatgggatgaactttattgtcaggactgataaagctgaatatgtgaaggttca

SEQ ID NO: 1323 - DNA, 1868 bp, Zea mays
  misc_feature (1)..(100): optimal_loci_344235_G1, chr10:116611996..116613863, Cluster 8
attaccaaatttaatggttattattcctttctattttagttccatacaggccatttgcataacatctatttcagcgtgaaaacaataagttatcaaacaacttccacaaatgccaaaagacttcacttttcatatgatggacaaccatgggcatgatagcatttttgtgcaaccaagacttccctaccaagtcaaaccactgattaatctagttctcccacctgccgaccgccacatcaatcagccacactaacgatcacgctattgatcaccatcagctcttatctaatggagcatttcggtgcacaacctttatcattagcctacaatcacattaatgctacattagctttccttttacagaatttaatttgaaatgaaacactacattatattgaaataaaaaaattatccaagtacatcattatgcaaataaaaattacataattcataaaaacataaaaataaataaaattatatattttacaaaaaaatattggtacaatactactaatctcagttatctttatcttccacctctttcacatcttctttctcttctaattttaaatgcttagtcaactttttaatgtcaacctgtggaccctttttatgttactgtttatatcgatggtggattaatccaacaacttattgaattgctcaaagaattttgattgagtcatcctctagctagccttataaagcttgttcaacttaatctctctaagacaagggactcgttcctagcccttttcttatacattgagctctttccctatcaggttcaatagggcatggtggaccgacactctctaatgatatgtagttataatcgtcatccaatttaagataggatatcttactcccattgttggagtcgccatcaccatgccgcgtgcaccactttgactgataatgaagagtgcgccacatgtgctctagcttgaagtcggtttcatcaagcttattgaggaagctcttcttggtcgtcgaggagcatagcgccatttgctcgctcagtcaagccacatacaagtggttgtatatgtcatcaaagagggtgaccttgcggttgcttatgaacaattgatccttcatttgcttggaggacggtggtgagaagcttccatagtggagttgtgtatactggctatttggtcctagaaggttgatctcttcttgccattggccgcaatgtgatccaggaagtgtagtagccatgcatggacctataaactataaactcaaaaaattcttgtcaacttaaaaaattatgttgagttcatatgtgtgtgtgcacgtgtgcgtgtgtgtacttaccaatcttttgttctccatctttgtccaatgcccttgttgttagaattgggtaccaccggattaagcgaactggtttgaagctatttcattgtggctgcttaggggcactatcatacttgtaggaggatgaaatgtggctacttgaggtgttatcatacccgcaagagagcgaaatgaaagatgaacaccaaatggagaagagcaccaaactaaagagcaaacaaaggagcaccatatggatgacaatacgaatatggagggtatggataagcgaaaggttgagaagaagcaatggtgataggagtttcaatattaggagcgtcagtagtaagatttttattagtaggaggaggagcatccatggacgatcagcacggatagagatgagaatatggttataaaaagatattatagactcgaaacaaggacaaatagaaacatacttttgctgatgatggacgagaaaaagactcgtccttgcattagacatgttcaaacgtcaggtcagatcgggtttggatcaggtttgggtcaggtcatgggtt

SEQ ID NO: 1324 - DNA, 1576 bp, Zea mays
  misc_feature (1)..(100): optimal_loci_34728_G1, chr1:211255425..211257000, Cluster 8
aaatggtaaaaaggttaaaattatgcacaaatggaacttcgaaccatggttgttggctccaaacctacaatcacacacacatctggccaacaaaacatgcatgtctttgttataaatggaaaccatagcaacttagatacacgacgaataatgatctaatgaactattgatagtcatcataattttaatttataaactcgaaatatatgacttatatggaacaacacatttttttcttaatttaagtatgtgaaacctaattttaagcacacagtattaaatatctatttatacaccattatttattatatatatatatatatgttaaaatttaaaatttaagtatagttaaaatttaagtatatatatgttaaaatttaagtatagttatcgtatgcacctgctgtctacggggagagagacaccagttcgctactctatttttttcacaatctcagctccggcaactgagccaaacccaaccctagaccgacgaaatcgtgttttacgtacggctacaccatgttcggccgggtccgtggagatacgggcaagggacaacggtctcctccgcgccgccgccgacgcacgcgtcgcgcctgtcggactcgaacccgccggcagcgtgaaaataagctacatgcccacgcacgcacgcacgcgcgcgccgcgccgcgccgcggccggccagccgcccgaagcgatcgtcccccgtctgcatgcatgcatgcatggaaggcaatccatgcaacacgcgagggagagagggatcatggcacgccgccgcccaagtacgcgcgcgctggccctgcctcgcaccacgtcgaacattggcgccctcacgtcgaacacacagcatgattccatggccgggcggccgggccggccatgattccccgcctttttttcccccgtctggagccggcagcgcccgtgccgcagccctcaggcttgcccgaaaaagaggtgggcggcaatgagtgtgcgaccggggagtgggcgaggacgagacgcgagcttgccaactgccatggcgagcgagcctgtgagcgggcgcactgggcagcagcaggcacaggcagcacccgcgggccgcggcagagagcagcagcagcagaagagcaggtgcccgtcactcggcagtcgggcagtctggcctcgtcggctcggctgccctgccccgtgccagtgtggcagtgcgcctgcctgccttggacctcttcttttcgccatatcacggctcactcagtgtcctactcctactcgtcgtctccttttatgttttgttccctttttctaatttatttaaaaaaattgtcttttctgtctatccgccccccaagctttggcatcctttgctttcactcgcttcctttttcactttcctctctctcctctttccctcaatctccttttttttctctccctcgtcgtctttcgttggctttggcaggaggagccaagaaagcgaccttcacgtacatcgtgtgctgaaacagaggaggaggcgttgtggcctctgatcaacggagtgcgttcccatggccgaggaggagccagacccgcatcgcctatt

SEQ ID NO: 1325 - DNA, 4006 bp, Zea mays
  misc_feature (1)..(100): optimal_loci_349363_G1, chr10:145013139..145017144, Cluster 8
aacggtcacgagataattgtgcgatggccgtcggaggatgttcttttcagggacaacacatgcaaccatgcaattttgttcagactgttgtacatgagcgacgacttggacaaaaaggtacatctcaaccagtatgaaaaagaattatgatatgctcatgggcctccacccaagttgacataagaagcatatgaaagggccgagaagaattagaaatagagcaaaagcccatgtagtttgtaaaacttggccagacagtgacagcttcaactcgctagacggcctcatagcgagacctggagtcctggaccaggaattctttaggttttattcaaccaaattaacattttcttggcccgtttattaatgaactaaattgggatagaaagttgaaatgcagatcttcatgtggttgctccttcaactgcagtcttcacagcagacaaattgcttggcagggaatggatggaaaattggcaatcatggcatgcatactcaacttcaacatgaacccggttctcctttgattatgaactggctgttggtatagcggatttggcatgcagtggcagcttttggtcaggtatagactctgttgagccttgagatgcttcacaaaatagttgaggaaggaactgtgaacaacgtggactggatcagagagtagctcccataacatgtgcagatgctgttttcgtatacttgggagcaagatttatgttgaaaaaaaaacttcgaaaatgtttagatgccttgccttgaagggagttttgtgctaagccgtgagagctcgatcagtcattgtatcgttgctttcatgagaatcaagatttatgtgtgcagatgctgttttcgaataactcaaatccaggcaatcatatcatgcatgaaattgatgtcaactcgttcaattcatataaatgcatggaccctatatatgcatattcttattaatgcttgtatcaacaacttatccaccaaactgtcgacagcctcgccagaacggcagcgtcttgttcctgctgcctttttgtctggccacgggtacgtaggcacggcctgctcccggtacgctagctatacgggtcgctcatggcccccatgtctgcaggcgcgcgtaccggccggcagctaccatgcatactgtctccctccctgccccggccccaacgacgacgacttgcctgagatcgagacgggtcctgcacgtccatgtaccatgtacgcacgcaggtgatcgagctagctgcagctagcgtatcgccgaagaaccaccgttgcacctgtgtggggcaaaacaaaacaaaaaatccactggccatcggccgcgcggcggggccgggccggcgtggctggaggcgtccatgcggtccgtatcggccgggaccggagcatgcgtcgaccggccgggagagcatcgcagtaatggcgccgtgccgacggcctgggacatgctgtcgtctgtcgacgacactcccgggccgcgccccacgggaccacgaccacggcgcctgggtgcgtgcgcgcatgcagtgcagggcgcccgcgcctccgatccgctggatggcgcccgcggcctcgcgttaacgacgttgtccctggaggcctgaacagggcggcgcgcgacagcacccaacgggcgatgggccatggccaacgaccccagcgcgcgcgcgcagcgcaaccgtcggtacagcgagtcggcgtcagcgcgcggcgccgtggaaaacgaatgacgctgtgcgccgccgggctccacgcacggaaaaaaggtcgtcgatcggccggctcgcgctcgccgcctgatgagatatgtgttcacacgagccctcgtcttcttgtcacgtcgcagtcggatctgcgtgaatggtgacctaggcgcgtctatctctctcacggccgccaaggtgcacgacatgaaagcatcgacgatagattgatctccatctccgccgtggtggttacaatacactcgcggtggcttaactgattgcgcacgcatgtcggaccgtcgaatctatcggccgtccgtcgacggagcaagccagccggggcgccgcgatcgaaagcggcgcagctaggtaaccggcagcaaggctcatacgtctacttgcatgcctggcctggtgatcagaaacggcggcgacgacgacggtgatctgatccctccatgacctcgcacctatcgatccatcgggatcatgcatccgggcgtcgatcgccgtggtggcttcctggctgcgtacgtcacatcgtgctcgtgacagcagcagcttatggctccctatgccggcgacagtgcggtggcagcgggcaacaaggcccggccggtcacgcatctatcgtcggtcgatgaacagcctcggttgatctgatggacatggcgagtgatggagacgacgacgtgttgtacgtgcgtgccggcggtctgccggccgggctaaccgctgcattaacccacggccggtcggctctgcttttttgcattgttggagtaccgtcttgtggcaagtttttgtttgtccacgcacgcttctccttacaaagtgatgcatcgtgcttgttcacgaaagcttttcgaattatcagcgtagttgtgcattttattgtgagcacacggcgtttcctataaactaaattaatgatgtgtttggtttgagtaataattctatctaaatatgagatggtgtagtataagtttattcttcaaattttgtgggacgactcaattctttatattcatgttaataataactagtaatgatatggtgatggatcaacttattacattgtacaaacaaaaaaaagtgagaattatgcctcaaaccaaacacactatataaatccttgtagatttaaaatccaaaaaaaatcttgtatgctggagcctggtgaaccctcctttatttaccctctacaagtttggtaaaaaaaaaccttgtgatccttttgtttctcctattatgatgttcatattgcttcgcataaaatcaaaatccctgaacgtagaaacgctcgtgtggccgcgggtggtgcagtgcacgtactagctaggcaggctcaggctgtcccacgagccgatcttgtatccgtgtcaggcgtcgaatcgatccggcgcgcatcaaaaaacgcgagcgcgggcttcgtggccgggcgacccgcaccaccgccgcttcgtacacgtgtaccggggccgcgcgtaagcgcgcggcgggtgtgcccgggctttgaacagcatctggtcaaaggcgccgccgggatggatgatgacggtcgatggctgctggctggtgaatcggatcgatctcccacctggccacctggacttgtcagcgagagcagtggcacaccagacaagcacacctcctgatgacctgatccacagacagagacacgggaggaagagcctgcccgacccgagagctttcagctttgaatcgatgagcctacgatccgcctatacctgcacatggtacggtgtccaagttccgacgtgcccaaactccgacgcccacctcggccaggacagagcccaaggccactaatgtacagtggagtacctcccagttacctgggcctccaccttttatctactccactccccttccaacatctgcacgagcacggcatccacaccggttctcctcctcctcctcctcctcctcctcctccttttttaccacacacgcatccacatccacacctctgtccttattacctgtcgctacgtgcctgtaaaatctctttcttaaactaaaaaataactaggtttataaataacatctttagataattataaaactagataaagactaaaagacgacctgaatttattaaacctaattaattacataattcatagttgatattcaaatatttgatgagacacaaactaataacactccgaaacttacatgcactgctgggagacaaggggacaggattcttgttcgctacaaaaagtcacggtacgggccggtacagttcagggccggagaatcatatt

SEQ ID NO: 1326 - DNA, 1911 bp, Zea mays
  misc_feature (1)..(100): optimal_loci_36927_G1, chr1:222982816..222984726, Cluster 8
gctgttccagcttcgcattactccagcgcagatgtcctttttttttatcggcgcggtcgcattactcctaccatccgaattcatatcaaatctctcactgccaccgccgttgacatgtgaattgtcgtattctaatctaacgcgagattccaacgccgccgaccgccttatccgaggaccggattagcacgagaacccccatagtttccggcaccacacacctcacagcacagcaaagccacagaggtgcggtcacggtcgtgcgtgtcaacgacacggacccggcatgtccgtgccgtgccgtgaaacggaagcgattattggctaccttctcttgtcccagtcctggacttttggggaacccgtggccatgcatgatgtgcagttaagacaaaagggcctccgcgcgaagctcagacccccatcatgatccccagcacaaaaatggttccaccctgcggtccggtcactagcccgacagtgtgattggggttcttgttgtcctgagccttggctcgcaaaatcgtcgtcatcgtgttcccccgccccggccgaaaacacaagggcacgccgacgacagaggacgtaccagggcgagccggcgaggcatcaaacccatctcgcgcccaccgtgccgtgactttgccatggtcaggactagagctctgatctccgaaacaaggccaatagccaacagggggggggggggggggggggtcatcaaagtagagctataggagcctaggctaggagcagtatagggctctgtactactgcgagcttttcctcctgctcccgtcgtcagttggtcgtcgcagctttcttcaggatcagggcccctggctctgcctgcctttgccgtccatgtcacgccattgccatgcatgcaggagcatgcagcatggcggagccccagacccagagcctgtgagatggatgatgatgccaggttaatgattgcgctgcagagcaacaacgaaaaataaagtgtacgctgcgcctcctggcctgacgtgatggcaggggcggacctacgttgatgcgagtgggggcacaggccccgctcatttctctgttgtaagtagtagtgtctagatttttactatgaggtcccttgttcagactaatttagagacactttctttagtattttagcgctcatctttgtaagtatgtccttagtcccattatttcctgggtccgcgcctgcgtgatgggacaggtgcgtcacggatatcaatatcatatcggcgacttccctggcgcagagctcagccggaacgggaacggaaccgtctcggctgggctgggccgggcctgtccttcgacatgggtgggtctcggtctacacgcagtcgcgctggtacggtggcgacagctgtgagatcgagcaggacaccccgtgcactgccactgcaccgacggacgacctgtggactgtgtgggcaacgatccaacgacgcaataagagaagcgcatgcatggcgatgtggaggaggcaggcatggacagagagatatgcagcatggccagcgactagatagcactgaccatccggccggtgtacgtaccacgcgtgtgtgccgtgaccacgtcgtgcatggaccgtccgtcgcctagtgtcgtatggggcgcacagagtcgccggcgtcagctagcccgtcactccgctcgccatatgtcatcacctggattgggtacacactagacaacgagtgttctgtgccctgccatccggacgggatctcgcgtttgtcgccatctcctgtctcgtcacctcgcgggtatttgggcgagccattcaagtgcgttcacatattttcagcgaaacactccaagatcccgccgggttatgctaacactcggccttttgagatgtagatggcgtattcgaattcgattatttaagga

SEQ ID NO: 1327 - DNA, 1528 bp, Zea mays
  misc_feature (1)..(100): optimal_loci_43693_G1, chr1:257183639..257185166, Cluster 8
ttatgtttaggcactgatcatgctacccctacattaaacagagttgtttagttaggggtggaataaccgggacaaggtagcttttagttttcctggtcattctgctacaagttgttatgtcgaaacgctgaaaattctggtttaaccaatgagacttgagatcctggctggcagccaattttcctggtcggccgtcagctgtagttggcagctaccatggctgcctccctgtgtcctctcctggctgggcagctagatgtagctgacctcggctgtcttgacgactgctccatggctgggggatgggcagcacgatggaaacggttctgaaccttggaatctgatgaagtcaggtgaaacttgattaaaatggctaatgacattgctgtttcaaaatagctgctgtgggacagttgttttttggagttgttcttttgtccaagttttatggatgctcttggagttgctcttaatttgacccaaaacagacgcaagttggccatatctttcccaacaccaccctctttgctttcagttagttatctcatccttatcgatttgaatagatatttacctgctgagactgagagtttactcttactgagtttgtcgtgtaatcgatcttgatttcttttcttggttgaattttttctctgcctatttattaatgggaggctggtcaaattcaaggagctgtggtttccagattcagtggccatggcgttcttccagtcgctcccagatcaatctagggctctaatagccgcagcccgagtaaacaatgggcttctggttacgcaccctcacacatcaatttgattgctgcagctttatgctgtaggctgtagccattttttctcttcaatcaatgtagccagttcgctgcagcttattccgaaacggcttctgctacagtattttgtctctgaattacagctgcagcagtctgaacagctgtcttaaagccgcagcgaacaggctagttgaggcctggtgatgagatctccctctgctgctattgctgcatggctgtgatgacaaaaaggttatttggttgattatgattacttaatgccatataaggatcaaaacgtgatgaccttatttgtgcgtgtctgagccgatgcaatgcagagtccatgtttactatttttcctgctgacattatcaccttcgatttttattcctgctgattactttttggcagtgatggtttctagtctgatccttgtgttcctgacactttttgtctactaagggttttgcactattgtttatttattctggtcatgggatggtaattaattcagggtacaaatatccttttatctatagctgacactttgacaggataatatccggatggcctgggacagaaacatatgtatgacctggctgggatgacaaaaacatacgttgtcgattggatttctttgtagtgtcttcgtatggcctggctgggatgacagaaacatacgtttctcgatcctgatacttgattttttttcaaggaccaaactttgatgac

SEQ ID NO: 1328 - DNA, 1802 bp, Zea mays
  misc_feature (1)..(100): optimal_loci_44531_G1, chr1:261612949..261614750, Cluster 8
acttagagccaccgacatgagttcccttctccttcccactagagcctcgctttaatttggaatgacgcacagtttacccagattcctgctgcataaatcgaactaattaagttctaatctccttcctacgaaacataattccttttccctgtcgaataatcagagtcccttcccttatcgaatagtctgcaaagcaagtggatcccaggagcttctgcagatgataaagcccgacatccacatgggcaactctctctgagtctaaaatccctccccaataaataaagcgaaatattccctcaaattctctggacgaccagcatacagctcattgtatgcattgcgcgtatgcagctgcgacagaggccgcaacaactcagctttctttacgcgatccgattgctacttcccaaagagaagccgagagagtaaacactcaccagcctggcagtgcttaattcagctgagtgatgcaccaatcagtggccacccaatgctattatatatagatgatcacagatctatcaacaccaccaaacccaatccctttccagcacactgcaaaacaccaaaaggaccgaaagcaatggcatgcgttgcaggaacaccaaacctgcgtgattcagagtcagaaaggcaattgtatgagtccatgggcattggcattgacagggcaaagatacctacacagtttcacgagaaaacatgcaccgtcgcgcgctggccactggacacgacaacaacaacttgcctatattggcataggcagagtgataatgttggttaagataacgagtgctatacgcatgaaaacttctttcataaataaaggcctacatctacatatagagacatgaataatgaagcagcacgatctgaagcatctaggtcccctactattttttaataagaatgaactgtagctgtgacgacatgccaaagcctagtagatattttatttacgtacctgaatatgattggcccatcactgctctcggtttgtacttgtgcacatgtgagatccaagttgaaaacgcacgatcatttcaacagggaaaactacacttgagtaggaggcagggaactgtacaagtttagctctgaaacaagtagctgatgttccagtggcagctaatcaccaaacaagcataatttggaaataagggctgtcactatcacaggaaaaaatgacgagggatttatgcacaatgacattagaatcactaacaaaaagcattaggagaaatggaagctgacaaattttgtcttaccaccttgtataggatcttgcttgcgtgtactaagtctggtcagctcaagaattaagaactattacagatgcaactacaatcactacatatattctttctagaagtcaagttttgaaaggctacatcgtcctatagaattcagcccacaatgactaaatagttgaggcaaatataaactttcttttctttctcttaaatttaactgaacaaaaaaaagatcaggaacaaacaagaaatacaaacagggtgtttggtttgacagaagaactcatgtggcatccgctgaacctaccagcatagaatgggttggtccagcacttttttacggagtgtctttgtacttcaagtccttttacgattaactctccttgaaagcacctgatgggtggtgcagttccaagctgaaaaccaaacagcgttgtcagctttggttctaggatcagatcattccaggtgacctcgtgccgcaaaccaaacatgctgaaactattaccacttttccttgtgtctttcctcatatttcaccaataa

SEQ ID NO: 1329 - DNA, 1758 bp, Zea mays
  misc_feature (1)..(100): optimal_loci_45202_G1, chr1:265436426..265438183, Cluster 8
taggattaccgtgaccgtccgtgattgggaaaaaaaatcgagaaataaactacaccgccaattatatacgttagcgctaacactgttttgaagcccggtaagcgctgcatgcatgcacgcgtgcgcgtggtgagggagcatcgcacagagagctccacgcgtgagccactgctagctgtacgcgcggacacgtcaaatcgcaagcgcagctcgacatgcatgcttgatgctggagtattatatagtacaagcgcagagctagcatgcgttgctgggtgcacgccacggcggtgctagtagactagtagtatagtatcgatacggcccagtgttcccgtgatcgtgtaagcactgaaagcagtgtcgaacaacactggtaccgtagccgactagccggcagcggcacgacaatataaggctactgtgtgctgtacaggaaaatagtctctgactgccgtgccctcaggagcctgtttagtgataaccactgctcacgacgcattgctccagtccagtccatgtccgtacgcgcgcgccagagaccagacccgaggtggtccagtgaccagtgcgcccatgcatgcatgcatgcgcacgtactgtctgtcacaggcatcgtctcacgtacggtatgccgtattgccctcgcgcctcgctgtagtagcgtgcatgcgtgccgccgttctcttcggcaacagcgttcgttcccgcgcgcgagtgacaacgaaccgaggctcgtccgtccgtcacgtctgaaaagccgcaccaccacacgtccacaccaatcaccatacacttcgtccttccaacgtacagaaccagcccggccggccggcccgcatacgtcaacaagaactcatcaccgatcggacgggcacgggaagaccgcgtcaaaatccaccaccaactcgtcccggcccctgggacggcagaaacggacgcatcgtcgtgctcaccgcagggaatccgcgcgagcttcccccttccctacatccggaggcgcaaaaggcagggcctagtgcttccccatccccagttttttttttcgtcttctttaatttacagcaggaagccaggaactcaacccaagagggaaaaaaaatcaatccccggagaccggagcccggagcaggtgaagaaatcctagaatctccagcacgtctgccccggtctccattgaccataaccatatgaagaagaaaaaaattgcttttccaggcatggcctgggatttgccgagatctccccttcccggcgtgcccaggcacagccacgccagataggcgggccccaccgctagtagtatagcgtcgccccctccttcgtacgtgtacgatcctacctacggcgtatcgacgaacctcgctctgccacgcaaaacaaacaaagcaaaattggatgccaaatgcagcgaatcgtctgtttgctcgaactgacaccgccgcgcccgcgaagaacagtcaataaaaccgggggaaaaatgttgtcacctgacctaataaaaggtactacaagttctgcattgtcaaggcgtagtaggcataaagggtcccccacagagatgtggtcagacggcgtgcgtagaacgtatcgggtaggagacgacaatacgggtcgagccgtacggaaagtgttgggcacgccgcacgcactactaccccatctgtgtcgtggacgataacctggttgctgcgcggggttagagaataatcagcttggtaggttggttttaatctgtactggcttctactatactga

SEQ ID NO: 1330 - DNA, 2129 bp, Zea mays
  misc_feature (1)..(100): optimal_loci_47943_G1, chr1:280212766..280214894, Cluster 8
cagagcgcaggccttttgttttgcttcagaaccctgcccagcatcgtcgtcaaaatgtgggcagataggttctcccggattctcgtttcatatggttggaggccggcgctagaaataaattcttgacgacaaattgtattccagtgcggcatctctttctggttggtgatcagcttctggatcaagttttatactagcatgagaatgtagcgtggtatctatctaggataatgaagaagggaatttgcagctggtggctacagtaccacagtagcatgtttacaattacagcacaccatacttatggattcggtgagtctaagaactctgtaatatatataggacacgtagactatttacgtacaaacaacatactattcatattattcctattttctagagcataacggcggcgtgtaaaaatgttaaattttgtttttttctctctctctctctctctctccctcaagaggattaggaggagatgattctacatcgtctcttctaaaatagttatccttcttgctctttctgaggattcaactatttttaagttaaccaaatatgtacatgcaaatatcattatttatattatataattagtataactatatagttgttttttgaatttttttgtaataaatttatttaaagatacgtacgttgttatttttatttgtaaatatagttaaattaaaaggctttaatcattataaacactatggtgataactattttagaacgaaggaagtttttgatagagaagccgtgtggtgtacaagaatcgtaaaatgaatgattgacaccgtcgtagcaggctatcctgattggaaccattagagctagtagttagctaattaataaattattagctgagttgagccaactaatgaaataattgttagttgttatataggtagctaacaattagctattagctgatgttgtttggaacccaacaactaggggcgaagctagggggttttgttggggttaactgaaccctataaaatttgaaaaatactatacaaatatattgttatttagtgtatttaaatgatgatcagtgaaaccgaccctaatgactttgttgtttggcttgttccctgccaacaactaatttttagtagctaactattagttttaaaggttctacatatggtatacgaacgaacactttttacactctacccattcactttttacacaactcggacaagacagaccggaaccggttggagatagcaacaagccactgtccacattctacgtttggataagagaaggcaggtacaatggattcttgtgtctgtttccatcatctctcgacagagtcatactagaacccgacctggaattccacgcacctacataagatgttgctctccttcctctggctatttttattcttcacgaattctgatggagggggttcgtttctggccctgaaatgatggcctgaggtttgagattcccgacccgttctccaaacagtgaaggccagtggataaaggatagagtccggtccgtcctgtgctgtcacggtccaggtgggaaatgcgtgggagtggaaaacaaacaagaaaagcaagccgcaaattcgcccgtccctcccgcggatagatggacgacgcagaaactagccaaaagccaaccgtacgtgaaccatcaggcaggcatcagtgtatagattccagctgcccgccgcatgctagaagaaatgtgcggtgggcacgtacgtaaaacgtgtcgcgcggcgactcggcgggcgggcggagaccgtacgctaccagatgcggcgcgccgatcccgcgcgcgcgacgcgagcgaggggaacgaccgcgtgctatgcttccactttggttgggtgatgtgagccgcgtcaccgcgcacgtccgagcgccccgacagcgtcgcgcgtgggcgcgggcagcggacggcccccgttgttccgctgcccaggccccagagcccagaggagagtactagtactactactcgtacctccctgcccaatccatatccactacagatgcgtgcacttgcgcccctctcgccgataaagggaaaatcactggcggccgtcgcgttcggttggccagttgcgcacgcggcattagaggtggata

SEQ ID NO: 1331 - DNA, 1458 bp, Zea mays
  misc_feature (1)..(100): optimal_loci_49881_G1, chr1:289843608..289845065, Cluster 8
tgtaataagatatgtgtcatcattttttagtgttgttctggcagtatttaatagtgtatgttggttagtcagcgtatggtggctattcggtaatttaggaatttgtgtgaagaaaacaaaacaaaatgattctttgggcaaaacactaaaaatagtaaacctaaagtcgttgttatcactccagagcatattttcatttttataaatatagtatgagagaaattttatgtaggaaagaagcataataactcttcagtgaagcataataactcctacagcccatacgagtggtgaagattaaattctgcacaaagaacgacgcaatgaatgccttcattaccaccttgcccagctgatcgtattatcgttccctgtagatgcttcaggacctaggatttggtatggggagaagaagaaaatcaccttgagggcctatccgtatgcggtggaagggagtaggcaaatgaagggaaatgggatggagaagaagttgttcaacatattctgctctggttatctcacctccgcctctgcgcatcccactccatggctaactgctccccacttcgtcgttgcggcagcgccatcttccaccggtaccttttctccttccccaccacttttctccttccccaccacgcaacactgggacaaagcgcgcaggggagcagggacactgacgaaccaaagtcgctgctcccgacggcgatggtgccatgacttagcggacgtcggtgggctttgctccggcgccgggagaaggacgacgcggagggagcgagtaggaagaaattagatgaggcagaagggtaaagaaacaaggggagacgtcgtatcaaacggaagtatccagagacacgggaagcatccggagacggagggaaggtatccagagacacgaggaagtaccctgagaccgaggaaaatagatcaagcgatgattgacgatcggacggcgtgtgtttttttgacgacgtgtaatatatagaatatagaatagagtcggatgcaaaggttgccttccggccggtccatgtaagacaaaaaaaatctacaccctccgatatgatttttacggctccggccacctccaccaccacatctctcacattctgtcacgccgtctctctcatctctgcctgtccagctccgcgcttcctctcatctcgccaccatgtcagtgccacaacatgcaacacgctccaattccggctcaccaccaccggcagccttggcgcctgagtgggcccggtcccgtctgccgctggggccttgctcttccttggcttgagcagcaggacacagaaattgtggccagccggatcagcgatatcggcggcagggcttcggcttcggcctcggcctccgccgccgacgcgtccacagccaccgcgttagctgccccagggggccaggcgccaacggaccaatatacaccagcatcatatcttgatgtta

SEQ ID NO: 1332 - DNA, 2073 bp, Zea mays
  misc_feature (1)..(100): optimal_loci_51803_G1, chr1:301157898..301159970, Cluster 8
accacattttcgctatatcttcaaagagttccatctgaagaatttctcgttcatttgcttgtagagattatgttgagatgaattatcctcaataattaagcacgttactgttagcttcaaatagggtcttggtaaaaaattcaggcaatcttcagaaacaggaattgccttttcagtgtttgaatgatcagacatattaaagcagggggacatggatgtatatccacttgcagttaaagctgaaacaacattatctgttgatcacccaccagatgtagatgaccaaaagatgaaaactcctaactcacatatcacccaggcggccagaccgtgtttgaaatgaaagaaaatggggattatcaagtaagagttgtttgccagatcctttgggtcaatggaactaggtatgaacagcaagaaatatatggcataggaaactccatggaaggtaatgctgatgcaaattatccagggaaagaatgtgttatttgccactcggaaccaagggagatactattatcctcccatgtaggtatatggtaagtctgttggtcgtctattcaagaattgcattttttttgtaaaaactagcgatctacttcggtataagttttcattatttaattgtattctaaattaaaaacatagttatcttttgataataatatttgcttgccagatcctcaattgtatgatccacagtattccatattaggaatattggtccagaaaaattagtagttccgtacttatgtctaagcatcttccattttctcgtaactgatttaatgttgcattagcatatgtaagcttctagcatcgcatggctttgccgacctctgttgtatctgcctatctagaggtcagagaccaagatgccaaggagagtgtgtatatacacatcattcatgcatgtgccatggctacctgaagaagcgtggtgaggaggattcctcaagccaggttgacttcttttttgggaaaaggatctagatcactaagatatgacaacttgtttgattcttatccatcaaaccttgcatctattgcacgactccattcaaaaagggtgctgaaactgaaggaagttgtgctaacaagctactgcagaaatgaggttacaaataactgttagcatgttgaaatcactttaatattcatctaattttcagttgtctttcccgataatgtgcggaacaacagaaaatatctcacaacctttcttgtgatatgcagatcaagtccacataactaactttggatacattcagaattctacagtgtttggaatgggagcccactgggtcttatcagattgctgctaaagaacttacagaaaatggcgctgtaagtgatcagagtggaccctctggtctgattggtattcaactatcaacagaaatatctgatggaagtcttccttcaaatccttaaaaggcaatcatatatcatcctacagtcgctcatcttttagcggtatgtgtctacccagattgtttctttgccttttaaagtccatcttttgcgtaatattggcaggcaaataaaattttcgtaggattgcatatttccttgtaagaatttcttttttccccaacttatttttttgggaaaaaggatttagatcactaagatatgacaacttgtttgattcttatccatcaaaccttgcatctattacacgactccattcaaaaagggtgctgaaactgaaggaagttgtgctaacaagctaccgcagaaatgaggttacaaataactgttagcctgttgaaatcactttaatattcatctaattttcagttgtctttcacgataatgtgcggaacagcagaaaatatctcacagcctttcttgtgatatgcagatcgagttcacagaactaactttggatacattcataattctacagtgtttggaatgggagcccactgggtcttatcagattgctgctaaagaacttacagaaaatggcgctgtaagtgatcagagtggaccctctggtctcattgatattcagctatcaacagaaatatccgatggaagtcttccttcaaatccttaaaaggcaat

SEQ ID NO: 1333 - DNA, 1469 bp, Zea mays
  misc_feature (1)..(100): optimal_loci_51949_G1, chr2:751005..752473, Cluster 8
cgcaacaagtgcgctctgcactactcggctcagtgtcctttttcatatatatatatgccactgttctgctggtctatcgtcgaaagcctagctgggctgtgggcgggaaactacaagttgtctggaattgaaagaaagaaagcggggtaaattatgatgatgatggcgtacgcgatctcctcaaatcattgcgattttacacaacaacatacatattacatatagctaggaaagggaatagattcattagaaacaccatgatgatgatggcgggaaggaccagcgacaagaaatgggcccagaccaccgcggggcccgacctcacatgacgcttgtcgaccgcgggaagcagcatctccgtggtgggccctccgtgtccccttcggcccgggatggcccacgtgcacgtcgaaagcgtgagagcgagaggaggacgcctacctaagcgagcaatgcaacagccatcatcgtcattcaccttgcctatccatcatcctcgtcttcttctgtctatccatggcgatttggcgttataaccacccccacccccacccttctctggctacgtcctcgctttcccttcctcccagctgcctgcccccccttccctaccctagctacgcacgctaccagctgccccccatccatgccgtccaggaagctggtggaggactccaaagggatcgcattgatctattctcacctgccgcctgctgcatgcgatgcgagtcgacgacaagatcagtgcaatccctttggaattttccactcgcgccttcacccccgccgcacgtgccacacgcccctccatcttccatggattccatctctcatcaggtatctctctctctatctgctcttgcaagctacttccatggatttgatttttgttaagttcgcctacttgctctccacgtacgtactggctacatcgtttctgcgcaccacacacccaccaggccatgaggaatcaatttgctcatgggagcatgatgatgcagacaagtacaaacatagtatataataaaaatagctgccgattcattctttcctttcgctcatcgttttcgtagttaattcattcattggcatggttaagtatgtgtaaatacttacatgtagatatatcagggtaaaggtccagacaggacccatttaagaggattgaatatgcctgcagcggtcggccgccccaactgcacctgcacgcgcatcagtgtatttcgatcaactctctctgtcctttctgctttctccaaattaatacacttattcctcagacgacactgtcgctcactagtcaaagcagtatctagtttttaccactttagagtgaaagatacatatatttttaaaatactctgtttagcattacattacattgtaatattcagttttgattgtgaattggagatgacagcattaagaagacaaattgatgatgagattactgttcgccaattcatgat

SEQ ID NO: 1334 - DNA, 1671 bp, Zea mays
  misc_feature (1)..(100): optimal_loci_52480_G1, chr2:3871160..3872830, Cluster 8
tctaagcatgtatatgtagatatagagattaggtatatatatcgatacaaatatgagcgcacatatataaatattacccatcacgagaaaaggaatatatgtcgaggagaattgtgatatagatatacatatagtacgtggctgctgtacgtgtgatctggacaaacgtttaatttggacagaaacaggcactgcacaatatagtcattgcgggtttgcatgccccgacagctccaagaacatgatccatgcaggcatgggccatatatggacaccgggtcattagcggttgggcagtagttcatgtcatctgttaattaagcatcattattggcaccggacaaatcgtgtaagcgttcggttacgagtgcattatcacataaccactccctctagctcggatttattagcaagagctagcaaaggcaggtaacagaagggacgcgcgcgaaaagttgcaggcctctcgatcggccacagagacatacgtgttccttgcataccttaacgccgcatccgactgcatgcatgcgtgcatgctttctctcccggtccgccgtgttcgccgatcgtgtgtgtgatgtgcacgcgagtgattagcacgccctaccagtcggatcggattctcctttcgcccggccgtcgtcgtcgtcgtcgtcgtcgtcgtcgcacctctctcccgtcccgtccggcgtcccgtgtgtgcgtgcatgaggccgacggcactggtttagacgttggaccaaacgaaaataataatgcgtcgtttaggcagcaggctataggtaagcatgcactagcagcagcagcagctatcactcccagctgctacagctagcgcgagcgtatagcaacgacgaccctagctaagctagtagccagtaactgacctctccctgatcgtgatgcgtaaatggaagaagaagaaaaaaacgagaagattatcttatctatatatatatgcacgtcgtccgcatactctgattactgatacggtgcccgcgcaagactttttagaatttattttgtcacgggtcagcgtcgaatcgactggaactaacgggcacttaattattagcttgcgcggatcatattcatccatccttttcccgctcgccggccggctcgccgtcgccactggagaaggagcggtcggggttcgtgactacgagcggcggcgcggcgccgtgccttcttggatcaccattcaccaccaggattgttattagctactactattattattattcatgccagtatgaccgatcatcttttatgtgcaggtacaagtaggccaccaaacaaatatgcagctctgcgctctgaccaagtcaaatttcatttgactaagtttaataaaacagtatccatgcttacatctttgataagtagtatggcgtagggagaaaaatatatttcatggccagtttagcgatacctatcgatatatataatagtaacccttagattttttataggtttaattcaatgtaaacctttttcatttcaaggaaactgaaaaggcatatactaacgtactagcggtatcaattcgtgttggggcggagcggctagccggctagagagaaagagagagagagaaaatgcaccaccggcaggcatgctgccgttgcgcgtggaatgaagcctcggcgggcaaggcaatcaatc

SEQ ID NO: 1335 - DNA, 2479 bp, Zea mays
  misc_feature (1)..(100): optimal_loci_52877_G1, chr2:6009430..6011908, Cluster 8
  modified_base (1011)..(1011): a, c, g, or t
  misc_feature (1011)..(1110): n is a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
  modified_base (1107)..(1107): a, c, g, or t
  modified_base (1108)..(1108): a, c, g, or t
  modified_base (1109)..(1109): a, c, g, or t
  modified_base (1110)..(1110): a, c, g, or t
ggatggatacatgaaatgtttgatccaataatcaggttgttttctttgtaccgggcctggaagaggagtacattcatagcttgaatttgcactcgatgctttgaggagtacattcgaagttgctgagtttgaagcaggtatagtataaaggagttgccttgcaagaagtttggtatcaaggtctatgaaggagttgtaccgtttgagttaggatttggttactactgcgactgcgactattcttatggagatctttgacaaaggagacccatgaacgtgtactgtactttgcagagttacgctgacaaatccaaaagctcagtgaacgagcgtcaccactttgcaatgaaccgtgcatgcatgggcaaaacttgccacgagatggtactccaacaatgcaacaagcagaagcagagccggccgccgtggggtcaatacagcggttagcccgtcgattcggggaacgcagctgatgctgtatccagccggtacgcacgtacaatacgtcgtcgtgtacgtcttcatcaaccgccatgtccatcagatcaaccaaagctgctcaccgccgatggatagatccgtgaccggccggaccttattgcccgctgccactgccgtgtcgcaggcgtagggagccacaagctgctgctgtcacgaacacgatgtgacgcaaactagctaggaagccaccgcggcgatcgacgcccgggatgatctcgatggatcgatagacgaaagataggtgcgaggtcttggagatcaagatcatccgtcggcgtcgtctatgcgacgggggcgcggccaagcaagcaatcggccttatgggtcctgctggcgggtacctacctaactaccgtacggcgcgccacgatacatacgcactgactaatcggagtccactgacgatatgctagtaacaaccaaagaacatatataaaagcaaccggtccggctcgtcccgggtcccggaagaacttttgtgctgccggcccgtgtcggtaaacaacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcgcgcgcccaggaaagcaatcggccatatgggtcctgctggcggttacctacctactagccgtacggcgcggcacgatacttacgcagctgtcgatcgcggcgccctggcggcttgctctgtcgacgcacggcacggtcaatttaaagcaacctgtccggcgtgggccgtgtcccggacgagcatcgtgcgcgccgcgccgtgtcggggacgacgacgtcgcacgcatatatgcgcgcaccttggccatgcgtcggaggatccgattcgagcatggcatggcatgagatccgacggtccaacacgcgtgcaatcagtcaccgtaagtgtaaccacaccacggagattgatcgatcgagcggattgctccacagtctattcatcgtcgatcctttcatgtcgtgcatcttggcggccgggggagagctaggcactctcagtcttaggtggcgagccggccggtcgacgacgacctttccgtgcgtggccgcacgcaacagtgacaccagcatgcgcgttcgttgtccacggcgccgcgcgctgacgccgactcgctggtaccgccccctaccgacgggtcgctgcgctggccatggcccgtcgcccattggggcatgggcgtgggcgtggccgtggcgctgtcgccccgcgagcacgccgccctgtaaggggacaacgtcgttagcgcacgtccgcgcgagcgccatccagcggatcggaggaggcgcccgtcgcggccccgcggggcatggcgtgtcgtcgagatgtcccaggccgtcggcacggcgccattactgcgttgctctcccgatccaggcatgctccggcggtcccggccgatacggacggctccagccacgccgcccggccccgcgcggccgacggccagcggatccgacgcgctggctgcagctaggtcgatcacgtacgcgcgtgcgtacacggtacaataagatgtacgtgcaggacctgtctggccgtctcgatctcaggcaagtcgtcgttgggccagggaggaagacagtgcggcagctgccggtacgcgcgcctgcagacatggggctggggggggggggggggggcatgatatgaacgccccgtagcgtacagggagcaggtcgtgcctacgtgcccgtcgccgaacaaggcagcaggaacagcacgctgccgttctggtgaggctgtcgacagtttggtgcatacgttgatacaagcattgagcggcgcagcggaatgcatggaccaacaaatgtacgactggagagtggagacacatggtcgatcgtctggttgccatcaagattatgcatgtcactgtcacatacagattcattacgctcctactatctgaacgatttgacaacga

SEQ ID NO: 1336 - DNA, 1965 bp, Zea mays
  misc_feature (1)..(100): optimal_loci_53126_G1, chr2:7194923..7196887, Cluster 8
ctgtgttactagtaaataattaagaattgtcagtatgtcatattatcatttagtaattaaaatatcaaaactaactttgataagtgctaatatgctagttagtgtataatttgtatgctaattaaaataattatgatattatgtattttctttattgttataacaaaagtagagttagtgtataattataaatatataattagatgttatttataaataaaattaatcaattatcttcgcccctataagtagaccttgtgatttgtgcatgttgttaaattggctaaaaattagggcacaaataatctctaatttaccaattttggcgtaggtttgttcctcttttctacttctcgcctaactatagatctaatagactgttactcaagcctaatacgacatgaaccatacgcagcacaacgcttacacataacattactagattaaggaggacgaagctataaataaaagagttagagtctttttcaacccatatatttcttaaccttttggctatgataaagtgtaatatttgtttatggaccatatattcactttaatattaaatttgtttttataggtatcaaatatgattgtgtgttgtcacagcacacgagcattgtactagtttttttgcactcctttaaaatacaagttttgggtgtcagacatcatataaaacgtgcaggtatgttcttctcctccgcttctcgcataacaaggaatctaataggttgttataccataaataggctatgagcataaaccaagtagccaacacaacaggaagtcacacacagataaatgggccatgagcaactactaaaacccaacataatagcaagccacacgtaatacgtcgcttccacatattatcatctaactagttaaaggaggacgagtgatcgaactttttttcaagtcatatatttctcagcctaatcattttttttattaagataaaatgtaatgtttgtttttatcaatttaatatctgatatgtaaaccatatattcactttaatattaaatttatatttatgaatattaaatatgattgggcgtggtcgcaggctcgcaacgcactagcattgtaatggttttggtatacatacgagtttatggtatatgcaaccaatgggaagcgccaatactgtccgatatgtaatatataacgctgtccagtgacaccaggagctttatttgcacaaattggagattctagcatcgtctatcatggagtcaccaaccaacagatttctcaatcttcccgccatgattttccccgtgctcttgctttttctcagaggctcggccgctggcatcgcatctgacacgctcagcagcgatggcaacatcaccgacggcgagattttggtctcatccggcagctcattcaccctgggcttcttctccccgaccggcgtgtcagcaaagaggtaccttggcatctggttcaccgcgtccccggatgccgtctgttgggtcgccaaccgtgacgcccccattagcaacacctcaggagtaggagtactggcagtcggcagcaccgggagccttcgccttctcgacggctccggccagaccgtgtggtcttccaacacgacgagttccgctcctgccgtggcgcagctacttgagtccggcaacctagtcgtgcgacagctgagcagcggcaacgtgctctggcagtcgttcgaccacccgtcgaacaccttgctcgccggcatgagactcggcaaggacccgaagactggcgcggagtggtcgctcacgtcgtggcgcgcgccgaacgacccgacgaccggggactgccggcgtgtgatggacacgaggggcctcccggactgcgtctcctggcaaggcaacaccaagaagtaccggacggggccctggaacgggctgtggttcagcggcgtcccggagatggcgtcctactcgactctgttctccaaccaggtcgtcg

SEQ ID NO: 1337 - DNA, 1576 bp, Zea mays
  misc_feature (1)..(100): optimal_loci_53430_G1, chr2:8957754..8959329, Cluster 8
gttgatgttttgtatgtttaacctgaaacctgtgtttgcacaaggttccgacagcatcttccatggttcagacaacaacttctgcatcaaatagttttgttcagatttaacatagatttattcaaactaaaaacttttttcaacacatattctgtgttgtcctaatatggcgccggtaagggcgcctcgagttctagtgtattgaaaggcctgtggaccgaagatagatagcaagcactgcaggaggttataactggtttcgtctctcgtagtagtaggtgcggtgcatgcattaacgagccctttaatgccacgtgtttatcatcgtttcctaaagttatctgcagctgtcagttgggcaggcatatgtaagcaaaaaaaaaaggtttctttgtcctgctgaaccctaggctggagacatgtatcgtgcagtgatgacaggtgacgagtcagcaaccacttggtgcctttcgactttagtgtagttgctttgggtggtgggatccatggacatgagcaatagcatcaccatattcatctgtgagaggttacagggccttgagttgagtgccgcttaaaactatgtcactctctacctgaaagcgtttgcatttggtagtagcctggtgcgcgctggaccacttgttcaaacggttagaggtcagctggttaggtctggtcggtatgttcgccttgctcgcatctgcgatcggacccctgacgaatgaactacggttctatgtagcctgttttcgctcggttgcttcttggtcacgatctttagcagctgccaagctttacgctcggggccatgcgtctcgtcggccggtgtagggtagtccgatccccgattcaggatccgatcgttggggggtccctggattttaaaactcggcacgcgtgcggcgtgcagttgcatttttgccgccgtggtcaggagcagtcagtagagcgtcactcacacgagctgtgtgtgtgacatgggccgggctgcgcgtggccgggatggggtcactgccgagcgtggtggtggtgactggcatcgtccgaggctccaggggcgtgttccgcgtgtacgtacgacagcgcgacgaggcacccggggactggggagagcgcacgagccccacccccacccgcatgcccgcaccaacccagcaggggattcgccgccggggaaacgctcgtacgcgcacgcagccgggtggcagcatcggccacgcgtttcgatgggggcgcaccgcgcatgcactatctccgagtgattccgatcctctctgttagctacggcgagactggcgagtcacgagaccagggttggttgccggcttgcattgccgcgatcgaggacgacgcgctcggcggtttcggggtagcattggttcggattccggtgcacggccctagctcgtatacgtacaatacgcgctccctgctgccttcaccgacgagacgagggtgccgacggtcgggtcggatgcggttgcgccgccgccgacagggttggaaaccatgggcccgatgagcacctctctacctctcttctttgtcgcagaaaaacagacctggcacctgg

SEQ ID NO: 1338 - DNA, 1824 bp, Zea mays
  misc_feature (1)..(100): optimal_loci_53446_G1, chr2:9082224..9084047, Cluster 8
aaatcggcctggagtgccactgatatacgtgcaatgtaaatacttgtgcagtatgttcagcactcgcccaggaaacgcagtcagacataaaaacggtaaaggaacaagacaaaaaacaaaacttctctttacatagtggtcaccgatcagtctatgtacacagactgacagacgcttatcaacagataaaatgacagcttcatccagctttgcactatcatgaataccggtacctaccagtactgaaaacacgagacacagagcacatcttgctgtcttgctgattcagccaccattgatgaccatagattgatcattctgagtgaaagcacagtatgccatggtaacttcacgtgtaaacgagagttgagttgttcacgcatagcaatttaagttcactacatcagcactatggtaggtcaaggcaatttcaggaggcactatacagaaactacatttctgaaggtgtctaaaaggtgtgtgtagagtgtgcttactagtagtttagccaccatgaccgaaatgttttcgagctcgtaccaagattacctaagctgagcatcatcccagatctgttggccaccctcgctgtcaagatcaacggcgaccacaaggcagcaagcatccagcactgcacatgggccaaagaatgagctctgtgtcaagtgtgagctacaaccatatagggatcagctaagcttatcataccttcctttttttttctcattcagccactactgcagcctacaaaggatatcataatgggccgacccagtcacccaggacgcaatatgttggtcaatcccaccagttagtaccacctcggtagctcagatgagtagaagataccttaaaagttcagctcaggcaacttgcagcacgaccttacttgaacaggatctgttctataggatcgtactgttgcatccttgattaataaggaggcaagtacttaaacctggttgatgagtaaatgacctgtgggccagagcgtgattaacggccaggattcagtctctgtgctttgtctggtgctgtagatgatcgttcctggtcaggagcccctggctaagggtggcccacaggttgtctgacaggtcttcaaatctttttgccctgcttcagttgaacaatggacacctcgacattttttttgccaccaataatgatggaatcatggaactgtgttgcgtttgaagggaattttgatgctgtgctgtgtttgaagaaacatttgagtaaaatatttcaactggcttttcttcaacgtttgcccaccgattaaaaggggagatctcttactcgtttttgccattagtaatacaattttttagctgtgatgtatttgaagagaatttaagtaggatattcctgtcaccagctgttctggctcaatgttgctctcaaactaaaaggggcaaatctcttgcccgttttggcattagtagagccagacttgtggtacaattttttagctgtgatgtatttgaagataatttaagtaggatattcctgtcaccagctgttctggctcactgttgctctcaaactaaaaggggcagatctcttgcccgttttggcattagtagagccagacttgtggtacaatttgccagcttcgagttgctgcctcatctctgactatgcgaatctgcaatatgcaacacattagtattgagccatcatgactctttatttctttccacttgatctgcaggaagttcagttgttttgatttccctttttctttttcggttgacaggtaaaactgtacgcttaaaaaacccgagtctatgcagctccggtgccttgtgattgtgagtt

SEQ ID NO: 1339 - DNA, 1452 bp, Zea mays
  misc_feature (1)..(100): optimal_loci_53548_G1, chr2:9493472..9494923, Cluster 8
gctctgcgtgtacctgcgcgtcgccgttttatacccggggccgggacgcggcctggcaggcaggcagggatgaccgggggaacacgtggcgccaaggtagggaacggctgctctcgtgtccggcgttgggggtatgacgcggcgcagcgcgggcgcccagcacgccgaatcggcgcctcacgggcgggaggtgggagcggatcatgggccgtctcatggctgggcgcggcggcgcatgtgcgtgcagggcgacgtgcgtggccgcgtatggtgcatgcgaaccccaaaaccgccggatagtccgggtcctggcacgtcacgcgcccgccttcagtgctgcgcgttcacgttcgcggccgctccggatgcggaacgatcgagcgaggcaaggcaaggcaaggcaatgcatggcggcggtcgggcggtgccggtgatgacctctgctgcatgctttagctgcaagaaatggatatcacattttgagcttagagctgtatgcaggtagccgaaggctggaacggaagactccatatgcgtattcaactcaactttgcatcatttattacacaagtacatattatgcaataaaaatcataaacacaactccgaccttagctcagttggtagagcggaggactgtagtgttcgtagataaatccttaggtcgctggttcgaatccggcaggtcggaattttttattttttgaatctcatcagatttttatcaggttcgtctgctttgaattctttttatttgttgcagattttttatcagatttctctgctttttaatttcttgcgctttttttttacctcatcagattcctcggctgctcagtcaggtttgaccagagtcaacagcagctagggattaaagttcaggcaattgcaattcagttttccaacaaacgccgccccacgttgacaggacctgtcaattaccatgtttgagtatcttttttctaaaaaaaaagaatctcatattttaggtcctgcttatatcatatagtaagttgctcctggctaattagaagaagtgggtaagattcagctgatagtagttcgttggaagggtctataaactacttgacgttgattaatgaactacttcattcctcataaaaaaacaaagtatctgagagttcatctgtcacaaactattttggattttaggtgagatactaactcagtttgaaaagaccacattcacatcatttatttattactgacccaaacatgataaagaaaagggggtggtgatggcatgcggcatttggtttatcgcaagatatatgccctagaattctagatacctcaaattctactgtctgcaatctgcatcctaaaaaaaccttgatgttttctgatttttaaaataggagcgatcaatcaaaactatccatccatatacgcttatttactgaaaggtgatcaacagtaattaagaaataa

SEQ ID NO: 1340 - DNA, 1669 bp, Zea mays
  misc_feature (1)..(100): optimal_loci_54146_G1, chr2:12796673..12798341, Cluster 8
cacaagagtttaggtgaagtaaaacaacagggccatcgtagtaacagcagccagcagagtgagggcctcccacaaggtcggggaatccaattccagcgttcccgagggacccaacaagaacaaggtcggccctttcgtttgggccggcaggaggcaaaggggcctgctctcttctattgggccagcacggtaactgggtgtcggtctcggctgggtaattgtggctcaccctgcttcttattttttttttctttcgttcattaaatttaggacaaggtaattgtgctcaccgaccgtaaaaggatgtcccgggaaaatgcctctgccaccccccaccccccctgcggcgggctcccacggcacagcacctgcgttaaacacgtcacagggcttaggcagcgaaaggcgcactgcaacaactctgcatctgtatctgcaaatgccatgcatgcaccacctctgaacatccaaatgtgccggtacagggggccgcgcgcggccggctccatccttggactaccattcaattccccggcgccggtgacgagcatcgagcggggcctgcctgactgcctggcgctctactagctcccagaacaggcaaatagtggcgcgcacgcgcgcgtggccgcgcgcggtacggtgacccgtcgccgtcgcccaccacggctcggtctcgttctcggtcgatctctctcctacacacagtgcgtggcgggcaggcccatcgggcgacgtcgtacgcccggccggacagggtgtgccccagcgcttgaatgcctaattattgggcgcatcacgacccaatctccagtcgtcgtggccgctgtgcggatcacacaggagctccgcgtacggccacgcacacaccggcgccgcgcgcggccggggtgcttgcgttgcgtcttgcgatgccgatgcctacgtgatcggcttgcgtttcgtgcggagacttttgccagcccgagcccgaccagcgatcgctcacgccgccggcagccgcgcgcgcgtgccacgcacgaactcgaccagcgccaccggccgacgacgtactgcctagctagctcgatctctgcgcagctggacgcctggcgcgagtggtgcgcgcgcgcgcgcggtaggagcggcgggcgaggccgcagcctggcttgcagcagtggaggagctatagatgacggttggttaacataaataaattactagtccgtacttatatattgtgcctgccaataaaacatcgcagcaccagcagcaacaacaaaaaaaaaaaccgtccacctcgatcggctgggattcattcgctctcttgcatctgcgccttctctaaaaaaaacctgctcgctagctcgttcatcacgctacatttgttttccccttttcacggaaaaaaaaataatgaagcggctaggcggccggccgagtagtgttcgttgatgcacagcagggatgcacgtacgtatatggtgtgtgtaaacatatataaatcatcattccgcatagagcgaagaggactattacacacgtctgacagacttaacagttatatggactgtgctgatacgatgcatctctgggtggccgtaagacacgtgcacgtggccatgctgctacaacagaggcactcaccgatcacaggcacgcatgcatttctcctcctcctcatttgacc

SEQ ID NO: 1341 - DNA, 1798 bp, Zea mays
  misc_feature (1)..(100): optimal_loci_54900_G1, chr2:16867142..16868939, Cluster 8
tttgtttacttagtgtgtatggcgtgatgctttctcgttagctagtagattttgatttgatgcttttgttcgtgctggtagtatataggatacagcaaatggtcgttgcccgcccgcctcccaaaattttcgctaaatatttctctactcaatctttgtcagaattacctgtaccttcaaatctggattaatcaagcatttttttagtgacgacacactccagggtagtggtaagtattgaataatacttgtccgtatactgctgctcttttgtcgatctggtgctagtggtcagttttctgtagatacataaacccactatttatttaaaagaggacagactccacatgagtaaagtctagcaaagggataaactcacaaagagaaacgcagcagctaagctgcagtgttttttttaaaaaaatatgtggattctgatttctggtagcgtatcggtcgttgattagattatgccgtcctgtctgctccatcaggtcgatggtggcaattatatgaagtccagtttgtaaatgctacgatgaagtagaagccttggagcagtgtttctggctacaggaggccctcgtatgggttgcatttcgttgcccacgggccttgacgccttgtctctagtactcggcagtgaccttcgcttaaagagaagtcaagtggggagtactcggcaggcagtggagttgcttttgtttcaggttttgctgctgttgcaagctcacagctttgcagaaccactgctcattggtcaagaaactggagaacctaaactgcagggtcgagaaagctccatgcgacaaaacaacaaatgcgtgccacagcccacattactgaaccgaaccacagctgcagggctctgaattcttagccaaacctactatgatgacaactgatggaagtttggtcaggttgggcatgtcattttttgctgtttgcacgacatgctttattatcataaaccggtctactaaaattcttgcgcagtcagcagggccggcaccacagtacttccaccgcgggctttggcttgctttgtctattcaaaggaatgagttggtaatcgatgcaggattaacgggaacaggaggggcgaggcatgattgctctctcccacccactatggccgtttgacagcgagacaggaccctgtgtcaaggtcagtacagaaccgtgccagttcttggcgcctagctaccttttcagtacccttcaatgtcaaagcccagaaagcttgtgtgcgttggggggtttgatcatggcctcctcgccgctgttgccccccgcagctttctctatagccactgtttccaccacgcataattgccagttcacaaagcatggcatgatgtcgaattgttgacgccgaagcggccgcagcaggatgtgtgctcgatggcttctgctccgtgcgccgtgcttctccccctctgcgacgctgcgactgcgagcaagcctactgccaaaagctcatcatggtaattatttgtacgtctcttgcggcagggattgacaatctccgcaacttttgttgggagattttctttttttttttgttcgccttttccaaatcccatcgttatgttattttatagtgcttcggtgagaatatgagatttcacatgcagtggcggaccaggtttcaagcctaaatgttgtgttgtttagatcacaggagctaaaacaaaaagatactgaagtttagtctctttagatctaaaaagatccaaacagtaagagctaaaagtgactaaaatgataaaaatatcaatttagtcatttttagctt

SEQ ID NO: 1342 - DNA, 3244 bp, Zea mays
  misc_feature (1)..(100): optimal_loci_55802_G1, chr2:21599108..21602351, Cluster 8
aaaatcattatgttaatttgtatattttccattataaaacttcaccgtccggcaggcctatgacttgtgccatcattattcttttttctagacgcgatggcatggacaaccaaataaaatcattataaaggtgagttgaagttgagagtgaatcgacttatatttactgtttataagtcaatctactctcaagtccaatgtaccttcacgttggtgtcggtactgcgatagctcgtttagtttacgaaatgtaacgtaaatgataatagtaacgattcacactcgaataacgacggtaacaaatttgaataaaatggtattcatttgtagtgtggtatcgattacgattagatttaaacaaacataatttaacgttatcgattacgcattacgttaccaatatgtgaaccaaatgacagctgaaatgtaccccactgaccgtcggtgaacacccgagaacgcccgcatccttcgcgacgaaacaaacacgctcgctcttgggcacgagagaacgtccctatcgcacacacccgcacgtattccatccacaagctaaacacacatcctttgcttctctaattttactttggccgctgccttccgtcgacgtcgtaagctcgtgtggccgctatactcacagtagacgaccaaagacgtgccgggcaacacctttggtagctagcgcaaaaaacattcggctcgtcccctcgtgcaagcaacggcgacacccatcgactttttcgtctcgttctttgccgcgtcgcgaatcacctttcagtttcactgtgcagggcgcaagacaaaaaggacaggaggaggaggaggagggcagccatgagaaagttctggactcctagctagcccatctggtccctgccgctgaacgggtggccaaaaggagtcctctcggacagtgtcaagataggaacgtgaaaactattttgccagctaggcaagagggcgagacggattctcgaggattcagcagattattattccgtagacgtatgagatgcatggccccacgtatatttggaagcgtttcgttaggggaaacggcgtttatttgtcgaataaggttctctggctttcttcagctgttcaaggcaacaatggtaaactgtgagagagaatattcataaatggcttaaaaaaaagcagacggagattacacatcaactttggctttggcctttcatgctctcacagtttactgtagctgcgagggactgcagccgcagttgaacaaaaataaaaataaatgactatgacattatttttaacaaataaaaaataagaaaacgtcgaactggtcagggtggtttcgctggtctgcgtctagtgtccggtgtggctggattgctctcttaaaatcgatatatgacaaatcatggtcagagatatcgacgttctttcatagaaacggttcttatgtgcgatccggattagtgcttgttgacacatactgtacatcataatttaaggcaacaatctcatcgtgatatgtactacgtactattttaattgccgtttccattgtagtcagtactcagtactggctgatagctcttttcaggcgtgtgacgaagtgaccagcttcagcgctcttaatctttggcaaaactcgtccataagtaggaatactaatgtctggcaacaggtctcggtcgtcataattggagagcataatactgtatgtgttcttattagtgcaccggatcacgtgctctgattggaacggcagcgattcgttctcaaggaaaagcagtgtggctaataagttcgtattttactagtagtagtattttgacagctacttgagaattattagcacaagtagcaccgcaacggcaccacaaaatcctgtcgctggttcatagcctgcgcagccaatgcgagcatgacagatctattgtgggggtggtgggggggcaagctttattataccctcatctccgctcgctcgatcagtgaccgccgattcaccaaatcaaaatctctttcgcccttgacggcgacctcagggaagacaaggggtgacatgagagaacactgaggcctcaagctacgggagagtgcggtgtgcttgggcgggcctgcgcgaccttcttctagaaacgccggaaagcggctgtgggcctactactgcccttcttgtgcggttaactgcccagacgccactggagtttgaggggtgggtgatgtggtgtggtggccaaaccaatgatgtgcagctgctttacggaccgttgcttgcttctcctgttccttgtgcgttctgtcctgactcctcctcagccatgtatggtgatatgcttgtcctgtttcggctgccgcgtgggcggttaccgctgtttggttcgccagtgtggtgtgctctggctggccatgggagagcttcaggaatctctcaggcgcagctgcagcgccgctttagaccacgaccaggaccagccgaaagcacgctcgccgccgtgacgagacgggataggacggggtgactagttgcgtcaaaggagcgcgaggctgcggccgccaccacgcgcagcgccccaccacaccacaccacaccacctcacctcggacgcgtcgaaccgtcgaccgcttgttcgcgccacgtccagaggtgtggccaaagttgtcacctcggccgtgagtgaccaggcggcaggcgcagacgaaggcgtcccgtcccgtaggccacctagactagaccgatctttttctgaactgtctagggaggaggacggccgcggtagtggcagctttagcgaaggacagtgcgcacgagctcggctggtaagcgtcaattctaacgtactgtacgcgcgacggcagcccaagatgtgcctgccgtggaggcccgagcggacactggaagtccttgtcctgccgacctagcatgtccggcgattgaccagaacattagcgtacccaaccgaggcgctgtcgagtgtgctaatgatctgctcaatcagtcaatcgccggacatctccaagagttagtggcaaacaacggtgcacagagagagacggtgttgttagtacatactactagtaccatataaactatagacaagactgtctatttgggccttccccttacgttcagtagactagtactgttaagacattttcgtaggcccagtcagtgcacaagcccaacaactccgtggaactaccgggccctcccacctcgcgccattttcgccttggtttcttgctctgggcaaggattccttct

SEQ ID NO: 1343 - DNA, 1538 bp, Zea mays
  misc_feature (1)..(100): optimal_loci_56055_G1, chr2:22942388..22943925, Cluster 8
aagcagacgtgctatgagcctatggttgctgtggtgttaactgttaactggagatctctttgatcagctcgtatttggctgaacctgaactgtagttttccttttgggtctggcagcctctatagcatataagaaggaatggacctacatctacatttagatttggttcatggcatgttgttgcgtcatcacagtttggcaggtcgcgctattatcatatgattgctcccagttactcagttagccatgagtaccatcacatgattctttccagttagccatcagtgtttcaattaatctcgggccttgcaaagaaatgcaacctgtggacttcggtccccatctgaatgtattatcggaagaaccggagaccctgtggccatggtggtaggcacgggaaccggcactcttgcagcgacatttggggaacactaatagttgtttggcccattttaagatatctttttattgcataattgccgtcgtccctctgctgtttgttccagtgtccgcggctatctgctatggcctgtgttgtccggctgccagagttgtgcattattgcggcacgatgcctatgattagtagttgattactgtttaatataatatctactagactgctactaataatctcgttagaagaaccacaaaatatggcatgccccaattcctaggtgtttttctttactggaaaaattggggccgactgtacctgcttccaccactactgtagcaggcaagcaggaaggaaaaaaaatccccctcatacgaaatgcaaactcattatgttgcagccgctcacatttataagctgtaggtccaccatatttattagttgtaggctcatatggacaaaatgcaatcagcccgaaacagttgtaacttttatgtccatgtagtcctgcagcttataaatgtgagggagtgcaacagaataagtttgtatacaatatgcatatttttttcacagcagaaaccaggtgatgatccaattatgattgcaagcagacaaatgcaaatggagtgcctcttgccttcgctgtattcctaagcaaaatgcgagctttcaaaaagcgtgctgttctgggtttttttttttttttgcgtctgtcgcaattcaaaatgaccagcagcacatagtagcgctccagcaaaatacccaagtgttttcaactcccttggttctaagagcgcaggcccgtgtttcttatcatggaaaacgccatcaatagcaggcttcctgattgaagtgtctgtctcatgagccagccaaatcctgacgcaatctaacaatagaaagatgatgatggcacatactgtgtgtcctgtacctcggttgcattcgctcgttttcgtgcacgcaaagtctgacagtctttgaagtgggtgtcacgtctctttgtgtccgccattttcttctttactcgtcaggttcaaagcgtctctagatttgctagttgaaaactggttgttctagcactgtctgacgtgcttactttctgttttcttaaattgtataataaactgatgaggggg

SEQ ID NO: 1344 - DNA, 1697 bp, Zea mays
  misc_feature (1)..(100): optimal_loci_56735_G1, chr2:26929737..26931433, Cluster 8
ccattatatcattagtctattagggtagtctagcgtaggagttagagttgaggtagtgagctttgctcatatttctagatctgagagtttggtatatctactgtacctttttgtttttccgtaagattctactttatccaatacattattcttttttctacttggtctttattttatgtaacattattttttgtgatagtgttgttaatgtatatctcgaagatcatagtgttgttcgcgattaacggcgtcacaacttgtataaggttagtaggctagcgaaccatactgacagtgtgcatgtgcgccaagcggccaaggccccatgcgaatccctcggttctggcgcaagtaaacgacaggcagcctagtgacacaacgacatggccacaaagttgctgtgcgcagatgaacacgtgagggtcgcaggcaagccgccgcggcgcacccgtaccgtacgtcgcaccgtgttgtgccgcggcgcagatgatgcctgctccacaagaaaacaaaaacaaaaacaaaaaccagggaagacgcgcgcgcaaggggccaaccggccaagggcgaagggaagggaacacgccatggcgccgtgtgcgcatgtacttaccaaggaggagtccatggatccttctgagaaagaaggaagcgtgcgcgacttgtgctgcagacaatggaccgtgcatgatagtactgcacgtagctgcactgtactcttgtttatttggaggaaggtgtgaaaggaatctacatggaatctgccttgaccagtcggaaacgatttgcaattgatgggcactcacatgctgccggccggccgcgcacgaccactagctcagcaagcaatttgtaggtaatcaagccagctgcatcatttggcatttatctttggtcgagttgaacatatagttgggtgcttagatagatcctgcaatggcagcatggagttagatgatttacacatgttccttgttcagctattccacctgacaacatatctttgatcgagttgaacatatagttgagctcttttcgtaaaattaaaaaaaattacatatagttgggtgatcaggtatatcctacaataacaccgtggagttgatgacttacacatgttcctgcccagctattttcctgccaaacatgatgtgtatgttccttgcaaagctaaaagcaagaatgacggccagtttagatccatgatatatgtacatccaccggtagatatttgtcagtgttcatgaatgaccatacttctgaaagttgccaagatgtttttagagcaatgcacggggaacaactaatgccggccacaagccacggaggacctaccccggatctagctaaggacccattatgctctggagaatccaatctcagagcctcctagatctctaaggcttttccaaccttcgtcacatgtcagaacatatgagattgaggtccccagggccctagaggctccccaggctttagggcgctcctaaacttctagagctctcatggtcacgagagccctctgtcctcacccttcaggctctctgagatctctagcttcaaagtcttgatcaatggtcacgtcacagggcttgatgccttttatgtggaaaatagggctcttgactcggctaagtacaagagcatctgcagactaaatatggttggtcatgccctacaataagacgaccttgaag

SEQ ID NO: 1345 - DNA, 1490 bp, Zea mays
  misc_feature (1)..(100): optimal_loci_59200_G1, chr2:41488931..41490420, Cluster 8
ttggatgtacatgcccccaaaacagacggggctaacttgggcagttgggctagtggaggagaacatacacgtcggcatcaacaactcagcaagtcatctccatttgccatttggggcttgcctccaggtccaggctcatctgcgccaatcaagcgggtagatcgtcagggggggattatcaaggctgacaaaacgcaagactttgaatgccatcaatggcgagggggcgggtttggtaacccaccaaatcatgcgaccacttgttgatgcggctgtttgttaacattgatggagaaccgtatccgatgcggggagaggtcgtcgacatacccatctgtggttaactggttatcagtctcagttaaagctaaagagaagagccttaaagcccactacactctgtggctgtgcaaacacactctgtccactcctgatcctgcttaacaaatgtgattcagtatgctcctaaagcctgtgcggttccatcctcctttccccctttctcgagagatttcactggttcacgagacctgcaccatcttctgttgctgttttttttgccttatctacgacaacattcctcggatgaacctggagcaagaacctggcaagcaatctatggcgtgcgaggatactgcagggcttggggccctttggcggcactcaatgccagccaaccacggccaggaggaccccaccccacacatgatgctagacgacgccaccaaggcacaccaacccaacaacacacgagggccaggggtatggtacaccttgtataaatacaactcctgacacgcagtaagaccggtttcaaatgtctgatgagaggccaggagcattgaatcgtccgtctccaggcaaaggcaaacagatagataatggttctcggatcaagtagtacgatgggggtaactgtaatgttgctgctgcagccttggggtaaaaaacaagtctgcagatcgcacagcaaacatacaaagggacaggtgaacaaatgcaactgcagggaacaatgtgaaacggtgtgaaattctgtgcagaattgttcccttttttttatgagtttgaaacttgagtactaacggttcttgggcacgggataaggcgcccattgcgtcagtctatctgttcatagttagattagatctcgtttggatcaactttttcttttctttatataagcctaagctgggcatctaacagtttcttgtaagttgggctataaccagagttataagctgagctgtttggatcagttctagattttcgagcagctagcaacttatttgaatcaatttaaacgtgaccttaggccctatttatttccctcctagactatataaaatattactttggaatcataaataaactaaaataagctaagctagcttatttgtagtcctaaaatgatattttatccttctacctttccataattttgaaacgaaaccagcaggatttgggcagggaagatgagacgcaaggga

SEQ ID NO: 1346 - DNA, 2277 bp, Zea mays
  misc_feature (1)..(100): optimal_loci_5982_G1, chr1:30262071..30264347, Cluster 8
tgtactactgtgtctatgcacataccttagtctttatttggttcttttagtcaagtattctgtttggttccagtgactaaaccggactaaaaaccattaattgatatgaataatgattgtattacccctattaattagtgtatgtttgctggaaaaaagaaagtggagataacaaataaagtaaaaattctactttagtcccttttagtcacctcttgatgactatagaactaaattttagtcacatattttaatcaccatgtttgtttttttaggaactaaaagtgactaaactttagtcgcttaaaaccaaacgggaccttacacgcgcctacgctcaattattgaggcgtacgtacgtccatctgggctgcacagaaacggatacatccactgcagcactagtcgatcgatgagcgacgtcgactgagctaaggccaaccgaggtccgtggcaccaggcaccagctagctagctaatcagagtccgtggaaaaagggcatcgcatcgcagctaaaggcggccgcttcggtgacatagtatagacggcgagccacgtcaagtctacttctctgtttggccaagatcgacacgccatttgtcacggctccggccggccccaccactcccgtctttggcgtcgatcgatcgggccagagagcgagcgcggcgcgggcgaaagctgcgaagtagtatacaacaacatggccgcgaagcaggatgtgacacggatcgcgtaggcgcctcgggtatagtataggccacgcctggctgtctctggccctgcatgcacgagccgtcgcctccctcctgcgcccagcgtcctggccgaccgaccggtcgcgctctcgcgtgggacgggggtgagtgcgatgcggctgagataggtgcacggcaatatgcaacgagcaaagccatcggcgtcgcgtcggtggagacgcgagagatgccgtggcgtcctgacgcggaagcgaaacgaggagagaggacggacgccccccccggggggggggggggggggtccacgggtgattcgcgtacgtgcttggacagccagcagcccggaccggacgacgacgacggggcgatcgaccggcgtatcgtcttgcgttgcatatttgcatgctagattgacgcgtgacgcgctgctggctccagcctccaggcctccttgtctgcctgtgtcgctgcgcgcgcgggccgcggagcgtacccctaaacccaatccccggtcctctctcatcatgtgatacatgagtgcatgcatccgtgtagatgatacgtatcacacacgtactactgggaccacgtgtacgccacacactagacttttgtatccttcacgatgcaaccagactagtaagaggaatatatatgctcgtcatcgtttcgctgtcgctgtcagaaaacacactattgcgatcgtttttttttacgctccttaactagctactactacagtacacggagggcagcacaataatgagtactagtagtgtattcacttctccagtccctgaatctgcgtattactgtgcgtgacacaacgagggcggagcaacgcgtggtcaagtcgtgtcgtacggtgcccgtacagcggcggccagtttgtgtcccgtacaccttttgttctctttttcttgacacaatcacattttcttcctgattaaaccagccttttcttgacacaaacacatttttttcttgattaaacagttactgatggcgcgcgcgcgttgatcctgaattcctgatccccttgctctgtttcccacaggatgctgcgctttttgacatctccgtaaccacaaccgctccatgacattctagactactacgggcagttacagcgaaggattctaagtcttggctgtagcaccttctcctatatggcaaacgacctgaaaccttatgggccataaatatttgacacgtttacggattattttagcaccgagtagacctaatacaaattgcgtacatttacattctctctttatccatatttatggtctgtgtcctttgcttcgcacattgtatttaatttagtctatggctaggttacatcttaccttataattctaccaactcttgttatatatagcccgtgtgccacaacatcaggaatccagattttagctttcagttttctgtcttattagatcataccatttttttgcgtatatatttgaagttaaggttctgaagttattgtaccttctattcaaaacactattctaagtctttcattacattcttagcctttctagcgaggaa

SEQ ID NO: 1347 - DNA, 1766 bp, Zea mays
  misc_feature (1)..(100): optimal_loci_61423_G1, chr2:54278298..54280063, Cluster 8
gccaaaattgttttcttcgaaagctgactgaacttctccccatgaactccctttctggagtttagaaaaccactcatgtttttcgaaatgctgactgaactactccacacataaacagctaaatagagtactgtttatacgtacaatggacagtttataagttgtttaatgctcgcaagtagccacactcaaatatgaatatgatccttttatacgtgtgttgctagtggattcaggaaaaaccaaacgattaaggccatatatgtttgggagatctacacttcaagaatttcaggtctatttcagcttcttctatccaaacgtgaccaactccacaagctctagtttcataatttttttaaaaactagaggttaatttcatgaaatttttgaagctcctcaaatgatgcttgaaaaacactgttttcatgcctactcatgaagttacataaaaattacccaccatgtcattggttacatgaacatgacctaacaaatcatgtctctttctccacccgctaattattaaaggtaattaaggaaactcacacaaattaattgtattatagaaagtggagtctatatgcaaaccaaacagtcttgaaccctgtcttaccaatctgttgaagtcgtttcatggtgcagctgtaaaacctaagctgcaattcttgaaataaagccctcctaaacatggcctaagttgaatataatttcaatattttatagactagtaattctggcagcatggtgcagcatggatattatagataagagtatgttaaacgtgtttatataaagactgattgaggtgtctgtgtaacaaacgatattaatggttctacaaagtaaataatatgtgtaacatgtggtttttttattgtttctagatgactgttctagttggaaggaaccaaaaagatttgaaccataacatttcggaattcgatttcgaccctaagttagcgtttggtcctagaaccggttgggatggagcggctccagcatcgtcagagaacggctccgtccgagagattttggaggacggatgtacaatatgtgagcataatttttttagagtcactctgatacttacatagaattagtccaaacaaaaataaatgaagagtggagcggcttcatcccatcgtagtcaggaaccgaaagcagtgtgtggccatttgtgctcagtgtgggtgagggtgaggccctctggatcccacccagcgacacaccaataaaacttgcacgcaatcgacaaaaaagaaattatcaaggcatacgcgcgccgcaattcgacacacagatgtggagtgcaagggttggccatacatgcgagaaacgcggcctgggaatcaggagatacgtatggagcaggccactcacatccagccatccaggattggaggggcacaagtttggacaagcctctctgaagggtactagtagtacaggacaaagcgcaagatctttttgtcagctatggtgcttgcattgcatataaaggctgtggcgagatggagtccattatattttaagacaacaacaaggcaggcggccgcgttgcatccgaacaagaggcaaacaccgatcactcgaaaggatcagaccattggcgttgtcgtcgttctcggtgcccagaacaacttctggttcgtcaaagtattactaagattagacatgcttgcattggatgcatactagtcaatgagcatggcggtagattctactttcttggcttgcaaagatccatgaaatgccgccgggag

SEQ ID NO: 1348 - DNA, 3506 bp, Zea mays
  misc_feature (1)..(100): optimal_loci_80142_G1, chr2:172489654..172493159, Cluster 8
cccaccaggcctgaacatttgattttcgatggattctcgttgcaagtacaaagtggaacaacaatggccctggttggtgacagcggcagtgggaaatcgaccgtgatcagtttggtagaaaggttctatgacccacaggctggagaagtcttgattgacggggtcgacattagaggaatgaagcttggatggatgagaggaaaaattggtcttgtcaaccaagagccggtgctattctcaactacaatcagggaaaacattgcctatggaacagaaaagccaacacttgaagatatcaatagagcgatacagctcgctaatgctgctatattcatcgacaagttaccaaatgtataactcaatgaactattacgtccgtaatgctatttatttattatatagatgctaattttctgccactcccattgttaatcagtacatcttgtgaaacatccgcagggtcttgacacaatggtgggggaacatggaactcagctgtctggagggcagaaacagagaatagcaattgctagagcaatcataaagaaccctaagatcttgctactggatgaagcaaccagtgcgttggatatggaatcggagcgggtggttcaggaagcattggttaggataatggttgaaaggacaacaattgttgttgctcatcgcctaagcacggtgaggaatgctgatgtgatatctgtcctacaacacgggaagatggtggaacaaggtatttgcttattgaccttaagaaaacttatttttctatgttcttcccataatcccatttgcagctttcctaactatcatctcttcattttgcaaaactgttcaatttctgtgaatcctgagcaggttcacacgttgacctgatgaagctacctggaggagcttacactcagctgattcgtctacacgagactcaacaagaggcagaagatgtccaccctgacatggaaatttccaggagatcaacaagtaaaggctcctcctcttttgggcagtctatccctgctccacttggctcacccgatccaacggaagtcagtggtgctcctgacacagaggaaggagctacagacagagtgaaagtgggtaggtctcagaagaaagcttcgatcgccagactcttcaagctcaacaagccagagactcttgtccttgcacttggttctatagctgccgtagcgcatggcactatatttcctatctacggcacgctgatttccactgcgataaaggtgttctatgaaccgccacaagagctactgaagggctccagattctgggcaggcatgtttgctctgctaggcgcttgcgcgtttgttctgattccagtgcagtacttcctgttcggactagcaggcgggaagctcgtggagcgcgtacgctcgatgacgttccgaagtatcatgcgccaagaaatcagttggtttgataaaccagaacactcaaggtgatcgattgtgatgcatgcatgatgatgttcggaaaaaaaatctattattgtcagatttttatctatttacttactgataccataagtctccaaacttgtgtcagcggatcaatttgcgcgaggctgtctaccgatgctctgaatgtgaagcgactagtcggggacaatctagcactgaatgtccagaccgcatcgaccatcatgtcaggcttcaccatagcaatggtggcgaactggaagctggcgctggtcatcacagtcgtgatcccttttgtggctttccaagcctacgctcaaatgctgttcctgaaaggtcttaacagaaacgcaaaggtactacagccacactcaaatgctgtttcatatctcgtcttattaactgtttttttgatcggggcgcacagctgaggtacgaggaagcaagtcaggtagcaacggacgcggtcggtggcatcaggaccgtggcgtcgttctgcgccgagagtaaggtgatggacgcctacgagaacaagtgcgagtcgccgaggaggcaagggatgaaggaaggcgtcgttggtggcttggggttcggcttctcgttcgtcgtcttctacctgacgtacgctctgtgcttctacgttggcgcaaggttcgtccaccaagggacagcaacgttcccagaagtgtttagggtgagaagacgaatcgtccttatcatcatatagtacagttcgtcagtcagtcagtacgtgcatgcagcatatttatccagaacagtggcttctcaggttttcttcgtgctggctttggccacaagtggggtctcgcagacgagtgcggctggggcagacagtgccaaggccaacgactcggccgtctccatctttgcaatccttgaccgtgaatccaagatcgactacagcagcgaggagggcgtgaccatcgcgagcgtgaggggcgacgtcgacttccagaaagtctgcttcaagtacccgttgagaccgaacgtccagatcttcaaggatttttcactgaggattccttccggaaaggttgctcctttttttttaataatttggacacatttcttccacctgaccgacgcagagcttgatctcaataatgccattatatatataatatattatcctcgctgcagactgtcgcgctggtcggagagagtggaagcggcaagtcgacggtgatcgccctgctcgaaaggttctacgacccggaatccggcaagatcttcatcgacggcgtggagcttgggaccctcaaggtgagctggcttcggcagcaggctgggctcgtcgcgcaagagccggtgctgttcaacgacacgatccgcgccaacatagcctacgggaagcaaggcggggtggtgtcggaggaagaggtcgtggctgccgccgaagcagccaacgcgcacgggttcatcgccgcgctgcccgacggctacgacaccgtcgtgggcgagagagggagccggctgtcgggcgggcagaagcagcgcgtcgccatcgcacgggccgtcgttaaggaccccaggctgctgctgctggacgaggccacgagcgcgctggacgtggagtcggagcgcgtggttcaggaggccctagaccgggtgatggttgggaggaccaccgtggtggtggcgcatcgcctgtccacgatcagaggcgcggatgtcatcgccgtcttgaaggacggggcggttttggagaagggcaggcacgaagaactgatgcaggtgaaggacggagcctatgcttcgcttcttgagctcagttctagttctgcatgatcagaggggtagttggcagaatggaggcgtgtctgcattttttagattaataaggaaccaaagtattccagactccagacgcgtgcttgtgcacggataactagttaatcgcacaggtcactacggcaaaaacatgtatttggtgacgtgtttccgattttatgttgccaattaaatctgtttagcgactcctaaaaaagatatcactaatagaaccattttagtgacgcgtttttataaatacgtgtcattgattga

SEQ ID NO: 1349 - DNA, 1465 bp, Zea mays
  misc_feature (1)..(100): optimal_loci_80564_G1, chr2:174556325..174557789, Cluster 8
cctgcatgtagtattgaacatgtttacatcaccctgcagttctgatcactggagctctatttcagttctaaacatgtttctccattttatcacctgggtgtctggtgagaaggaccttaattgtggtagagtctattttggttgtggccctagaacattgcatcatgtcagctctctgtgtccaaagactttttttttatcattatgcaaaacttgcctctgtttacattgttgtactcatggtgtactgtttaatttatcatatgattctcgaagtaagaactacaatttgatggttgctgctagctatgaggacctgacaaggccaatgtgcatttgggaagagaacttgaagagcaaataaatattgtcttagattttatgattttctgaacatgtcgccatgtatcagtgtcagatgctgaatgagttatcttctgtgatgttgaatcagttgtcttagaattatttgaacttgtttgcatataccacttgcattatgttatcaacatcttcagtgatagaacactgaatcatgctcctgctgttttcaaaagctgcagtaatgttatgcactatggaatgatgctaaggttttattgagcaggttgatctctcagccaccagacaccagacacgcagccggggttggccagcgccagccaccaggccgccgtggctccgacttccaacgtcgtgccccgcctggcaaccgaccgcatccaccgcctcctggctggctgggcagggtagacacaaaggtctcatccagtgctccactcctccggtgagcactgatctgatctccacaatagcaattgcgatttttaattcccaatttctaagctttgcattagtaggtgtttgactttattttcttgtaatgtggatgcagtagtataataacttcattggatttaattattgcagcatccttttctgctccgagacacctgctgaagctggaagtacatggtacaaggatgattactttaattgaattggtaaggaaatgttggttttctcgtccaattcagatattctcgtttccatttgatcacacgtgcttcgtacatcacgtggatagtctgtatgaatcctaaaaagatctaaatgaacatcgtcatttaattaatataggtcggtcattttgcaacccttgttaacaataaccaaactgatggattttctaccgccgtaaatttcaagtaaaatttatgttatgatgttcaacttttcttgtcatgtgtggcggaaacataagtaggctggataaatagttttgtaatttttatgcctaaacatgttcaaacaaactgtttgtaatctaatgtatgcaactttgatgcttagctgttatgttaaataccgaatgtactataaaattatatattagatagaattatatataaaaaaaatttgttgtggcacaccctatacaaaaatcctaggtctgccactggct

SEQ ID NO: 1350 - DNA, 1645 bp, Zea mays
  misc_feature (1)..(100): optimal_loci_81773_G1, chr2:180529319..180530963, Cluster 8
  modified_base (747)..(747): a, c, g, or t
  misc_feature (747)..(846): n is a, c, g, or t
  modified_base (748)..(748): a, c, g, or t
  modified_base (749)..(749): a, c, g, or t
  modified_base (750)..(750): a, c, g, or t
  modified_base (751)..(751): a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
  modified_base (771)..(771): a, c, g, or t
  modified_base (772)..(772): a, c, g, or t
  modified_base (773)..(773): a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
  modified_base (787)..(787): a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
tgtgaatgctcccacaccggatagagcccttcctttgtactactctctgctcatttgttaatggatacccgattgcccttgctgtagtatgggtatgtgtgatattggtgacggtccctaacaacttttgggcatgcgattgaggttctaggaagaggatgggagcttgagcttgctgtgcgctcttgtttggacgtgtggttcagggcagggatgccaaatcgagccagggagtgcgcgaggttgcgcgagtgggatggcggctggttcagttgctaggcgaaggtgcgtgctgcgaccgagcgtggatgctgaatgtatgctcccggtccctgtcaacgatcgcgttcttgctgattcgtatgcagcggctgcagtgagggggaaatcttacgatctagggtacgcagcacgaggatcactcgacacggtggcgttatgagggaaatgcacacgatggggcgcgcgagatgtgtaaaagcgctctagcccactacgaaatactccgatggaatatctagggcaacctagtagcgctgaccatagagagaaagcaaatgatgtttggatcagctagatcacggataagactgaaggactgttccatataactgatgataccagtcctattgtactttggataactgctaagttgtagaataaaatccatattgcctcctaatattggataaatggtcttaacaaaggctacaggctcaaaaaggtatgggcccccaagtaccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgggtgagcgcgcgtcatttttattctcaccatcggcccaacttgtctgcgtcccgaacgcatatgaaagtgccagtactgacaggaattaagtagtcgcggattcttttatggcagtatcagaaagaatatcttcactttgaattgcgttaagtcctatctagttgtgcgcgtgtcgacgtacttccctgcgaggcggataatagtgttccaataactcgttgtttatcgacagcgcctaaactaaatcgaataatttgcccacccacgtcaagtgttttgcgacagccctagcacagcccgctaagaagcatagagcatacacatgtctataaatagaagtgcccatctccacacctgcggtatggttgcactcccaccctctattctcctagccgccaccatcggatcctctccccacgctgtcttcgtcatccccctgtggtcttcaccaacggtcaacctcagcatgggaaccagcaggtcctcttcctccccctaccaaagctcccatgactcccccgccatggcaggtgtcacatcccttccatgttgcccgtggatgccggagccctccccagaacagtaagagtacaatgcgtttatgtgttacacaaccgaacaaggcctaatgtgtcattcaagataggtttgcttagccaaaaaaatgacttcttggtatggtctagtgtctaaagtagtccctgtaaaccttacgaacgagaggaatgtgtttctttggaatcttagtaagaacgacgtatttacagactgatccatctataagattatgata

SEQ ID NO: 1351 - DNA, 1466 bp, Zea mays
  misc_feature (1)..(100): optimal_loci_82147_G1, chr2:182653682..182655147, Cluster 8
atgacggtcgctatcaagtatgttctggctttgcaactaacttatgtccattctcctaaattcgcacgagatcgatctcgccagccgctgaagaaaattccatccagcttgacccgttccagtggccgggacgggacgtgaagcaacgccagactggagttgtggaattcagcctccagaagctgctgtgcccaaggcattgaccgcaccaaagcgtgtgactagacggctcctcgcgcctcccacggcgccacagctagccacggcccgcttgaagttttctcgccctagccgcggactggtcgtcgtcgcggtcctgccgtgccgacacgaaagtacgcgggggctcgcgttgcgtcgccggccgaagtaccaatcgctctgcagcttcaggcttcagccatggacatgtgtacagtacagaagatcccatccggtccttagcctcggctccacctccgcggcacgggcgacgccgatgtagaatttcgcggcaaatgtgcagcggcgccacgcggttttaataagcgcgcgcgcgggggtgaccgcgacgctggctggcgcgatgcgcatctgccgtaccgttgagcgcgtcactcagtctccgtgtgctagcttagcttgtgagaaacggaagctgagatcgtcgaggcgtggcgcggcatgttgctgcatctggccctgtagtagtgtacataggcaggcaccgccgcaccgtgcgtccgtgcctgctactcagggcaaactactagctagctagtcggtttctccttcaggtgactgtccccatgatagcgggagcggcggctgcaggtcagctgctggtcgtagcggggggcgcgcgctcgtctggttccgcggcgctcccgtctcgtcctctcgctctcctcctcctcctcctcctcctcctcctctgcctcgtcggcgccgagcaggcggcccctacacccggtgccgccggagagaggcggcgcgtggacgtggacgtgggtgtgatcttggaccgcacgacatggctagggaacatcagctgggcgtgcatggagctggccctccaggacttctacgccgacgacgacgacgccggctacagcacccgggtcaggctgcacctcagggacgccccggccgggcccagcgccgtcgacgccgcgtccgcaggtacgtacgatgtcctgctttatttcagcatccgcactaagacttgcaaataaatccacactgcgatgtaatcgaatcagcttgtccgggcttcatggcctcatgggaagagctcacattatcagctagctgtactatacggttcttgtaccccgttggtggttaggcctaggccgcgcgcgggcagggagcgacgacttgcgagagctagccatcttgagttgaggtcattgttggtggttaggaactctgaacgcccgacgtgacgatcgtgaaaggtatatatcgcaaagcaattccctaac

SEQ ID NO: 1352 - DNA, 3165 bp, Zea mays
  misc_feature (1)..(100): optimal_loci_82750_G1, chr2:185835222..185838386, Cluster 8
aaccggtatatgcattgatagaggggaaaatgttttacgataattcgaaagtatggcttttttgggaccctactgatatgggcccgcctctggacaaaattgaagcacggtgaaaactatactcagcaattcagcatcagcaaagtcacaagctcttgaccggtcccatgcccggagtgcaggttcaccacttcaccggtcacctaccacctgccgtggtcgtccgttctggaaggctgaaactgcattggggcctgggcctcgcgtaccggcctaccaacagtgtacaacactgctggtactcggacagtcgcaaaaatcttctaccagcgagccagagacacagggagacctcttacactatacagtagcatttttaaaaaaaacgaaattgaatatgtacaggaaaactagcttttttccttcggagaaaggacgagaaagtactgcagagagagcccaatgttgcgacgaaaagacgtacaatttcagtgcagacagtatctctgccttttctcccttttccgtcacttttggagcctgatttccccacaaatcacggccgctgagcttttccattgtacccatacccatttgccttttacctcagtcagtctagacgtctaatctcaagctcatagaatgaggtctgtttgatcccaagaactaataattagctaaaaatagctttagtggatccaggcactccggctaatgactcaattaataggttagaataaacaatctattaataaaaccttattaagcattactgttcagctaagtattggcaactactattagttggtgaatcactcagctaatagccctgttagtatgaaaaataattgctctctccatactgcagtatgaggatctacagtttagatttgttcagaaatataaggttttttagatactccactctctatatctcctctgtcttcttttgcaaaaaaatatatatattaaggttccttttaaatttggtgtcatctaaatcagtaaacaataattaaggaaaataacgagcgaactactccctgcatgttaattagtaagggataaggtaatcttttcctaaactctttgtttgtctaaaaggcacttggatactttgtattttgggacgtagagagcagttgactcattatagctagtagctatatataacacctagctggattttaaaattctaaggccttatttggttgcgtatgaatcggagatggttgatgagattaaatattttttctattcaatttcgactagtaagagatttaatcatttttggtcaattcttctaaccgaacatgacaacaaatctcaaggcggacacaccactgaccactgaggctacaatttcacgtaacaaatttgaattttggcatcaagttttgttatcgtactaaatccagcgaacttgaacttggatatccagagatatagggctcagaaacaaatccagcgggtgcacctggatagatccaagaaaacaacaccatgtcatctcttcgcttactgcaagatagacaactcatcttcttctagtagtactaaatgaggcactaccgccccttttattttgtccatcctctttgactatgccgacaataatagccagatcgaccaaggttggctatgcggcattgttgctgtttcgatgattggacgccaaattaaaggagcaagctatgctatatatagctgctagggtctgttttcagatgagatgtaaattgtcctcgtggctcagtaccgatggatggtcaccatttttgcatgccactgtgttctatttttgaataacgcaaccaaaaggcgctgccgcggaccagacaaatcatggcgaacttgtaccaccgaaaatgtgaaacaaagttccttgccagagcttaccaactttttaccatgtcgtgccatacaagttctggcaaaaaattaaattttgtgcaccttcgtttgcagcctttaggtcctgtaccctaaggacacgtaatgggtatactaactcattcacttcttttaaatgtttgtgtatattggttctgtgcccatttggtctcgactcgctgttgcagtgcggccgcgtcgggcagccgggcagccgcgtcggcagtgcggccggagcgacaaatgccgtgcaggaaggaggtcgtagaacccgagcatgaccttgtcgaaccacccggcgtcgtcgaccacgtagaacgtgcaccgcgccggtcatgcatcgtcgccgcctccagacgcacggcctcctgccgcgcccacctcgtcgttcgacccaaagctagctagtgccgccgcgaggagctcgtgagtcgtgacatgcgcggggagctaattaaagtccccatcgccaaggctgtcgccgtacccgtacactggacagtgcagccgtgcatcccgttcgcctccagctagcctccggacgacgatcctttcccgccgcctaccttggcctggccaccaggccagcaggtaacgcagggtgacgaagaccgtgaccgcgtgcagcgagctcacgtcgttcttgatgtagtggccgagttgggggggagtgagcagtagtggacgcgcagcgcttgatcatagcctggccaaatctgatcgagacaatcagatcgcgtgttttggaacacgtgctgcaatagagatgcaccggcgtcacggcaggcgcgcccagggtcgccgggccctggaccctggtccgccaggaccgccatggggatcgagtgagcccgtcctgaatgttgctgtagatgatgaagcacgacccggggaacctctggacctccggtctcgacaggagcttgctgaggcgtgtgctccagggtcaccttgctcgccatctcctactccatcttccgacttccgttgcctcccgtaattccagccgaagtgaacatggcccggtccgtaaacatgccgaggaacagatctgtaggatctgtcactgaagtcgttggcattgttgatgaggtacgctgcttgcccagcatatgcgaggaccagagaaggatatatgctacacagaaatgctatatcatggacaattcacaaggaaggatctcaaggttgcagtgtctatgaaaaataacctgaatacccttcttaccgaagtgaccaagatctgacaacatagcttcagcaccagtacgc

SEQ ID NO: 1353 - DNA, 1596 bp, Zea mays
  misc_feature (1)..(100): optimal_loci_82871_G1, chr2:186536450..186538045, Cluster 8
acatgcccgtttcctttgggcaagtggccgggagcgcaccgtagctatatgctatagctcccggccggccggatgcagcagcactctccatccatgcatgcatggctggtcgccttttcgatcggtttatcaatgtacgcgtgcccttgtgcgcctgataaggacgtagccacggctttcgttgcatagtattttacgggcaaaccacattattaaagcgaaacagccggactagctaatcacgttccacctacatgatgagtggctcaaaaggagggttgggttgggcaattaatgggaatcctgcgtcgcgacaatttgagtgctggctctactggaggtactgttctgctaactgcttcatgtgtgtgtatcgctttggctccaagaatggttaaaattaaacgcggctgtagatgtactgtacgctgcctgggaagtggcaaggaccttgtagagagtctaggtagactgagagagagagagagagagatagggggacgggttgactggggtttgactgggctcatgcatgcatgcagggggtaattaagctggcgacggggacaggtcgaaaagaccacgtgatccgccaccgagggtacgcgcgcgcgcggtactcgctcccgcctgcggcgcggccttcccgtccatcggcgtgggaaaagacggccattatatttgcgcagtgcagccttgcgcggtctgctccggccgttgctggttgctgctgctgcttcagcaatgaaacttttgcagaccggcgacggggaggatggtgtgatcgtcgtatatgaagatgccgatacggttccgtcaatcaaatatgtgcagctcagatgcatggagtgaggatgtcgtccatcgcttagcttgttggtatttgcccggtggtcattttggtgtctatccatcagtgttgtgtgctagctggaggaagggtgccacgtacgatcagtgctccgtatacgcattctgaccggtgctcttgaaatgtcgtccctactgttgtatatgaaaggcgcgcggcaccagtagaggagcactgttgggtagtatatatatgtactattcccgattcggtccgtggcatcaggcagcactgtagcagactagcaggcaaggcatgcgcatccgaatgtattacggagtgttatgcacatagtaacattttgtactgcgtaccctcgggttctggggtttctcagtctcacgtgacttttagggcagccggtgtggagtgtggacgcggacaacgtggctatagtgaacttgtctgtcgccgaccaggacaattactgctactctgggatacatcgcctcaagcaactaaataaacaaggcaactagtaatgaaaactctataactattgtttgcatgtcatacgtcgactagttagttgcccgtgtatatataggcagacattgtttaaatgatatagttattcaaatacgatctaaacccatatacggagtattaggttagtatgaatggcgagatatatatgtggtgtatgatcaaacaagataaagtttttttctcttgcttttttcacactcgcgagaataggaacggtgggggaggagatactatac

SEQ ID NO: 1354 - DNA, 1561 bp, Zea mays
  misc_feature (1)..(100): optimal_loci_84630_G1, chr2:196742777..196744337, Cluster 8
tctgaacttctgatcatatatatactacaatcatgccggcaaggaccggcgactgcatatggcacatgcctaatattgataggtcggcgaccgaccggtcggcgagaaaggaaaggcaaagcagaaaatgaggcccgaacctgggatatgtatgttgcgactgacccaagctacgtcgtcttccgttctaactaatcgcattacggttaagttaggtagcagtgccacgggagcgcgataaaaaaggcagaagctaccagaattttcctttgaatctctctcctgtttatcagcagcaatctaccaagactttggatggtgtcgattatcggttcgcagtcgcaatcgcctacgacgtacgccgacgacggcaggcatactccattccgtccctagctacctgtacatatatatgcggtagcacaccaatctctctctctctcactctctcttttaacaatctctctattcattaattaagggctcaaacaaaatatgaaaacatatttagatcgtgactatccaccgttccccgcgtcgaacagacgacgacatcgtcagattcatcaacgagccggtaccacgtccatgttcattcagcgtggcacgcagcaacgcgtccacggtcgcatacactgtggaaacgttccacgaatctagcttgaagggacgacgacgcggtgaacggcgattcgctggaaaaacgaagacataaatcggattagaaaactagacggtctgcgaactacagttagttacttagtccgaggctctcttgcgtttaactacgtaagatctcgataggattagcataaggtcgagctgatgctgtccttaccagcagctacagctagctcggcctcagctctccggctgtgcaatggccgcgggcttgaatattccgtgcgttgcgaattttgcaaatccagcatgcgcttcatcaggtcaatcatatatattggcttagcttgttgttcatcgagagagagagagagatggagagagaaaaacaggtgttgtttttttttataagagggatatatactctcgtttctattacttgcataacagaaatacaaagtgttttacggaacggcttttccccagcgacataaccgcatggtggccaagttcagaacccattataagacgatgacacgtctagaagccaggattattccacatcatcagattcatcatcagtgtccggcgatctgccttccgcttacacagcccggacaagcagtttagcaccctctctgaagaatatcctgcgaattcttgtttgctgagccctgcccctgcccaacacgaaaacaggtgttaattgttctatggtcaaaccatagttaattacacgttaggtacgtgcattcgaccgtttcttttaactcgcgaaaataaagcgccacacactactaggcacgcgtgtatgtatgaacatatgaccatatggtacaattttgtctatgtttttttgggattgggtcatcttgcctcatgtctgttgatataagctagagataagtccattttagttttaaatttggtttaagtgaat

SEQ ID NO: 1355 - DNA, 1861 bp, Zea mays
  misc_feature (1)..(100): optimal_loci_8701_G1, chr1:45746354..45748214, Cluster 8
ccaaataacatccaaacattcaatgtgacaataacatacgaatttagttgggattagatgaaagattaaatccctttggattcatgtgcaaccgaacaaaaccttagagctctttcaatcatgttctaagattgtgttcaacagtttacttatatgattacttaaaatattatttttatattgcagattgtattatttctagagtgaacacgcggagatactctaacgctcgggtggttggtgggatgaacgggagagggtgtgagagtgagccgcatgatacaacgatgtgctggcctgttactaattgggcccagttgagcgattggacgcaggccgctttacctgggaaattttatacatgggccgagccacgttatgtccccgtataaccttacgatgagcgggttcctttcaatttgggaaggtggggtccgtatggcagccatgactcgtgatcacgcgcacgcatggagcagtgcgccgaacattcggagcctcgtcaccttttttttctcccctggcgcgtgtgcgtggacagcataccgcgtcatccgtccgcttggttgatggccacggacaaagggtgcgggcgtgcggcccattactgggagaactctagatagattagaggggggagcattttttttttcatcaaacatcaaacgagggagagagagcaaacacccatgatgttaacctgccttcagcgtccgcgataagctcttgctcgaggtcgatttggactcatccatgctctgccatgccactgccaatctgtttgcgccgcgcgagcttgtcgcgacgcgccggcagcagattgctgccgtgatggcgtgagcttggattagcacatggggtcgtccgcctccccatccccatcttgctcagcccatcatgggtggccagattaagcctaaacagtactatgcaatgaccccaccaggttaagggatccacgctaatccacagctggtatcgcctatcagcagcccccccccccccccccccccccatgattactccacacgtacatccaacctttgcccggcactggtgtgccccgttccgtatcatgaatccaggatcccgcgctttattaggccatccttacatcacactatttctaatgttgacgcttcaataaaaataagataaaatgaagaatgaaacattatttcttaataaagtgtttcgtaccataattttataggtaccataattttataggctaacatgtgacttaaatgctacatctaaataaccaaaagaaatgaatgaaatagataaagatgaaacaaattgttcctaatagtgatttcacgtgttttacaataccatggaaacttttttggcatagttctattatgatgaaactagtttcatctattttataataaataaatatagtaccatatcattaaaattaccatgtgacatactaattaatataatgaaatatctcataaaccttccattgcgaacgatcttattgtcttcacgaagccaaaacagggcgtctctcaagtcccaacctacaacggcattccgtctagtccatactcgacatattttctattttctctatataattatataaagcctatttagtaacaatgttttttaaaaccgtagttttagaatactatattttacaatcgttatggcaataccatggtgttgattatctcctaaaatattatatagtgtttgaatacaacattatataccatgatatttagataatattgtggcagacgtaggaggagaatttacgggggctaaaaaacgaagcagaaccttaaaaaacaagtgttaaaaataattcaactttcatatgaatacacaatacaaggttaaa

SEQ ID NO: 1356 - DNA, 2371 bp, Zea mays
  misc_feature (1)..(100): optimal_loci_87098_G1, chr2:211186412..211188782, Cluster 8
aaagaatatgagacagatgaaaagccaaagaagaatttggcagcagcagcgatgtgaatagatcctcagaaagtacctgacgtaacagttaggagatctaccacaagtgttcctttcatgctttattaccaccaaagatcattaataaaacatgatgctaccaacaaaaattgatacaatccaaaaacacaagggacagataaatcttattgttcaactggtatagtagttaacaccaattcattttttgttttaccattcctttggcagtgcaattgcttttttgtttattttatatagacagctttgtagtgcaaagtgccaattttctattgtggtaatagatttatatattgacataatagaacatgtgtccatatgtttctcatcttgtaatggtttccgtgaccaagaacattatctccaatttttttcattttcaaggatggtcatatatgatccagtcaactacatctggcttgcaaaagtctgcagtaacatgaggatacatttttttttgttttccaggattgttatatatgcccaaatgtgaagtacttaagagaaggtgctttcattaatgttgatattgaaaaggggatacaagatggacaggtataaagcaagcaactacgttatttgtttcttccactgaccaatctgtaactgtaatggtatggttgacgtcctgcaaacttttgtaaccacatgctgaacaccctgcgatcagctggtttcctctcctttgcactggcaacattcttttttttcttcttcattttcttgcgataaacaacagaattacaaccaggaaactgattttcagcgagccagctccactaactaccctgcagtggctcgctgaaatcagtgaaaagtaaccgcttcatttaagaacaacagccttcggtctgagctacaatttgaatatcatggcatggacatgattacaagaattgcttgagcttgtttgttctctagggaatgatgaatcaggaatgccgttgcttttttgttgatttcttacgttttttcctgctgacagaaagcagttggcgacgaagcaactgttgtaaagaagcggtaaggatccatatggcgtggaattgggcagccgtccgtctaccttgcgtgccttcccccagctgcatgtatctgtgtttccgtcttgccacaagcagcccacaaccacaacttggtgtcttgtatacctgtgccttgctttccttggttggtggtgacagggccatcatgaattaggcatgacttgtttccattctggtattgtaatgtgtatcattactgctagctgctatatcttggcagtccacacggtggcaggacctcaggccgttctttgcacggcagagctcgggagcaggtgtccccagtttgtgtgagccacggcagggccggaggtcagcgtcgacgagatgagggcggtcctggacctgggagccgcaggcaggcaaccaaccgcttggcctgcacgccacaattgacttggccgtcgcgagcggtgacgggaccgcgggcgtatccatgtggatgtggccgtctccatcggcaagatatggatggcctgtccagcttcccatcgtgagctcgcaagtgaacgcatgaatcacaacacgtacagcaccagtgcccacaccacactgttctctgctcgacgacgcgcagtgcacgccacagttgtcgtctactcgtcttgccaagcagtgtgcggcggcatgtggcacccccccaaagcagaacaacgggcgccacagttgcatccccttcgcaggtcatagcacaggccgcgacacaaagtcactggccggacgcggaaacactctctagtgggcggcagctgcgaggtggacgacgacccgacccagggcttccctactggctagcctacactctctcgagtctgaactggagctaattgcatcagtggctgcatgggagcaggtcgtcgcaaggcctcgactatttcctttccgagaattattcatcttccggtactggtaggtatccatgcctagccagcctgtggtgtggtcactgtgtgcagtgtgtcgttcaaggcaaccgtctcaacattcaaccagggttacgcaaccatttgttgaatttacgaggactactaataataaataataatgtaaaaaatctaccttctttggaataacatgaaattagtggcggatttaggataattttttaaggggtgatagttaaatatattaggataagaagagatatataagaggaatgattgagctgatgtagtgggtacacagatggccgctagagtcaagtatgtgggtgtgcagatcttgtaccaccggcacttagatcgtgtcaagcagttcagtcatct

SEQ ID NO: 1357 - DNA, 1671 bp, Zea mays
  misc_feature (1)..(100): optimal_loci_89116_G1, chr2:222650876..222652546, Cluster 8
tgatctgaacagagagccgtctcgaatcgtcagtgcagttcagctggaagaccttagatgatgaccaggtgagagtttggcacctttgctgtgttttttttggtattggaatggagggagtattatttggatgcctttactgattgggttacaagaggttatttcttattcaggctaatctattactccttccaaagaacagccaaggtggtggtgaaaggaaggtgtcagaaggtctgttcgttccatctctttgcagtagatatccgtaattactttgttactaccagtaattttatatatatcctcatttcaatgaacagtcaaagtagttttgatcacaccggcagacggcagtatcaattgtgaacactgcagatggatgggggaatgacactttgtgattacttctgcagatggaaagaaggatgccgtcggttcattgctcagcgcgtcaggatgcttacactactccgtgcacggcatactcgttcaaatacctgcacaagtcaagtatgcactcaccctccaatgcacattagccagggtaagctatcacctctgaatgtccctttaagcaagtgcttaccttgtgcttccaactgcagaaagagttttcctagttacttgcatgagggcatgcttgaggccatctcaatccaggcattggctcaggtaagttcacctgtcatacttatacatcttttagttttaattttatactatggcgccgaatttataattagcttgtagccttgtactactaccctggtctcgtgctcgacaagggcggcgagccggcagaccatgtcagtgcagtcggctgcctctctgcagctgatgacctacttcagagagctgaagggcctggttgagtgtctgcttggcagatcctgtcacaaggtctgatgctagtccaacacaatcaatcgattgcattaatcaagatatgtgctgacgacgggatcttttacttgttcaattgtacgtagggtagggtacctcctccttggggtgtcatgaaaaacatgcacaaggaaatcccagacgtcgcgtgcaagaagttccaagtgtatcggcagggtacgagttgccgagcactgattcattctgggagaatgctaatggccagcctcagattcagagtgccgaggagcatccgaacgatgacgaagatgaagtagatacaaaatgatagttctcatttccaaatgcttctttgcattgtaccacccaaagtagcagaagttgtagtacactggagttaaaaaaatgcttagtccaaaaatgttttggattcagcatatgcctcgactgaaaaaggcatcgcgatcagctgatcagcatctgtataactgcaagtattaccatatgataaagtctcgatgtgtaatataatcataaataataggaaattatagttggcttcttactgtaatcgccttagttttattttcccaactgtatgaacagagcatcacagggagaaaaacatggcacgcaacgcatttcaatagaacaatagttgtctattcatcaggtgcatggaagttagaatctgtactgtatagtacacaatttgaaaggccaggctcacgtgtttactaatccagttgtcagataaggttacatttgtacacttcatggtccttccaaatgagtctcgaacat

SEQ ID NO: 1358 - DNA, 1452 bp, Zea mays
  misc_feature (1)..(100): optimal_loci_89535_G1, chr2:224233042..224234493, Cluster 8
ataaataaagcggcttgtattctatgttctgttaacaattaactatgatgtgtgaataaccgccagtcaagagagaaacagtacttaccagattgtgaagcaaattaatctgcaggtttgttcctcaaacaaatcaggtagatgtttcctcattgcagcctcctccaaattcacggcgtcatcctttcctggaactccatcccacgcatctttggaccaccctaattgcctgtagttcagtgagtacaaatgatggtcttcaacttgctgtcagcagaggggcagtacgtagtgtaaaatctcagaacatgcatactaattattggaagaagaaaaaacgacaatctcttaattgtaaaaataagtagacatttcaacgagcatcttacccagcagaagacaagcgtgccaaattaaactatgcaattgccaaaatagcgcagggaatgcacatgttcccctgtcaaaaattaaaaaccccctaatgttatgtttcttgcagtaatgtgcacaagtctctatcaaaaatgctaacaggaggatagtggcaagcattcccataaacagccgaaccatacgaatcgctgtggaagcccacaacttctttgttagatagggcacattattaggctttgctagtgactaaaaacatgtcacaaaggatgcgagttctaaatgtgtagagtacttacaacgacttcatcaggcaataattcatacaccttggtaagcagtaatcttttgctgttactctgtgggatctctagctcgtactctatatgggcctgaaaacaaagaagaagaaatgttcagagcgaactccatcccagcttcaaaggttcagggcaagaaaacagtttacatgcatctatcatcatcgcgttatcgaattacgggtcgatcacacatagatcggacacgtgataatacaatctgctaaaccagctcaacatcccaaagctgctgcaaaaagctcggattatatcagtggtaatcaagggatgactaattttttttagtggtaaagaaggggacgagtgtagctttcatcggtctgtaagaaatttgagcgaattccctagatgccataatcgccgtcacacgtaccgtctgcttccattactggtacatgggacccacttgtcatattcgaacctttctatctctgaccgtcagtccgtcacacgcacgcatatacgcttgctgtcctctggaaactgtgcattttgtttaaaagattgtcttggaatctgatacccccacacgcatcatggatagggaaggaatctagctaggggtgattgcatggttcctagtctagctgagaataagagatgctgtctgtctgtataaaaaataatatattgtatatataggattaaaccaatactcctacaagattataatcatagtttttataatcttaaaataaatggtgattcaaaagaacta

SEQ ID NO: 1359 - DNA, 1441 bp, Zea mays
  misc_feature (1)..(100): optimal_loci_90457_G1, chr2:228647866..228649306, Cluster 8
acttcaatgtagaacgctacaccagtttgaagaaaaccagttttgaacggaccaacaaagttagagaactcattttgttagttttctaagttcggtgacccaagtacattttactctattttttttagttttttgcgcaaagagataatattgacatagagtacactaataaatatacgtgcacatacaatttcattctaatggatataagctgatacaaaattacaacttctttattgaatatccaaatgtacatgtagctcctttatcgaatataaaaatcttaatagagtattacatatttttagtaaaaaacgtgaaaatacatctgagtttcccatcgctggctgtctaagtccaaggagttccaggagaatggtttaaagcgagggatgaagttacaacaaacgaggtcttagagtagaaaagaaaaaaaaaacggcactcaagctagtctcaatacaagctttaaatcaactagaacgaagcccattaatacactagtgtagtgttttctagcttgtttacatcagtgggacccttctttcttatggtaaaactataactgaagtggcccttgagtttatacagcagaggcgaactggacaacacgctcgacgcgagccatggagacacaaacacgtaggggcacggcacagtcagcaggcagccgccgaaccatcgatcgagccatggccaccagtccggccactcacgtcgtgctgctccccttccccttcaattccccgcaagggccatcttccaggcatgctctccatcgcgcgcctcgtccatcgctccgtccctgaagtggccatcacacttgtctccaccgcccgcaacattgccgcacttcgcggctcccccagacgcctcggcagcgtccatttccctgcacgcgttgccgttcgtcccagcggaccacggccttccagacgactgcgagtccagcagcaccctcccggtcgcgcagttcatcaccctcttcgaggccttcgagtccctggaaccggccttcgacgcactggtcagtctccagcctacggcgcgacgccgccactgacggcggcggcgtctgcatcgtcgctgacccgactgttgcatggacggtaaacgtggctcggcgtcatgggtgctcccacgccctgtactgtacctgagctgcaggcctgcagcgcgctggactcggccatcctgcacgcgctctggagacacatgccatctctgcctttcggccccgacgtagcaacatataacttcccttgagaatttactacaataaaattacaagcgacgaagagtttgtagcttgtatacaccggagcattgtcttcgtttctgtcgttgtgcgcaatagcccaccagcgcaatggtatttcagcatcctacgtgtagataccatggagacattgttgttgttgctacagtgttgaagaagacg

SEQ ID NO: 1360 - DNA, 1509 bp, Zea mays
  misc_feature (1)..(100): optimal_loci_92714_G1, chr3:3213661..3215169, Cluster 8
aatagacctacacgtttcacatgttacacacaaaattgatattttattatagtagagattatatgctaaacactatcacaataaaaattagtaataaatcttttgaataatacgagcaaaaagtcaaataagttataaactagaacatatgagtaaaaaattaaaaaattaaagctattttacttattctttaactttaagaaattttgatataaatacgcaacaatgtttatgacactaaataaataaattactaacatataatttatctaatgataccagtttgatgctagaaatataggttggctccttttttttaattttttatacataacaactataggaattgacttattattctggaacggatgtactcagaacgttcgttgttatttgagaagcggataagataattaaacctacacgcttcacacatgatacacgaaattgatattttaatatggtagagattatgtgctaaacaatatcacaataaaaattagtaataaatcttttgaataatacgagcaaaaagtcaaataagttataaattagaacatatgagtatataatatgttcttccgctcgcgccggccatcgaattttctctgacaaaccagctgcaacgatcgatgaagccgctccgtctcttctcgtggtcggttctcatactgacgtccatggtgctgctgctggcggacgtcgatcccgtcgtctcctccaccatccctggcagggcatacgatcttcagcttcggcgactccttcgccgacaccggcaacgacatcgtcgtcttcgccgccaactcgctggccaaccccgcggcacggctcccctacggcatgacgttcttcggccgccctacgggccgcaactccaacggacgcctcatcatcgacttcatcggtaagcagcagatcgagccagagaaaagtctgtccacatatcctgccaaattagtctctgttggtttgtctaccgactcagtcgtgaaccgccgtgacagctcagaagctggggctgccgctcccgccgccgttcctgcagccgcagcagcagcacgacggcagacaaggctccaacttcgcggtggccggcgccttcgcccgcgacgccagcttctatagggacatccccgtcgtgggcgcgttcgctctcaacaccagctctagcgtgcagctgcggtggttccagtcgctgtgcggccgccaccacccttaccaagctgatgagtgccggggccagttccgcgacgcgctcttcttcatgggcgagttcggggtcaacgactacagcctctccttgttcggcaagaacctgtcgcagatcaggtccttcgttccggacgtggtcaaaaccatctccacagcaacggaggtaatgctggctgctcttttttcacgctgcatgtgcatgcatggccatgggctgctgctgctagctgacagctgactgcccatcatgccgcgcgtgtcgtcaggaggtgatcaggcaggggcgacgacggt

SEQ ID NO: 1361 - DNA, 1816 bp, Zea mays
  misc_feature (1)..(100): optimal_loci_92962_G1, chr3:4718187..4720002, Cluster 8
aatacccttctctggctttgcaaaatgtgattttattcatcgttttttaactttgtgattttaactctttgttttgaaaacaagtcgtcgttacatgcatgcagtgcagttgacgatgttaaacctggtgctcaaagaaaaaaaatgcctatgcgatttattatgattttattcgacattatattatgtaattgtgatttttacccttgttgggttgcgtctctaagaaaagaagaaggctagtttggacttttcattcgtttgttttcacatttttaaaattttaatcactaattctgattttcactagcggctttgttttcaaaatagaagggtaaaatcacaaggttgaaaaaacgggggtaaagtcacaattacaaggtccatgaagggtataatcacaattgtctcaaacatagaacaccaaaagatgatgtctatcccgatctaaaagtttgatgtagctgtaattaatagaatcagtaaaagtcggtacaaattaaagctaagacttctaaagggtggtagctctcttgtcgagtttctgcgtgcattcatctcgctgttgtgggttgatactgacatactgtagattctggccggtggatacatcgcatcgcatcacggcgcatcagcacgcagcaatgcactatatatgctgcaagaagatgtggatgggtgtcctgtggaaaggacagagctttggtttgcctttgcagggtgttttctgtcccctcatttggctgcgatggaatgggaaacccgccggatcagatgcccgtcgtcgttaataaatcgtgtaacagcaccggctcgatccatctcgcgatcattccgaccaattttaattactagcagccattgatagcacgaccagtttatattagctagcatgcagtacaaactgcagggtgtcgccgacgttgacgaagaaggcgtccccgtcgagcgggacggaggcccaggcgccgtcccgcagcgcgacctccaggccggacgtgccgttggcgcggagcaccgagatgatctgcgggtcgatgtacaactgtacaataatgcatgcatgccgtggcgcctgcacttgtattctacggatcggtcggagtacggtacgtacgtgcatgcagtacaataatgcattgttcatgttcatgctgtgttcttctgcttccggcctgcagaggctctgacctgcgaaggccaaagccatgcatgcaaagcggacatcacgttacacacctgccggccgcagctatatatattggccgtcgcgtcagcgtcgtcgtcggcggcggcgcttttcgttgtgcacggcgctgctagctgcgcaagcgtgccgccgtcagtgaaaccgtgtcagcatgcatgcgcggtgactgtgatctcgacaggttttaactcatagtgcatgtcatcttctgtaggagtaggcctgccggttatcctccctgttattctttttctcttttttccttcgaaaaaaatacatcttattacattcctgagttgttgtctaactctataaatttttttcatactcaaactccaaaactaggtaatttccacacaccctgcaaataattttgaatccgcttagactgcctgcctctttgatctggctagaagtgggcctgcctgaagatgatgacggtggacctcgctcccctcgatcagtcccccctaacaactccgcatggttgttctccctccaactccaacagttcttattcctccaaacggtacgtggggcttcgctacatatgttcttctcccttcgagcttcgatggttgtaaattacttacaaaaggatgtcga

SEQ ID NO: 1362 - DNA, 1521 bp, Zea mays
  misc_feature (1)..(100): optimal_loci_93007_G1, chr3:4868456..4869976, Cluster 8
  modified_base (782)..(782): a, c, g, or t
  misc_feature (782)..(881): n is a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
  modified_base (787)..(787): a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
agctaattcgaagtcataattaagatcgagtagattatttgtcatgtggtattgttgtttatttccgccaaaacataactcctcacacttgatctgttcaaaggaaacagtgcttgatttccagacatacaattacagtgtcatgagtttattctcattatcatactagctaattgagtgtgttgattttctgtagcaatttggtatctcttttggggcagccacgcgcaagaaaaaaaggctaaaaatactcttctcccattgtagaccaaatgccaaaattcacacgcacgtagccaacgactttgctgcaaaatgtttctgtttggctgctcatgttgaaaagtaaagtcttggtgccactcagactcaggtgcataatccacaactcccgtgaacacacacatggtgaattggtgatgtgatgcgatgggagagatagatagagagagagagagagacatataagagagactgtgagcgggagcaagcacatgggatgaagccctttgctgtgaactgcaggagatgatgcaagagaaacagaagatcgagttggcatggcagttcctttttatctatctctctctcttccttgttacctcacacacatacacgctatcatgggtacaacaggatggagctaacaaccccccccccccccccccccccccaaaaaaaaacccacatatatggtccttgaaaaagctagctaaatgtgcttctaaccaagcagggtctactcaattgtttccatgggaagagatataacgacgatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccccccaaaaaaaaaccacatatatggcccttgcagaagctagctagatctgcttctacccaagcaaagacaaccaaaaggaaacccaagggaggagatgcaaggacgatacatggatggatatatagatgccttatattttttgtgtgtacaaacatgcttgatatgcatgctgcataggagtatttcatatcacggggtgtgcgagatctaaagcctgcacgcatcagccatcagctcgatcccttctctctctgtctgtcgtctctacagctctgtcacacacatgaggaagccagggagctagagctaacacagtgagaaaggaaagggcataaatacagcaagaaaagagagcaggaccaccaccatggccaaagaagctcagctctcccctctcccttgcgctcgatctcacgagtcacgacgactcacaagattgaaaggccggctgagcacatactaccacagtacacatacagcaagctctgtgctagatctacgcaaacatctagctcacctcacagggagagcacacaataaggggggaatggaaatacgcagaaaggaactgtggcgatttctttcccccggccccctgttgcatgctctcttctcaggaacaccaaagc

SEQ ID NO: 1363 - DNA, 2006 bp, Zea mays
  misc_feature (1)..(100): optimal_loci_94314_G1, chr3:11216826..11218831, Cluster 8
tgtcttagtaggcctccaggaaaaaaaatagatatataaatataaccaagactgatgctgctcagtagtagactgatatcaccagatcaggggcacaggctgcggaaaccatatacacagctcaagctagccgccgtccagtccggggtagtgaagacacaggtttcacaggcaagtggtaagtagcataggcatagcatgatgccgatacgtataggtaggtgtagttgccagcatcaaagtttcaagtgcagagctcctttttacctctttggtgaaaaaaaaaggaaggcaaaggcatttgacagagcaaacagtacagcagccagccactgcactgcccaggtggagcgcaggctcttcttcccgaggccgggttcaatagggcaagcagaaaacacatggatgcactgcacaacgtccaacacaacacctcattgcgttgcgcatctgcccacaagatattaccaaactcctcttgtgccgtcgcttcactactctactactaccagccaccaggattcggaattgtaaagcagccaccggaccggaacaacaaaactgaaaaaaaagcgaacctgttgttgttactttaaactgccgctctgatgttctacacaatgtcatttaattcgggaatttgggccagcggcgagtggcggcgttatgggcaagaaagctctcatctttagagatctccaaaggggtccacaccctttgttcttcctctcgaaccgagggaagttctagatttgtagctcccatgtgtttctggtccccataacggacggcatgtgccagagggcatccttcctccttgccctccatgcttgtgaggtggcattttttttcttgctatatagcaacgagccataaagaaacgaggcaattggcatgcgaaagagcatgtgacccaagcacgctgcataatcacctttgcgattagaataagcatgcgatgggttttaaccctcttgattgtttttcatgaaccaggggtcagggctaactactgtataatactataatcacacacccgccgcgagcatactagcgtcctccattagcccctagccgacaagcgaagcatgctttttgtatcaaaaccagagggcctagaaacacctttaccgtcacgacggcagcatgaaaagccgtgaattgttgtaaacaattgagcaactcatgggcgagttttaaggaatagtgtgtgtgtgtgtgtgtgtgtttagcagccgaactagtagaaccgttgcacagcaccatggtgtaaaaaacatctgactgcatgggaccgcattgacatttctaaatgatcctactgtttgatgcgtattcatgacatgctgcaaaagtttgcactatatttctgcatgactgggaggcttactttcactttcgagctcatcattcatgtgactgaagcatgcaaagagaagccctttgcagtagcaaatgataggaacaccggtttaggactcaaggatggattcatgttgcaggatgatatatggtttcaaagatggatatttgcgagcagcagagagagggaaagtaagggtggaacgggacaagtggatctcttaccagggaatcgtctcttgtcctttacctggtactacagtaggtaatttacctactgtagtaccttttgtttgctgatgatatttctgcttgtacatctcgccaacaatctccgcctctcatcggctagtcaactatgtgaatctctagaaaacttctttttcttacaccaatcaatgaagatattcagtcctcatgctgcattatttatactgcacagaagagatcgcaggatcatataaaacttgaacccaacccttcaacagtagcgtatattatggtactgaaattgccagctaatgcaaagtagtttaatcatagcacactccatgtgacgaaaacagatggcacttctatactggcattttttttactatgttctacaaaataatgggttaatcggaacatatgcatgtgtacta

SEQ ID NO: 1364 - DNA, 2038 bp, Zea mays
  misc_feature (1)..(100): optimal_loci_9573_G1, chr1:50684824..50686861, Cluster 8
tggacgagactgtgagaacactagctggaaatgggacgaaaggatctgattacagaggaggaggacaaggaacaaaccaggcaggctctgacattttttccctagctactctggaatcatcataccagaaacaaaagacttctgcatacaacttctataagctacatagattgttcctaacactgttttggttcaccctcaagtggcatttgtggctgttagaggaacatgaaattttgttggaaactagctgcaagtatcaatagcttgtcttgactgcaaggagcatagtccagcaaccagcctattagatttgatatttgaacatgatatatcagataagtatagccacaatattgctgatctgtataaagacatgatttctgctcatattatcaatgaaaccctcttgtggtcgaggttatccacaaacacatgcaaatactctggtagtctggtactagtagttagagatgccttatatggtcaatatccatgattcattgacttatttgtttacaacatacataaccctttacaaattcgaataacctgtgtgtaggatgtcaaccgtataacttatgttctgtaacatactttacgttgaataaatttagatgtattttatcaactgcaatgcaccctacacttgtttccaaccaaatagatatacttagatggcatcatgctgcatcaactgactccatatcatgagaagttgggatagttaactagagagtgacgttcattctagcaatctgtctttgttggggggctccgaactgaagacattttattagataaatctgtccgccctcccttggaggctctggactaagattcctaattctgcttaccctctcctcctctatgcggcttatatagtcctgccgcctaatacatctaaccaatctcctatatttaagctaatctccctaacccttaacagctggtacacccccatttagccagctgttgggatatctttgggtgcctatgcttagtatgctaatacgtacggcccatgagccatgaaaagcatcaataacagtcttcaaaactatttatactttaaactataaattcaagttcttaatttatcataacattgtaaaagtacattatggttttctagccacaacacacaaggaatatgtatcaggttcaattcatcaaccaacaccataccacaccatcttatatttagatgaaataagaggcaaatgaccatgcatgcaagaaagggaatatgtttggggggggggggtgagtcagcatttatctgaaaactgaggtggtcaatgactatgtaattcagtattgcttcacctgtatgtctggattagtggattaattcagcacccttggctttatcatatcattgtttatggtagatggaacaacaattgactggaaagtgttcatgcaggtcctaaattcaccatgggatgtatgctacgatcccgcagaggaggccgtgtatattgcaatggctgggcaacaccagatctggaagcacaatttacatgatggaataaccaaagttattagcggtgatggctatgagaggaatctgaatggctcaaggtaacagattctggcattatctgtcaggaaagttctaaatgtgctgttttaattggtcttacagcgcagtaatatgtttatgaagatggttaatgacggtttctatctgatgagtggctaatgatatttttggcgatatttccttgtgataaatacatatgtttaaaccgctttattttatccgacaagtagcaaatcctgtatggatcttggagctggagctgttccaaacagtgtaacaggccctattttacagcttgaagccatgtttatttttttcctttttatgctaatttctgtgaaagttgaagtagaataaccattccagatcttggcgtacaggcttgcttcttatatgatcagcctaagacttttcttcctttaatgtgttcatttgtctcctgcacatccttgcacttgatttggttaatactttgaagttttgaattta

SEQ ID NO: 1365 - DNA, 1653 bp, Zea mays
  misc_feature (1)..(100): optimal_loci_95748_G1, chr3:19093504..19095156, Cluster 8
acagataattccaaccgtgaaaaggttccttctgggactggaaaggctaaacttagagtgcatgaggtgagttgatatcttgtctttacattcaaaaaagttgatatcttgccttcctattgcactgccttgtcaaaaaagaagctttgtagtgtgcaaattttgtcaaagactgactatattattgttttttaaatatattaaattttattatgatctcccataatagttgagattatgcaagcaaacataccatgaacaatacaatttattcatagaacccctcagttttaaatatgtttttggtttcagcaccagtcgatgctttccaggatcatacaaaagccattaagttgcttcacctggagtcatgtcatctcttttggaactatggggaatttggccgtcgatgtgggtcaacacgaaggcacaggtagctctgcattttccctcacattagtttttgctgctattgtatgtacttgaatcaatcatgtcccattaatttcttttttgaagaatgtgtggttagaagcagtatgacgaacctaaagtatataatcaaaatttctggataaattaaagggtatatttttgccaggtggttgtcggttagttttgattaaattaagttgaatgagaatgagagaatgtgcattaggtacttgttatattgttaatcataatagggcaaaccaagtctttggctctaatatatttctatgctaaagtcaagactgtcttagcacatgggtaggcctgtgattttacctttcccttttgggagtggcgtaggttcttcctacaaaaatagaggcaaaatcacacctcctaaacatcttttgtaatgttctcttttgcttgtaagttagcatttctcatgctagcacacaacatgtaaacacaatcattttttttttgcaaaaagaaagtaggctaaaagaacgacaacaaaataaaaaaactatgacactatcttacttcttgtattgtccatcccatgaccctaaggttgcttgtccagactgcacttcatgaaaagtgggtagctgttgagatagaaaattaagctggaactgcaatgagtcgagcaattgcagagcatcctgtgcagaaccattaaatcttggaagagaagttgcttcctctattcctttctctgttttttccacatgattcaattgtagtaatgctctcctcaagctatgaaacatattatgaaaataactaaattgtgaactagatgtttgtttcaaactggttgcttgtgaactcaaattgaaacttgggacacaatctcggcataaaaacttgtgagcttggccgcttgggacagaaacttgggaaaaactagggaccgaaacttgtgaacttgggatataaactgaaactgaaactcggcatggttctcataaactgaaaccgaacctttcaatactaggcatggaacataaatcacaggttcagtaaataaatcacaggttcagtaaatgagtcatcggaccttacctccccttcgatatgtactatggcggtttctatgtgctcgtgtggcatatttataataatattgcatatttattagtgttacggtgatattttgccaatggattttgcatatcgaaatggtgtttatcgttttgtacctatgtt

SEQ ID NO: 1366 - DNA, 1696 bp, Zea mays
  misc_feature (1)..(100): optimal_loci_96491_G1, chr3:23181104..23182799, Cluster 8
aatgaacagagtaaggtcaatctagctagctagaagcctttttttcaagaaccatatatatagaggaagagacgaaggactgtacgtactaggacgaaaagattcctatctgccgcatttcctttcatttttgttaattcttgttccgacaaacaaagtctggatccagatggttgcttaaccccgacaatctgtcgccgttgtcaacggatttgtccccttgtttgtgtaccagtcagcagaagatgcgagcactgtactgtactgcagctgcagtactagtccagtcattggctggctagctcctactatacatactagtccctggaccctagctagttcctcccttggcattgcacatctagtaggttttcaccggctataggatgattgacagcacacaaagtggctgccaccctacgatctgatctgatctgatcgctgtgcccccgggtgtttattttctagagccgcggccgggtacacggacggcgggccgatgggccaccagctaacaggtaggagtaccaggctaccagcacatcacagcaggccggccagccggccggcgggcgatttgatccagctccccccagccacgcttcgctgcatgcatctgatcgtctgatgggacggatacatacacgcaacaggacccagtgccagtcccagctgcatgcatgtctctccagctcgaaagcctgaaaccatacgggcttccttttgatggatgccgatggaacacaagtgtgtgcgccaccagcaccaggaacagccgcccggccggctcaactgtctactgggatcagactactaacctctgaacccatttgaatttatatatgtaaaaattttggaggcaaagggtttgagaaaaaacgacagagaagggtacgagtcgccatgcaagcacgtactatggctgtacgtacgagtgagtagctagtggcagtgtaggacggttggacctgatctgtttcctctctgtcgccagccaccttgacgatcgacgacacaagtcttttctcgctcattgttctcccatgcctttccagctttcctcgtcctttcttttgccaccattcttttctctccaaatgctacctctgccagccacatccatttttttcggtgtaagacttgcgtttataacggattttccaagagtttttttttgggggggcgagatatgtttgattcttttcagggaacccgtaaggctgcaaaacaatctgcaaaactcataagattctttttttttttgcttgtaaaaaagatgaacagaagctgagtcaaggtgtcaagttcacgaagaaagactccaagtctccaacttatgactgagagatctaggactttgttcagagctagtttgatagacattattcttgagaagctcccggaactattttgcacctttttctatcaaacaagtgaaaagcgaggtacccacggatggatctcccgaaatcccactgagacatgcagctatcacacggtagattcaaataggcagcttcttagggttatatctattcgaatataatataactgaattatctatctctttctattagcttacccttttgggtagaactagttggtacatgcaacttaatatggtatcagagtcagaggtctaaagttcgaatcttaactaccagcttaaacttttatgttgaactggagtaatatg

SEQ ID NO: 1367 - DNA, 2222 bp, Zea mays
  misc_feature (1)..(100): optimal_loci_96877_G1, chr3:25356184..25358405, Cluster 8
tgttgtgttgtttaactacatctcttaatcaatgtatctaattaaaaaattgatttcacatttgtgttcctaatttttttacaaataaaattagacaccacttgctatatatttttatttcatttattctaacaattaattatttttagtcccattttattttctatttgccaattgccatatctcttctttgaattaataattcatttttacaattccagtttttatattttctaaaaaatatttttttatttcatttattataatatttaattattttttatctcatttaaattcctatttgtcatatctctttattaatatatcaaacttagataagcagcaaaaagcaaggtccaagctgcttttaaatttgtactataaaaaaactggtttttcaagtactactagaaaagctaaacccctttagttcagcttctgtttttttaaagtagaagcaagttcaaaaaactgaacaaaacacaccataaaaaacttaagatagcctcgagcattgcataagaagattttctcacacggttcgaaaaaacactcgaacccttgccccactcagtggtaccgtagcacatgtaagaatgatcatgactggggccggaccttagacttgtactgtggcatacaaacgggggcacttttttaacctcaaactgaaaattcactcaacgggaagtcaaaatcaggacttgaggaatgctactcaagccatccaaccactcagctagatgccctactctgactaatcactgctaccagattaaaaggatatgaattagcttcaaaaagtttctgcaactgcaaggccactgctacagagcttccttcagaaagaaaaccacaaattatgttttctttacatgcgcagaagccagaatattagaacatgaaacagatacgcacagttcagaacaataactgcaataccagccaggcacgaagcggcttgccaattcctctacaactggccttagaggcagctctataaagtatgagaaaactattaagtgctgtccaaaaagttcatttggtgtacttggcaatatgtaatgagcaaatggtattatgagtcatctagtttcctaattgaataaatattaccctgaactttcgggactacaggtgatattgaaccttgaactcatttgaatagacaatttctagggcattacttttttctctcgagttgcgcatcaatataataagaagaaaaggtgggtccaacgtagaccagtacaggacacttatattattaatgaaaaaggtacacattttttttaacgaacggtgagattggcagcaacactcacaattcttgcttgcaatgatagtgtccaggtctgcatcatcttgaaatcttcaaccggattatttcctaggtcctttcaaaatgttaatcaaatcctaatatcattccacacctatttgcatctgtattgctatactatcctgagagtccaaccaaatcagatcctaaatcttgaaaaacaattgaactgctattcatacaaagcaaccaaacgtccagaatgtagcgacttgagtattgtacacatcttgcgggcaaaacatataaaccaattaacagatgcaagctaggtcgcccgtacctgcaaaagaagtagcttaggcgtcgcaaggggagcaccacggcggtggcgtccgccacgttgtggcattccctcaccgtgacgccagagatgaaactgcctttagcccttcacgacataccacgtgctccacatcaccgttgtggatggccagatgacgggagatacggcggccgcggtgagcgcggggccgaaggctggacgagcggagcagccgaggcgtggggccgcaggatggaggagccgaggtgctcgggcggagggtggaggccatgcagtggaggaacggaagacggcggatgagcggacgagcggaggaggcggagctggggtcggccgcgcgggttacggggcggcggcgggactatgctattttggcgctcgcgttgtgttcgtgtgtttccttcctgtacaaattccatcgaattccaagctatactagaaaattagacgcactatatatgccctacacataaaataagcaatatatgatagttttttccacgaacaatgaaaccacaaatgataataaattcaaggcacatgatattttagcgtaagtgagaatagtattaatccttcgactatgcaaccagt

SEQ ID NO: 1368 - DNA, 1481 bp, Zea mays
  misc_feature (1)..(100): optimal_loci_97398_G1, chr3:28217368..28218848, Cluster 8
caacactagacagcgacacggttttatatcgatttcgtacttttcggtgtccactttgcgatccgttcgtttttgctggtctcgtgtgagtcttaggaacatctttgaaatcatgagatcactggttttgctgatgtgtttttggttcgagcgctttcatcatctcgattgaagtgaagtgctcaatttcagttttagcgcagcaaaagtttgatcgactcccattcacacccaccctccggacgcctcatcggtcgttgatagtatagttagtatttttttaaaagtgtttttattaaacaaatttgcttgttctctatgtttgttattaggcttaatcttgtatttaagtgtacctttagagcgggtccttagccttggtgaggtaggacgaacgcaggtagcagcatatatatatagcgccaaaacagcagcagcgcgcgtgcgaaactgatggtgtggcaacatatatatatataaaaaaaaacagggtacgggttggtgatccgtctatcagatcatgagatgcaggcaggcaccctgggctgaaatagacgaaagcgaacctcaactaaccgacgccatttcatcggctttcgtcttcttcttttttttttaaaaaaaaatgatatgatctaaccgaccgtactaccacgcggtggatcgcggcctcgacccaccaccactgctccacctcccaagctgctggtggatacactagtatctgaaaggtgctgatctatttgtcgtggtgtgctccttgttgccgtcaccggtaataataaggaaacagcagggccgggtaacgttttagtaatcagtagtcgtgcatacttattatgagagcagtatcaacagatttatttgttgcctatagcactatcaacaaatcagctcggacatagcaaaacagtacgtagcttcctcctcggatccactcctccgttccgttgacacctgcgttaggtgataggcgaaataatgcaacgatagaagacgacaactacggagaagaagagcgcacgcgccgagcttgtggacggtggcccgcgagcccagtccgccgccggggccggggtgcggaagcggtaaataagacaaaaaaaaaatccacacacgccggccgagagctgtaagattaccagcatcgccatcacggtgcacgcacagcgatccgtcgtcggccgatccacatccacgcacccacctgaatcgcccgcgacaccgactggtacggtcgagttgccgtgggctacaggaatcctacgtgtctcgccgctgctgtcgccggggggcggccgccatgcatccacgtcgccttgcgcgctcgatcgcccatgacctcacggattaaccagccacgcgatttgcgtggctggggattaccgattagctaggtagtcatcttgtattcgcagacgtgtattcgcagacgtgagcggatggatgagaccggagagggggggggggttcattccaga

SEQ ID NO: 1369 - DNA, 1388 bp, Zea mays
  misc_feature (1)..(100): optimal_loci_37146_G1, chr1:223833176..223834563, Cluster 9
agcggcagagcgggggccgtagctactgactcgaggctgctcaaggaaaggaaaggcatcaccgacccaaagcgccaccattggttcacgctagcagcaggtgtgcaggcctgtgcaccctcttattggcctcgctcgccgctgtgaaacgccgaccaggaggaagaagaagaagagcggcggatttagtggcacggccatcatggatgcctctgcatctctgattagacggaaccaaatcatactacctagtatcgcgcgcattccatgcacggtctctcagctcgggtggcataggatgcggcagtttagtggcgtttaaggggggcgccgcggaaagcacttctttttatttctgatcagatgcctaggctcggttcgctgaactacccggcggtgtccggttcctcggcacggacgcatcagtggggcaaactgttgcgccacgctgtgcgcacgatctctttactaattttaatcgcggcgttagcagctaacctaggtttgtgtcagttgtggcgaatcaggtcggccgccgctttacaaatcacgacgcgtccagcgacctttctctggcaggccggggtttggaccgggcgaatgattggtgctggcacggaggcaccgggtcagaactcagaagtggcgtttggtttcggacccagacagatgggcgcatagccactgatcgaactcgacgaactgctccctgcgcggctttgccaaagccagaagaagcatgcgcctcccgttgccagcaccggcgctcgtcagccatgaatgcaggtttccatcggcgcggcggggcctgatccaattcacagcgttgtcagtggaggacacagagccctgacttcacaggcatcagagcatgagcagcaagctcagagagtcggagaggtcagagcgtagcatctgtagcaacaacgaagctccagctcctccgaacatctcgcgaacaaccggtcgccgacgacacgcgggccctaacgatgccctgagggtcttctacacgctgctctggttttgtgtactctggtcaggtgtatgctattgctgattgatcgacagcctgacacactaatttttttcccccagtggtaagtactttgttatatagaacgcaccccgatgttcagaatcttcggatcggcttgtttcccagttcctaccttccatgccacgagatgagatcatcgactactatttccctccctgcagaaaaaaaaatatatatatcacatgcatcttcttccattattgcacatgacatgagcccggtatatatatgcgctaacgaaacggcttcttcggaaatttttcaccatcaggatcgcaatgagtgagcccgcaaggtgaggaatggagctcccgaccgtgcggcttcc

SEQ ID NO: 1370 - DNA, 1191 bp, Zea mays
  misc_feature (1)..(100): optimal_loci_10884_G1, chr1:58458445..58459635, Cluster 9
tcttctctctacatatactttgacaccgaaccaaacactacctaattggtaaaacatctttttttttaggcaccaggggcatgctgaacctggcgtcgttgctggttgcagtttgcagcagcaagcgctagttagacctgccatgatacttggccgaaagcaggcaatggcgtagtagcctttacgttgctaaagccaaagcgcctgaaccgactcagcggcgggtcgttcgtctctggggaatctggcgcgaatttggtctgaacaggacacgtttggggcctcatgcccggccccgttcgtcccagtgaatccgacggcgaccgcctcctctggccgctgcgacccgccgctggcgccacgggacgacggcgaccgagcgctggaggatccacgcagaaaaccgtgtgaatttgagggggttttctatcgggaacagagattttaacatggcaggcgttcagcgcgcatggtgcggggagctgtagcaccaagcatatcctatccctctttcccgtccactccggtccggaccagaattaagtttcgtccagcaccatttttttttgcgtgtgttgtcaccggcggcgggaatgctgtcgctgttggtgctgaatggatcggcggtgcgtgcgtgcgtgctgcacaatgtactactacaggaaaaaccaaataccaaaccggctttttcggctcaaaacttcacgctgatgaagagatcattaagccagccggccaggcatttgttgccaacgctggcgcaccgtacttttttttttcttggcgattgggcatcgcgctggcacacgccaatgatactccggacgctttgtcgtgtatgttagcgaacctgttggtttcggttcaagaagggacgttcagccgaataatgaaccagcgaatcttttttttttttttgctgttcggtgcgtggcacgccatgtgccggctctgctgcaccgaaaggaaacgaacggagcagcagttttcaggtacgctcataactcacgcttgatccaaacgctaatcacaggtcttagcccggcccgagtacattccagctgcggttagaacagacagccgccgccgccgccgccgccgccgccgccgcctgcgccgagatctccgtacgctggatggaatagtagtcacggagttgtcgagcaaacgagagaatagtagttggtagag

SEQ ID NO: 1371 - DNA, 1234 bp, Zea mays
  misc_feature (1)..(100): optimal_loci_1098_G1, chr1:5582601..5583834, Cluster 9
acgaaggcccacacattgttcattcatatagtctccttttccacttgaagaataaaagctccacttccagtagtcctgaagacgttggcgcgcgcaatttcctagaaggagcagcgtacgggaccgtacgcccaatcatgcggctgtcgaaagggaccgtacgcccaatcagatggagccaagacccttcgtcaagtcctttctttaatttcatggtcggtagaaacgcacgcgtcgcatgggcgagccggcccaggcgtcaccgcgtcacagccgcggcggctccaggcacaggcgtcagcgttcacggctcgcgagagcgaatggcggccggccggtgtcctctgggctctggcctgcctgcctccaccatgacaccatggggatctttccttcgctttctgatccacgacaccaataatggaggggtggtggtcgccgtccaacgtcgacggccgcaccgcgcactgactcagctcagctccagctccagctccacacgcaaacccacccaacaggtcccatgcaggtaaaggtaaccacacgatcttctcgggtaggccacgccaccgcgtgtagttctataggaatataccatgtaataaaaaatctgatatggtaattaatttaataaaaaggaagaaatagtttctaaagaaaaaacgatgtcttcacgaatcacgagaatctagagcgaacggcgtcgcgacatgacacctcagtttctatcccttgccttcaaataatccagtgcgctcgggggcacgaagctacggagtggtggctgaccccgcacaagacctctagtggcgccgcgggagtccatccgcatggacaccgttgagcggatcccactgcgagcatgagagctccacccatggcccgagtcccgacgctagctattgcgcctccatacccgccgctcggtagctcctgtcgggcctgacgccgccatccctgccatggctcaacgcacattaccgtcgctgtccactagccgggtcgcaccctgcgttggctcatcgcaacacgaggctcatcctcgttggacaccggacgccgttcatggactcagcaccacctcgccccggttctctcggcccccgcaggatgctttcttatcgcgctctcgtttgtggacgctatccgaaaattaggcaatttcggtactaacttcatcgaaataataactctctacaattaaaattatgtataagtagagtttgaacattta

SEQ ID NO: 1372 - DNA, 1255 bp, Zea mays
  misc_feature (1)..(100): optimal_loci_118161_G1, chr3:161961982..161963236, Cluster 9
catcgtgtgcgttcttaacacgaacaattgcaagaaatgaaggccaatggcatcattccacccctcttgttcgttcgattttttgactgggtcgccgctgcagaaattcggtgtgccccgcccgcggactcattagccgacatacactgtctggtggggggcgtacgtgtcatgtatcttgaatgaagaaactgacgccacaggctacttgcattgcaggtgtccaagcaaagctctcggaagggaagcgtctcgagagagagagagagagaaaaatcaaggcgatatttttgtttgggtggtggtggtggtgagtggaagcacaggcagatcgacaggatcctgtgtttgggtctctgctacagtactgggtggagaagatatgataaacaagcacaggcagcggtctgctccatcccctagctagctcgcgattgacggaggggaagcgattagtaattagcgagggcgaaggtggtggtggtggtggtggtggactgccgcccctggttttctcccgtgacaacaccaccatgcatggctcacatagtccaagcagctagccaccttttttcagaattcctcagactgcatgcatgcatgcatggcaatggcatgctcgcgactccggctctctactaccggctgcgctactccagccgtcggccactgtgcctgagaatctactgtgccccccgagctgatccgctcgatcggacacgcactgttgccgtcactaactaactagcaggcaacaacatgctctctggtttacaccctgcgtgcgtggatttgtaaatactcctactcctatcctacgtgtaattatagcgagcgggaagctaaggacagtggggtgggctcccctgtactgtactgtaccctgtgtgcgtgttcctggccgcactactggaggagacgagggaatctcctcaaatatatacagtatcaggctcaggagggagcgtagtgtagacttgctattagcccctgttgtgctaaagcctagtaatgcccgtagaattgaccttcgtctcagatgctatcactgctgcttcggcctctgttctgcttgtgctagtacagtacatatatatcatccatcaccagtgacgactcccgtcaactccaattgcaataggctaatagccagtaaaatgtaaacagaaacatatgtaatataactccgcatctgcggttgcagggtgacgaggccaatcacagcaacagaaaagcaccattattcttttctcgg

SEQ ID NO: 1373 - DNA, 1202 bp, Zea mays
  misc_feature (1)..(100): optimal_loci_118162_G1, chr3:161968659..161969860, Cluster 9
gagatgcctcataatataatgaacaggtcagcttggggggcggccaccgggcagagagagatctacctgccggcggctgcgcgcgcgcgtgccttggggtgggtgaagcaaacagggaagatcgaagccaagttttcagcaaggagatgggatgggatcggtttatcaaaggctgccatacgtactatatatactaataaactacacccgatttcccacaggtgagattgtgagaagaagggtggcttctcagtttttttgtcttattaaaaaaatcccagacctcgctcctaggcttaaaccccatgcatataatccctcccttgaactagtaatcatcaaagaagcaaaaaaaaaaaaacaaacccctaactaccgctactaatactatagtagcttgcatcagccccgagaaaaccgccctgccaatatatcaaaggcaattgttaattaggcactcccgtcgtcgtgctctttctcttcctacgtactcgctattattagttgcgtgtggattgatttgattgtcctttcttccagacacagaaacagtctctggtgcaacctagctcgctcgtgggagtcgcgacgatcgacctctccgtcgccgatggatctgcttgcattgcagctcatcactccaatgatcggggcaatttttgctgctggcctttccgggctccaatgatttattccctgcgactgcgacgacgacgggccggcgggggcgggggatctttgcttgcaaccaaaggagcaggccacgatcgagggagtactgccgggcgaagccgctgcacgcaccgccggctgcgacgcaacgccaacgcaacgcgactagggtgtgggcatgcatgcagatgcaggccatggatcgatgagcgtggatatatacgccacggcacggcgacaacgtagggccctgtgtgcgtgatgagccgactgccacaccggtgtacgccgtgctgctgccatgaagaagaaaaaaatggtcccgatcgatcgcctcagacgtgtgcttccgtctcacttcacctggtctattgtatcaataactaccaacacgaacggggttttgtgtagcaaaacacacacacacacacacacaaaggtagaaataatataatccaaatacgaatccaaaaatgacgcgaattcagacgatggcccctcctcctgcctccaaccaagacgacccaacc

SEQ ID NO: 1374 - DNA, 1036 bp, Zea mays
  misc_feature (1)..(100): optimal_loci_118183_G1, chr3:162078012..162079047, Cluster 9
tgtatatacacggaccgattattgcgtccagcagccaccaaaaaagcagtccacaggtacccaccgtcgtacgaacacacatattttgagccaggccaattgcatctgatagagtactatcatggagcatggaccatgctcacccatctgtggatttgtgcggtttctatggttcaagaaggctgtgaacgtacgtacgtacgcggcggcctcccctgccgctcggctcgatccctgatggtccgcgtgctttgctaccgttgccagtctcgcgcgcggtccttgcaaccacgccggtgcagcttgcgatcacccgtcagccagcaccagcaccaccaccccccgtgaggacccgcggctttctcgcgcgtcgcttggggttgtgcgccctgccgtccgggccacctgccctctctaacacccgcacggctggcgcgaagcggaacgagcgcggcatctccgcggtccgtgggatgggtttgtgccgcacggacgcggccacggaggcccccccgcatggcacgggctggattcggggcggggcggacgcggcggcggaggcggtggttctggctgtcggggcggggagcgaggacgtgacagggttccgaggcacacagtcatcacacacgcgcgcgcgggacgcatccagatcggtcggattgccgacgggacgggtggatggaaggggtccccgtgcaagggctacggttggctccatgcagtgcccccatgcacacgcctagctaggtgcctccgctgcctcgggtctacgagcgcccgcttgttgagggagctcgtggtctctatcgaccaccgctcgcttgccgcccgcggtggtgtgtacttggcctaagttcttgtgttgtagctgtactactgtgcttttgatacaaagactacacagctgtcggctcggttcacgtggcctatatagacgagcatctagccacaggtccagatgacaaattcgtgaggcttaattaattgctgtttcgcctttttttgatccatattaaatgtgcctacttactat

SEQ ID NO: 1375 - DNA, 1159 bp, Zea mays
  misc_feature (1)..(100): optimal_loci_118184_G1, chr3:162079157..162080315, Cluster 9
aaacccacgtacaaggaccggtttattttcaacagacctcacacgtaacggacgaaccttgatgttgaaaaaaagggaagcatgcgggtactgcagtcaataaacccaaccacaaccaacacataaagacgggtaatagcgctgcaccgtagcacgttgatggaacgaggcacgcgcgcttcaactataaagacgggtgatagatgcatatgcagctaaaagcatatcaatatgccatacggatacgggctagggtgcacgatcaccctcatcaaaacaccgagagagaaggagaaaaaaaaagttgtgtgcggactgtgcagagacccaggtcaacatggccttcgtttcagcggaactcacgtcatctcatctcaccgtcatgatgccctaacaagaatgaaatagcagcagaatcgggggaacagaaaacggaagatactcttaacgggctccgaagcgtcgactagttgcccatcagtttctcgcgtcatttgggccattgtattttaggcccaatttgtcctcgtccacacgcggtcagcccgaacaagcaattgcaagacaggaggcccatcaaagtagcccggctcgtaacatgtcatgtcaccccctcggtcgtccactggagagcctcctgctgctcggcgccgttgatttccagtttgttttcagcgaaattcaggctcataccttctctgtgactctatgtctgtgcacggtgcgctgcatacttgtcttgaagcctttcctcatataaaaacaaaaaatgttcagctgcgggagttcgacatgtgcaacgccaagaacgaggtggctgttgcaattgcaatcgagcccaatttcccggagtgcttcaacagcatggcgagtgcatggaggggtgaggccagtcttcatgtgtccaataaaaatatccgtaaatatatagatggtcaaggattaaatttgtttttggtgtagatgtgactttccctctgttggctgctagaaaaacagaagcaaataatataccaatcttgtgtatggcttcttagtctcacctacaatggccacaccactggtacatagatatgaaagtttagaccggactatttaaagctgacatggcatgacactgtataaaaataagagtccaaattacgacccgacacgaaaa

SEQ ID NO: 1376 - DNA, 1270 bp, Zea mays
  misc_feature (1)..(100): optimal_loci_120143_G1, chr3:174783801..174785070, Cluster 9
atcatgtaccggtagcgaaaaccagtgaatactggagtagggatattccaacagaaccggtataaattctcgtccaaaccttaaaacacgcataacaaatttgctcaacagtatgtctctcgtttcaaactccgctagccatagctttactgctgcttccacgtacaacctctctcttttccatctgttccctcggccggaaaacatgatggcgcagccaaatcatggagccagcgctttcattcggcgccatgccgccatccatgtgatcgtgtacgtccccgcggcggtccgccatgattaaccgggcgctaaaggtaatcgctaattaggcgcggcagctttgtttctggtactgtcttgtgacaagcacagatgttcagataatgcatgtgccgggcgacaagcaggtgctgtgcatatctcgctcacggggcagccagccgccaggcaggccggccgggtgccaaatgccaaatgccgcggcggacaccaccaccaccaaactgtggaatgtggcctcgtgtagagccctagccggttgcctgcaggatgcaagtatgtacgtgtcgcgcggcgtgtagcccgtgtgtggccgtgtcaagtggtggtatgggctggtacgccgcgcaactgcacgtatccttccaccggccggaccggccagtcaattcctggacctcggtagtacgtgtacatgacagctcaggcgggatgagccggccggtgcgggggccgccgagactgcgcgcgtgagagcgacggccggacccggacgtgtgcgcgcgcggcaaccgcgggggcctgccggtgaggcggtggcctgccgactctgggaaagctgatgcgtgcgtaggtagcctgcgctctcttcatgcatggtggcatccagatctttccctcacctgccgagcccctcgtgcccaagcccacggatgagctgtgcgcgtgtgtatggtcaggccattcctgctgactgctgctgcgtggttggaacgctcgtcgagtttgccgaccgacgatcgcatttagtacttgagagggatgcgtcagggtgtggacttcgctagtgtatctgtagtgtttttttttgggttcatgtaggcggtgacggtgagacgtgcctgcgtgtgctagcaaatgaagaagatctttgcaagtgcaattagagcaatgctaaccatccgtcaatccgtcatgtctatctaacttgtccagccaacgcattaggctgccgtaacatcatcatggcggtcaagggatgcactac

SEQ ID NO: 1377 - DNA, 1024 bp, Zea mays
  misc_feature (1)..(100): optimal_loci_121020_G1, chr3:179502702..179503725, Cluster 9
gtggaatgttaagtattattgggataatactctcacattgctaacgaaaagaaatgttaatagacttaaataatgttttagtggtcatatattgagaaactgaaattgggaaggacggagccacatgcacaccatggggtagaactctcacgtgaaccaatcggaaagtgagagctagggccatcacgctcatttgttactggagcttgtaattttatttacatttgtgtccaccaattcatcatacttaaactaattacatataatccacttcaacatatatggattagtggattacactgctgatgcgaggagaacgatttcccacttttatgtattgagagagaaaagactacgtggtttcacaactgatttgattggcgggggagagatgggtagccacattgtgccaaaaacacaaaagagctcaaaagtttcgccccgccccgctcactccccccacgtgacagcagcgcagcgcagcgcagcaagcgaaaacgtgcgagtctagcagtacgtactgttgcgccagtgcagctttactttttacctgtgcatgtggtcacacgaaagattgcacagtaccctaaagcgacactggcgggcggggcccgacccaaaggctcactgtgcttctactgtgcgcccggtgttcccactttcacctgtttttattatttatcatgcagatgctatagctatccagtctagtctaccctgcctacagtagcaacgaaagcataccacaggccggaggagtggttccttcacagtcaggtaccgtttgtggtcatgcactcccatcacactgagaacactaatgggcgagaggagcggccacgtcatattcccaggccttgcaactagcctagccctgcacgcccgcccgccctcgtcactccaaaaccctgcgccattactcagcggcgccgtaatcacgccggatattcctatccccgagcgacgcgtcgcagctgacgtcgtctacggcctgccgcttcgcatggctggatcctggtcctgg

SEQ ID NO: 1378 - DNA, 1092 bp, Zea mays
  misc_feature (1)..(100): optimal_loci_121718_G1, chr3:183133480..183134571, Cluster 9
tacgttaccataaaaaaaaaaaccggtgtcgtttactactccattgtacgttcaccgtaaatttatatgatcctattaggcattctaggtgttaacatacatgacaagttcacttcagttctgtttacatgagcacgggagcacctcacttgcagaagaaaagtcacacgtaccggttggaatgccagcagctggttcgtcttctgtagaatgtagtatgtgctgctactgtgtttcacttgacgacattttttgcaaactaaggtgttgtcactacgtcataagcgacaatgggaatgagaactgctagtgattccccgcttctgttgtgaggcatggatggaagataccggtgagccatctaccaccaccaagtgccaactacagtatgcctgaaagaggggaggggctgctgcccaactatatatatatgtaacgggtactacattagtaatatccacttgtgacttgtctctgttcctctcaggaagcgtgtttgagagaacaggcctgaaacccgggccatgcttgtgtctgtcgtcctgtccagattccagaaggcggccatgcatctcgcgcctcgcgggagcttctcgggcgcaggctggctacgcagaaggcggccacaaccataagaaagcgaattcgatgggagacagcaaggcaatgcagcaccagtagctaggccatagcatagccatgcatgggggcgtcgcttcggctatggtaccggagaaacagaaaggaccggatgcgcgataaccgacaagcatccctggtgctcgtcttcttccgtccgcggtttttctgatagaccgattggtacggtgttcggttcaggacttcaggtaatacacggacaaaaatacgtaaatgacggttgacggactagctcgctgttggaagctcccccgcctacaggctacagcacgtatcattggaccgcaacgccatcaatccatcatcattggtagttgaactcctgtcaaatctcattggctcttggctcacggtagagtagcacagacccttagcttccccaatgacaagaagccgtggacgctcgtgacgggaatggcttccaccggcggg

SEQ ID NO: 1379 - DNA, 1323 bp, Zea mays
  misc_feature (1)..(100): optimal_loci_121719_G1, chr3:183141723..183143045, Cluster 9
tgacaagaagcctgttgtgcgttgcgggccactcggtgcccactctcaccaatgtcatttactgctcatttcgtgcctcctgttcctcgcgtcatgtgacccactgcgatccaaaatgcattatttttttggctgttcacggaagctatttgaccacctaccaggaaaaaaaaaattgtattcgagtcgtccaaaacctcccctccagtccccagcttataacagcgacttctagtagtaagtagatcgagcctacttgtcctgctttgctttgccttccatgcccggactgccttcagatgcatggtttggtttcggtcgttgatgatttgcagagttggttggttggctcgcttcaaatcagagagcgactgctgctgctgcagcgagcgaacgccaccaatcaaatggaaccgtgaggggtcttcttccgttcttcgcttcgtcgctgctcctctttttttttactctcggctggtaacctcacctgctgaatgtactattgttacgtgcgttcgagagagtttcgcgacggttcatggagcggtggtggactgctactactacgcacgtgcagacttgtctcggccgtttgagcgtgagaacaaaatgctcagtcaaccgtgccgtgcagacttccaaccccctttttttttgccggataacttgccatttttttcttttcgtttttttttggaacgcgccatcgccgtgcgcacgtggccatcacggcacaaagcagagcctgaggccgtccggcaaatcgcgagctcgccaccatggacttactggctgtggacggacgggacacgcagacggaactggatacctgcgcttgttgctgtcccgtcccgggtggttggcgcgtgcgcgtccggcttcggcaggcgacgcggccgcctccgcccgccgtgcgggcggcatcggcatcggcatcggcaagcagccctggaccacggtcacggatgcacgaagaagcatgtccatgattagccttctactatcatccgccagaacatgcaagattatactcctacatgcaattggtccggtcccgtcggtacgcagttgctatagctagttggtgctggcttcagcttcagcctcatgcgagctctggtactctgggtgcacgtgaagttctggtccgtggtcgcgatcgtacgtacccttgcttatatgcgtgcatggatcaaacatcaaggtcatcacgaaccattgggagttggggggcaacagcggtgcgtgccaattttcctgcgaggattgtggtcccaattccccatacaagtcaaactcgccaggaggagatcgacccgtaca

SEQ ID NO: 1380 - DNA, 1123 bp, Zea mays
  misc_feature (1)..(100): optimal_loci_122629_G1, chr3:187617637..187618759, Cluster 9
agcgaactgtctttgggaggccttctcgaccgccttgccgagccgctcggcagagtgactggttggatagtatgccgtctttaaaaggcttttttggggcacccggtttctaggtacccgacataaaccaactcatacatatggacgggtaaattaagctaaaaatagtttacagtgtcatatgaacatcgtccacatgcgaggagagtaattttggacttgttccattcatcaaggttgaaaatagctaacttcttgagaatagggtatctggattcttaacagcggcgattgacctgccatgccggtagttgttagttgttaccagcgtccgaagcgataggcttcgactgagttttcagcccattccacaaaagaaaaaccgaagaaagatgtggtggtgcccccattcgttaggttataatgccgaatcccgtatcagctttattacctttagatgagcactaactaattaacccggttgattagtaacctgaacatctctgcctactgcctttgctgagtggaaagcctgtcgttaccggagctagttacctgcacggcaaccgttactcctgcagagccgtggtgaatgcagcatctagctacctgatggatgatggctctggctggctgatgcagaggaggagcctcgtcgagtgcatgcggcgtcgtgcgccaacgtttctccacataaccctggcgccagaggacaaaagcatgtaggagcagctctttccaccaaactgaaactcctttacaatctcgacgaagtttctccgcacatgctttttgtgttgtgctttacgcgcgtgtacagagcgccctgatgcgatcgtaggcggctggctagtcggctcctacaagggagccaagcccaagcggacggtcgctctcgtactcgtactccgtggagggggaaactaatcaatcatggagctgaggccacattgcattgctgttgccaccatggctactacgtatagtactgtagttagtagtgcgcgctcgcttgaggtttccctactcagatagcactcacgactctagctagtgaggctgcaactgcaaatcaaaaggaggcctttttacgcttcccccccagagtaaactggtgtgtacg

SEQ ID NO: 1381 - DNA, 1170 bp, Zea mays
  misc_feature (1)..(100): optimal_loci_123383_G1, chr3:191744762..191745931, Cluster 9
aagtttgcaaggctctcaaggcgagagactggtgacttaggtccgaatgaagaaggtgccctgaagcgctcgtggatggcgctcaccatttccgacaagaggtgcatttccttctccagttcctccaagcggctttgcgcctcgacggagctcccttcgacgacatcgaatttcccttttatagctgaccgggaaaaatgtgagccgtgtgagggggaaagcagacgataaacgcttaactttagaagagaccgctagaaggcgttaccttgcagataggctaggagtttttcctccttcttggttcgaccgactaactcctctaaggccgcaactcgggcttcggtgacttctcttcctcgctctagaatacggaggtgagagcttgccttcgcactcttaagatatgtgagggttgtcatttctgcatccctcctcgtcgtctcaaccagggcattatgggcgtcttggattgacgcagcgcgagcgtgggcttcggtggcctcattcttcgctgccagaagatcaccggcgaaaagctccaatgcctccctttgatcgagaaagaagctagatttttctgccagtgtcccagcaagcaattgaagaagaattgttagcaaggggagcattctccttaccaagccatctacacacagtttagtgccagcttttgacgcgcggccaagaatcgaccgaggttggcttgtagcaccttctcagccatgtcgctctcttcgttcagctccctacacggggcttggggcaccactttcggtcaagcagtctggagcaagttggacgcttggctaaccgttggggcctagcagcgtgatccagaacttcccttgagtagggacggacgatgccccctcaggcaatatggtctccataaaaatggagcccccgccccctccggcgaggggtgcaggggaaggaaggcggcccgctgtgtaaaaaatagagggtggcgagcctcagccgctcccgttgggcccgagctatgaccattcgaggacatcaggagacacggacctgagacaccgcctccaaaaccgccttacggaggcatcaccaaagcagaacttgacagcgcgaacgctccgccatcctcgtcgacggtaaacgtcgccttcctcctattagagaccaccttcctcacgtgcggca

SEQ ID NO: 1382 - DNA, 1182 bp, Zea mays
  misc_feature (1)..(100): optimal_loci_123393_G1, chr3:191779063..191780244, Cluster 9
ctttcacggtgatgcatgtatatagtggtaaggatacataatcttttacttgcaagtttcctagagaatgtggtagaggtgtctaacacctttttccttacaaaaccagctaagtttggtaggccgattaaaatttgcaagctttcgtgttggctggatatggccaacaaaagttggctaatttgcacggatcacctacggaaaatttgctaatttccgttgtttagtatataagaattaaataccgatgaaaatgagtaaacgcacatttttcgctaatttccgttgtttacatggatcatctagctaatttacatagctatatttaatggtaaacgcacattttttttgtagaccttttaccggttaaaattaggaacggacttttgaggtggcagtggcacggacaatatggataggtataaatccaggcatccagcagccgtgatctctatcggaaaccgtgcaggccccgggaacgggcaaagctgacacaaggtagtagtaggataggacttgtccgcgcactcactgcattcaacttgtgtggagtggagcgtcggggtgatctcgcgcatgttctcatctcacgcccgcaaatcgacacatgcatgtatccatctcactcagcgaatgcacgccgttccacaatccacactgtctttccagagagaaaggactgggattattgagttggttcccgtccactggatagacgtatagacacgcaccgcgctatacatctactagagatagacaagacaagaagttgatgcgagtccatctccatcgctgcatatcttggtgctccatcgatcgatcgccgctaacgggtggccctggacggttacacgcccttccgcctttctggctttggagtttgatcgccggccggtctcagtacgtgtcggcagtacgcatatgcgcgcgcgcatgcatgcaatgcaacagcagctttggcttttgcaaatcccgggtgtggcacggcatcagcacttcagcagcatatgtgacgatcgagatcctgccgatacgggggggtccaaatcttggtcgaaaagctctttttgcggatttggttcgtttcggtcgacatgcagtgcaggtcatggacatgcatgaccgtcagtacgagtacgagtggtatacgcgcgcatgcagcaacaggcggcggcaagcatg

SEQ ID NO: 1383 - DNA, 1050 bp, Zea mays
  misc_feature (1)..(100): optimal_loci_123958_G1, chr3:194725359..194726408, Cluster 9
atgtgcgcacaatcgtctggaaattccagcttgctcaaggcactacggtgcccctcaagtacgattggttgaataataactagagaggaacactcaaacatccagacgataaagacatggaggcagaggaaaacaaacctgcgcccacgaggccagcacaagatctatgtcacgaacggcaccggcagcaaatcaggcaaccccatgagttcggtggacagcggtagccggtagccccaaaccaagggggacggactgaggaacacagagatggagaaattgcaaagcccccaaatgcgaatagtggatggggaggacggggaagcagacgttaaaggcatgaaggtacaaatctctggccgatcacagcgccgactcccatcctcgacagtgccgagacgtgcgggagaggtcggcgatgcagagcacgtgaccacgccctgccttgcatatatcctctctcacaatagctgaacatggtcctacgtggatgcaagggcccaccagagctgcgacagatcgacctcttctcggtgacgaaggcgagcacgggctcttctcggtgacgacgtagcgtgtggacgaagcgcgaccgggttagaacggatgctggccccggcggtggagtggaacccaccgtcgcgttcaccggaggggggcaacgcttgtggcccctcaccggccacgatggaaggcaaaatgggacgcggcgcagactggtttggtgtggacggtcgcctccaccgaagggcagcgagcctgcgacgcccatggccacaaacggccgcgacggaaggcgaggagatggactatgcgagtgtgggggtgtatgtgtgtgtgtgtggtggggggtgggggggtgctgcgctcttgtggcgggaatcgcgggcaaggggcatgtcgcgagctctatgccatcgcgcgtgggtgacttcggttgcaataggatggaatgagataacacgatatcttaaataagattgtttggtttaggatcaaaatttagaacatgactatttagtgttgtccccagttgtccctcaaatttgg

SEQ ID NO: 1384 - DNA, 1052 bp, Zea mays
  misc_feature (1)..(100): optimal_loci_125047_G1, chr3:201019673..201020724, Cluster 9
acccatctcccaagttgtccatacggaccatacataactgatattggcatgtttttcatatatgcgttcgtgtagatccatggcggaaatactaaaatattggttcatccgttcaaatcctagtcccatacaagggatgatatgtttgtcgttcatatttatttgctgatgtacgcacatacaattcacatgaagcacacattactaagatctgtcacacaagtcccatgcaatagatttgtagtagacacaaaatctgcgtagagttattcttttaaaaagactgtttgaaagagagttatgtgagaattcaacacggccgctctgtcaaagaggccttaaaaaaagcactttcgttgtcagaggcaacttctctgcaggtcttcaaaggatactgtagcagtgccaccgatgatgggcgtcccgacaacagagctgagcatgcgtttcgacggtttcgttgccctgcacgaggacgccacggcggtgtgaactctcttctgcttctcgacatgcatcaattcttctcgcgttcgcggtgtcgccatcgtccatcgaggagccagagcgcatgcctgactaaacgggttgactcgatctctctccgccaatgtgcacgcacgcacgtcggtgactcttgcgcccgcccgccagtcgctagccaagtgccgcgccacttgatcccagatggctttaaccgagcgcccggcgggatcgcgacgtgcaagttgcttcgtcgggaaggggagggtggtggatgtcgccctcgttttgtttatgtatcttgcagtcctagtatatatggaccggatgcagcagtgatgcacatacctatctggtactcctatctcacatgcaggatgctatgtgccgtacagatcatatgtggtgcaaacgaacacctacacctaccaacagctacacggctacttagtcacctatggtatggaatgcatcgttgtggaagtcaacacgatgctagaaattgtggaaagagactttagcgaagaagaaaaaaaacactagtaaactacacaagcaagcagagtact

SEQ ID NO: 1385 - DNA, 1259 bp, Zea mays
  misc_feature (1)..(100): optimal_loci_125267_G1, chr3:202128269..202129527, Cluster 9
  modified_base (668)..(668): a, c, g, or t
  misc_feature (668)..(767): n is a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
  modified_base (710)..(710): a, c, g, or t
  modified_base (711)..(711): a, c, g, or t
  modified_base (712)..(712): a, c, g, or t
  modified_base (713)..(713): a, c, g, or t
  modified_base (714)..(714): a, c, g, or t
  modified_base (715)..(715): a, c, g, or t
  modified_base (716)..(716): a, c, g, or t
  modified_base (717)..(717): a, c, g, or t
  modified_base (718)..(718): a, c, g, or t
  modified_base (719)..(719): a, c, g, or t
  modified_base (720)..(720): a, c, g, or t
  modified_base (721)..(721): a, c, g, or t
  modified_base (722)..(722): a, c, g, or t
  modified_base (723)..(723): a, c, g, or t
  modified_base (724)..(724): a, c, g, or t
  modified_base (725)..(725): a, c, g, or t
  modified_base (726)..(726): a, c, g, or t
  modified_base (727)..(727): a, c, g, or t
  modified_base (728)..(728): a, c, g, or t
  modified_base (729)..(729): a, c, g, or t
  modified_base (730)..(730): a, c, g, or t
  modified_base (731)..(731): a, c, g, or t
  modified_base (732)..(732): a, c, g, or t
  modified_base (733)..(733): a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
  modified_base (745)..(745): a, c, g, or t
  modified_base (746)..(746): a, c, g, or t
  modified_base (747)..(747): a, c, g, or t
  modified_base (748)..(748): a, c, g, or t
  modified_base (749)..(749): a, c, g, or t
  modified_base (750)..(750): a, c, g, or t
  modified_base (751)..(751): a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
cttgacgcgagcaaggctcgccggggcggttttgcgatcacggcgatgtattgaagccccgcacattagtcaattttaaaactacgggcgctgcctggtcgaaacagtgagacgcgcgaggatgacatcgtggagagcattagagtcgacttaagtccgaagaagagctcgacgacctcacggagtgatggcgacccggaccggagtgctggccccagtcccatattgttgagatgctgggagctcggcgcgggcggctcatcgagtggcaagtgatgattcgtctttatcatgagcatatcgctctgtccggtgactagctgagcctacaggaagtatcgcgggttgggctctggaggatgttcatggtggtgcgctgcaggtcggattctggcggcctcacctgccagtccacgagggctatccggtgcactagtggtgtagggtctcgtgtaggctgtacacttcgcgtctctaaccgtgatttccaattcgcagctgagtggaagtcgaccagatgatggcatggtgtgcatatctgtcgtgagttgtcgtagggcctattctttcgcaactacctcgacgacccttgctggagccgagttcattgcatgatgttaaattgtagaagtttttccgcatcaacgtgttgggcagaacctagcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcgttcatccgaacttaaaacaacatcaatgaacaggtgaccaagactagacctgatccgctgtgcatcgagcaaggattccgtgactctgctaggcagtatccccgacgcgtaatcacgtctagtaggcaggcagctatccatacccgtgcaacggatcatgcgagggctctattccaggcgcgaccacgtagtcgatcgtgactgacactgcagtgcttggtctctaccgagtgctagatgtcgcatccgacgatcacatgctccgaagctatgcgacgccacatttggcagattgcggcttccagacttaatgttagtcgttttttcgcgcttctagctccgtgtctcggcgtccccgataatatgggtagcgatggggcaatttactcgctggtgcatccgaaccggggcgttgtcgctcagatcgtgtcactgctagggctcgccgatccagcagcgagggcaagtgattcccgtctagccggg

SEQ ID NO: 1386 - DNA, 1032 bp, Zea mays
  misc_feature (1)..(100): optimal_loci_126206_G1, chr3:206586509..206587540, Cluster 9
cgggtcttccctcttccctctcgggcggcccttcacgaatcacatcgccaggtccgtccgccgtcggatactctcttttccacacacacgcgccgaggattttgtagctgcgacgttcacggaccacgcctggaatctcaagtagcaataaacaagtggtggttaggaatcgccagctaccatgtgcatgtgacgtgtaactaactgggctgcgcatgcatgctgtgacgtagaccggataataagttaataacaaaataaaaacttcggtgcgcgcttttattttttggggggtattgggtgatatggaagtatagaacacatgggcgtgcagatgagcttaaaaaaacgttttgattcctgcatctatgttgcggtccgggtccggtacctatccatccatctacccgcatgcactgttgcaagtgtcatgtgatgagtggtacatcctgtggtgtgtgtgtgcagtgtgcagtgtgcattgggaatagtttttgcggcgtggcgggccgatccgcatccgccgagctggcccgggtcggcgccgcgcgcggggatgagatgaatcaatgatggcagagaccagtaggggcgcggattggctttgcctgtgcagcacacacaaggatagatcggatagagatacgggcatgggcgggggctgccacggtcgggtggggggataacgatcgcgccaatgcctggaatcagtaggagctctggcttttttttttctaatgcctgagtttgagccaatggagatgagggagaagttggcacgtctggaacgaacacgtagtagcattttttttgttttacaacatggcaagtagccgaactagtagctggcaaggttggaaggctggccccgaaccgaaacaagcaaacgacgctatgccgctatggtttcctttctaattttattccccagcgagctttacccctttcggttcacaactgtttagacgaccatataataaccacgctttaataaatctcttgttacctgttcccgtcagtactttgctgttc

SEQ ID NO: 1387 - DNA, 1275 bp, Zea mays
  misc_feature (1)..(100): optimal_loci_126749_G1, chr3:209113531..209114805, Cluster 9
aacataaagttattattcagagctcatacgaggagcttcacaaaagaacatggagagctgcctctcaataccacgtcttttcttagaagtttttgtaactattccattccaccgattctagatctgatctatcaacttcatcagagagcagctctactccaaagttttacaatttttagatgtgtttggcttgtaacacaactccacaaatttgagactgtgttggaaaatgactttgttacgtgcgccacctcccaagcggcgcttcttccacactggcagcccaccatggccacgattcctcctcctcccctggccgagcccacgttcttgagcgcaggccacatgttcttgaacgattcctttccaccatggtcacctattcttgagcgcaggccctcggcgcgtgcaggtcctcggcgcctcgcggtcgcacttgcaggccaccgtcgctctctgttttcatgcgaggaagaaaatgtgttggggaggaaagaacagaagaagaaacaaaacattattttctccataacgagttgcattgaattgtaattaacccccaattccatgtttttgggtgagtagagtttctagagtttagaccgttggcaagcaaatagtggtgcagagctgcaaaacgtggagttgagccgtcccaaacaccctcttggtagagttgaagagccaacctctttggttagtgaagcttgtgtggagttgaaaatgggagttgccccaagtaggtcttcggtgtcgtcatttgcatggcaaagttgaacgatatgcacttgcgcaggaaacttattggcatcacttcaaaccatataaggatcactacaccttttggtttgggattaagcaattcaacttaacaaatttactgacgacacaatattaatagagacatgaaacaatgaagagagagagggtatcaaagttccatatgataaaactagttcatactactgcgaagctagatcaatttgacccatctcctcgatcagctgacaatccgctagacattttttttctcataacctgaacaaaacgtatagcttgttatggaattcaggttgaatttcacaagaatttattttgtgaaaggagccccctgttcaatgtaggccaactagcgacatcccaaatttccaagaccatttctttttcttcgttttgcagactgggcccgttttaggaggcccaccctaaacctatgtcgacgagcatatactacaagttcgagcattttttactcgtgattcagcgcaaccgcga

SEQ ID NO: 1388 - DNA, 1367 bp, Zea mays
  misc_feature (1)..(100): optimal_loci_127252_G1, chr3:211740333..211741699, Cluster 9
atattggaagagcttatagtctaggtcacactaaccgctgccaagtacttaaagagccagatactcttgtaaagtgtttctttaggacgaaatggacatagacactagtaagtagggcctatttgaagggcaaaaaagtatattcgaactaaagtattcttgtatggatatgtagttgtcttgttgctaaagacagactctttttttgggatagattcacggtgaaatttgatgtccactggtgtagctgcttcacggctaatctgatatcccgatttgttttgtttaatatgaagttgtcctaaataagcccctcacgtctagatccagatctggatttgatgctgactgctgtgctggctaacccctccgtcacttcgtttcactgccagaaagcaaaatactactactaactaggtagtacagataatacgagagccattacataatgttcgtaggctcatgggcctagatgaccaggggaataatcggccgccagccggttgattgctgtgattaggtgtgaggaggggctcgttggccgttgggagaatgcagaggcacggaggggccgagggaaaaaaaaacacactcccttgtcgtgtttctgcaatgagaaaaaaaaaactgcatcgtgtctcgtccttcctcatcagcagtgcatcaccctgctcctaccagccggcgtccatcgaatgctagagcggtagagcgcactgagcaggcaccacacgcgcgcgctcgaacacgcacgacacaataaatcacacaatcctggcccgcgcgcggctgctgtaatagactactctcgttgaaagcgtgacgtgacgtgacgcaattccaagctggaattggagatggaggtgccaacatggacgtgatgtgatcctttgacaggatgctgtacggcgcaaccatgcatcatcaaccacgagtattcaaaggggagaaagcgcgaaaacaacgctaggtccacgagttttgtttgtataccgactcgaactgactagacagtagacatggcaataaaagagagtgcgtactttgcggaggaaaaaaatacaaaaatgattcgtcgttttgctaaaaaaatacaattactgtacaagacatatacgtaatggcttaaattacttagagacggagtagaagatggatcacgttagattggtattgtattaagaagaaactcagcaggtacggtccctcgtaaatcgggaatgtgcgggccacagcaaggagaaattttttaagcaactcagaaatttacccttgacgaagatcaaatcctgtttctagaggtgctactcggtagtcttaaccattacatagaagtcccattcgcaacaccttagcatctgccaaca

SEQ ID NO: 1389 - DNA, 1150 bp, Zea mays
  misc_feature (1)..(100): optimal_loci_12754_G1, chr1:69865634..69866783, Cluster 9
ggtggggcccgccggcagccagctcccagcagggcaggctcatcacggacggggacggctactagtatacagtgtgcagcttcaaggcccacctgctgagggtcccgcaaggcggcgacggggccctcaaccctgcggcggaaattgatttgagtacgcatggtgaccaccaaccgctgtcgctttcctaccctctcaccgccacgcggggcctcttgagctttaggcaaatagacccgccggtggggggcccaggcccattagtggttgggtggcatgcgtcaacgtcagggaagggtccccggcccggcctgacgtggtgcgtccctgtcgtgtagcggggagggggccgtgcgccccggcgaatggcgggcgcacacgcgcgcgagggccacgtgaccggaccggaggcggagggtggacggactcccttccgggactgacgacgacgacgacgacgaggaggtcatggtgacaggctgacagcgaaacaggagaataaaaaatataatgttaaatattaattacgatcccctctgtacgtgtagcccgggagtccacagatgtgatctgtcgattgcgatacatacatatatacttgtctattttggtgacggagaaacacaagggtatatataatattaaaataaagtactaccgtggcatatttatgatattttgacatggggggaaaaaagagacgtgctctgtcacggtgtttgtctttatgttttgttggaccgccatcagaaacatcggttgcgtctgaggtgagccccttggtccatatccaacggcccgcgcacactccacggtgggcgcaacggaaccaacccacgaaccggagacggagagagggaggaagcgggtcacgtcacgatcgtcaccagccggaccggacggacagaggggttgccccacgcgcggcgcaggtgggcccaacccgcggtactagtatactatactcctatggctcggcacgccttcccaggaccaggagccccgcgtggcagcctaggtccgtgtacgcacgggcggggacacgagcgcccggcccgcctccgcgtgtcctcgcacacgcgtcgcgtttcccccggccacacacgagcaggcatggcagtgaccgggctccgacttgaaggctcgcgag

SEQ ID NO: 1390 - DNA, 1207 bp, Zea mays
  misc_feature (1)..(100): optimal_loci_127581_G1, chr3:213409204..213410410, Cluster 9
gggagcgaaacggtccgaatgattttgtaaacacaaagttttttttttggccgcgcacgcaacaaattaaaagatccaagaacaacatgcaatgcaagtgcgtgcatgcatatcgaggagggtgcgcccatggtccaggagtactactacaggacaagggaaaaaaatgactgacgatcgacgtgcacatgcttcacataaggagtcgagccctctggaccttggccaaacagaccagaacagggaccggccggccggcctggcgctggcggggaggaggaggaaatcaatagccgccgcaggaatctaggcctgaatggcgctgctgcaaattgtcatatgcatgcgcgccacatgcgcggccacatggtggtcgtggtgctgctgcatttaagtgctttcccggcgctggatcacaggatctcgtgctcccagtgtccagtgtccccacgctgcaccaagcacgcagatcaaaatacgatacgtacgatcctactgccacgaaatgcgatctagctagagaaagtgcgatctagctacagcgcgtgtgcgtccaatatacgtacatggccaggccagctgcatagcgccgcggcgagcctggcgtcaaggagagaagaagaagatgatgacgacgacgacgacgagagtgttggctggtagcaaccagtaaataaatagtcgcgctcgcgcgtgatgatccaccggccggaaacgaacaggggcggaaaggagaaggacccacctgagatcctgcgaggcagccaaaagttcgtcacctcgctttccaggtggtggaccgtacgccacgccacgtaaggcagaggtggatcatagcccttggtagtaggtggttgggggccgcgcccaccacgttgcgtctcatgccgacagccgggagcacgtggccgccgatggctcgcgcgactcacggggcctgtctcgcgcgcggccgttggtagttacgggggggctcggggctcgggagcttgtgtctgtgtaccggcctaccgccctacctatgtagtataccaacaaagaagagcaggtggacgtcgttttgtgttgaagaggcgcacatgctctcgatacatgcgcacatgtaccactgggtatcgacagtccccctccatgcatcctgttaaacaagcgctatgtactacgtatgctcttatgataatgataataacgatggtccccaaatgca

SEQ ID NO: 1391 - DNA, 1336 bp, Zea mays
  misc_feature (1)..(100): optimal_loci_129240_G1, chr3:221558199..221559534, Cluster 9
ggggccaaagacacgtatgagttgcttgctcctcccctgcatcagatgtaacttacttgctggctggagacagcgccttagaaaaatcgcactgccaattattaagctagctaggaacaagtcacccggaaagtagacatgcatataatagaagctagcttcaccataaaaaaataataataaatgcttatatgttaattaattgtataacttaattataataataatctgcgtgcgtgggagaaaggatatcaaacgaactaaacagaccgcgatgcgatatatatttagtttcgaaaaaaacaggtcgtcagaatcagaagcgaatcatgtgtgtgcaaagtcaaaaaaaaaaaagaatcggatccgtgtgggaaaagaaaggccgcaagatacgagaagcggcaagtttccctcctccctcctgattcctgattacttgtaactagttttatctgccacgcacgacgacggttatattagttgtttgcacgcgcgcggcctgagctccaaagtctaagcagcacgagctcagtattatattattttatgtggggccggtttcgtgattggctcccggccggagcaaagctgctagtactactttggcgaggcctgaacctggatcttcctcgatcggcgagtagaatatactgtactactccgcagcatgcaccgctacgcgcgtgacgagacgtcactcactcttgccgcggtgtccgcatccgcccggcccggccgcacatgaacgaacgtgttgacgagagcgtagcgcgtactacgtacgtggtggcgcacgcagcagacgagagacgccggacgcatgcagacgcagaaggggaacaaacggagcggcgctgtacgtgtcactgtcgaggtggataagggtatgcacggtgtccacacaacacacacacacgcgatctgcgtgccacacataggaaaacccccgttttcccgtttcgctgcgtacgttgcaggggggcccgacgcgacggctgctgccccggtcgcccgacacgtccctgtcgcggttttgggtagtaatccaggccagttcacgtcgagctagcagctgagctctactacctctacgcgacgcgaccaccgtcgcgcgcggattacagcctgtcgtcgtgcgtgcccgtgcccctgtctctgtcgtggcaccgtgattgatgatgatgacgacgacgatgacgtgcgcagtgacgcgacgacatatatacatgccgcgtcccccgacccaacgccgtcggggacgccaacggacgaggcgcgcgtaccgctagccagcaccagcaccagcgccagccgcaggcacgcccacgccacg

SEQ ID NO: 1392 - DNA, 1244 bp, Zea mays
  misc_feature (1)..(100): optimal_loci_129571_G1, chr3:223292266..223293509, Cluster 9
gactaagaaggaagccctccccaaaataaagtagatggagagtgacttgagtctgtatatttgtttagggatgttctaaactcatgtaaaattttaatgtaaggaagttttatgatgatctgactctgtagaattatcttatcccgaccacatatcaagtctgggtcagagaagagacttagctatactaatgagtgagggtaccatggccactaggcgtatggtcattgcagtccatctagtatagtttggcctttctatccaatcgatttagtaggggtcaggtgcatctaggccttccgaggaggtcattgagtagtgaggattgaccctttgctggcaatggggttgcatggttgccactcataatgtgtcggttgccatgagagacatcaattttttcgtattcgtcacattgtttgtactgattctaagaaagtcaatatagattacaacttaccactatggggacttctgcatcttcctatttgagatccttgttgtttcttgaccttggagagttgcttcacttggattgattgatcatacgtcaaagttgactttgttgacgaccaaggatgaggtgtaagttcatagtgcgttagttttgaaactatttttgttcataagaacgtgataatgggttgactagcttgttccctgaataccagtgggtggtacgagtaaaaattgaacttgctaggcttgtggaccttcatgtccacaatagttccagctgggacgtttccaccttgtttgtccaaccctatgcaccatggtttctaggaaacaggcgagctcgatgatgcttttagctagcaaccgtacatcactggcatagatcacataaatccatctggctctaaaaagcctttgtcttccaccttctggccagcatcgtccttggtcggggttagtatcccacgcaaccttccttttcttggaccgctaaagaatctcctcttcaacccacaatccttgtacaaatgtttgatagggaaagtatggtttggacaaggctgctccaatttcttttcaaataaattaggggtctctttaatgggtaattgaacttctttagggtcgacgacaattgcaggcaggacttccgtctacttttccccttcctagtcttcttgttgcatttcatgtgcttgttggcacgaccaagggtcccctcattaggagtcctcccaaactcgaccatgttgtaagtctggccgtgggtctcaaccccaagtgtt

SEQ ID NO: 1393 - DNA, 1014 bp, Zea mays
  misc_feature (1)..(100): optimal_loci_129866_G1, chr3:224686989..224688002, Cluster 9
cgtactagtaaaacaatgaaagcagcatcgcgacgaggtcggagcacctcgctgaaatccattccttgcccatggtcacaactcacaatgtctacgcagcagaccgcggttggcaaccgagcgtggccctagcacgaagacaccttggttctccattccttccaaatgcacgagaaaacgaataggagcaaagagtcgaatccatgacgctggcaactgagacgatgtcccggcagcgtagccaccaacctatcaaggtcaagccgtcaaggaggcagcgtcgattagcaaagatgcaaccccgtaggagatgaaggcctgtttgtagagggtgcacacgtcagagtcctgacggtgcgcgcgccacaactcttcggcgtcccgctggcgctcaaaagagtgaccttgccttcctccaatgtaagatgaggcgaagtcgtcaccgtctcctcgattttggatcaccaaaaattactttgattctgcgtgactcttatccaaacactatataaaatacagccgcccttggtatttctccttgtacgtccaacaaaaacacaagttcggatcttaggatcttggagtccatgcgtgaccttgatctctggcgggggttgtgtccttggcgtccaataacggttctaggccggcctccatggccacatccaaccctcctattggttggttttggatctgacgtctttatgtccgaccaacataatgtttagttgcattggcgtggacgtgtttcatcatccccaataagattagcataaaatagtcgtttgatgtgttaccagctgggaagtcagtgtcggagaaggaccagaggagaaggccgcagaggagcacgccgacggggatgaggtggacgagggcgcgagcgaggtcggcgcgcgaggcatccagggcctccttcttggccacgtccgaccgtgggtcatatgtcggcagttggtccacgtccatcacgcccgccgtcgagctcggacccggcgatgccgccccgccagt

SEQ ID NO: 1394 - DNA, 1241 bp, Zea mays
  misc_feature (1)..(100): optimal_loci_1317_G1, chr1:6796702..6797942, Cluster 9
aacatgttttaagatgtctctagcaacttatccatccaatcagtcatcttattttttattttaaactttactctacaaatagtataatcgatagtacaaaataaagttttgtatgactatatatacgatcttctggagacagtcttgtagcagtagaaaagagtagagattggtgtgttctggtcttctggagacctcatatacgatctgtcgccacaacgatgcgatgcgctggcctggatcgcctattcttgtcgctgtcgggccgcatgataagtacaggaaacggaaacgggctgctgtctgggccaaaccagcggcccgagactgacggcgagaaatatctccggcgggagccaggtcggtccgcggggccgggtcgcgcgacggcctctcctttgcccctggacagcgatccatccatccgggcgccgcggcggcggtggccgtcactgcgctgcgcactcggcgcacagtgcccacgccacgctcgctctagtgctgccgattttcatccaagtgcttgcctttgaacgtcgtcatcgtcgtcgaaagaaaagtggcttgggggtgcccgtttcacgttgctgctgcactggctgaccgcaacaagcctgtcgacgatttgtcttgtggggtttcattagcgagcagagaaggaaagtgggtccaataagttgatgggctttcccagctccaaagatggccatgcaaaatgattaactggcccagtgggtttccctggtccaagacgaagctcatggagaggtcacgccacgttctgctctgctctgctgctggtgctggtagggttaattttggaacctgaacttgatggaggacagacatgcgattgtttttaagaaaagtggaggaaaaggcttcgcaattaaaggagcaatttgaaatggaggagatcgacatgagaaatacgatgctttcaccgtcgctccctttattcctcagatctcttatgcttacttttgtctggcttttctagtccaatcgggtgtgtgacccacaacattcgctcgaggaagatcggatcggtctcgtcggcgtccttttatctcacaaactgcaccgactcgaataaactttgtttctaatatgcgttaattatgatctgcaatatccgtcctccaaaaattacgattctcacttttttaagggctattataaaatcttaaatccactccagaattcaattcccacgaactgagtaggaaactaagctaagt

SEQ ID NO: 1395 - DNA, 1185 bp, Zea mays
  misc_feature (1)..(100): optimal_loci_132822_G1, chr4:6544371..6545555, Cluster 9
aagaaatttcatacgagtggtgtagaaagggttatgatattagcgatgacaattaacatactgagaaaaaaatacagtggtatgtacagaattttttttttccaaaggtgaacagctctccactacggttagttgcgcgcgcacaaagtggaaaagaaaggagaagaaaaaggaaaagaagatggcgacgctagttctatgagaggtacaatctcgcctgtggcgtccaatcggaacaacaaaaaaaaaaggacgacgatcgtgaggagcatgccgtccatgtcatgaggatcacaccaagtcccgggctcaccgaacttcccctgttggaaaacgatgctgcctgctgcggcaaccaggacagaaacggtggcgacaaataacacataattccggcctccgcgtctgaatcacacagctgcgttcctgcatcagaagaaactttgccgtttggttggcttcattcggtagcctggctactttgtttgtttggttgacttctctcggtagcctggctaactttgcctgtttaattagcttctctcggtagccggactgtatgagctagaaccgctggagcctaactccgaagatgcgaccaatttattcatatttagagagtcgggctcatgatgctttaaggagcctagatccaaatctatgtgtaagcaatagagctcgcatgtgtagaacctagctcatagcaaccaatcaaacagtagctacctacatcccgcgatgcaaacatggacagatacaggcaaccaaacgcgccctttgtttttaacagcagccttcaccggacgtgcttttgttaagattgtgtcgaagtggcagacatgaacatcatggctggcgagtgaaccgtaagtcaacctgccaatattatatcaccacttttaaaacgacgtatgctagacctgaactgtactagaaaaaaaaacaaattatacagcatagcgcaactacattccaacttcgaaaaaaaacagctccagggacaccaaagcttaagctagaaatgaacaaaacatcatctgaatggcggcctgctgaaactgtgaaacccaacccaacacaggctgcacatcttgggctacacacctgcccactcaaatcttattagccagtcatcatcttcttcctcaccaccggcacagccaccccacaacttgcccggcttct

SEQ ID NO: 1396 - DNA, 1316 bp, Zea mays
  misc_feature (1)..(100): optimal_loci_134539_G1, chr4:14695427..14696742, Cluster 9
ggcttaattggtagtagagattctacgtaggtaagtagaatatcatttatggcaatcggccgtttttccctttttattttcttgtccataagtttccccttttttgtggctatgaattatatttgtttggtcgcatacagtttttaagaacacgggcccaaccggcaagtcaaaatggtccctttcgttgcttcaataatggacggccaccttatgtgctttgcaagataaaggctcgatcgtagccatgcttgtggtttcacgcagagcacgggtcgcgtctcatcaaacagcactgcactctagtacatcacttgcacacgtgtgattgcgccccgcctcttttacatagcactcataaataaataagcagatattcatttcatttgtagaggccaacgactgtctgtgtgcatatatgcagtgagcactgatgagcaggtgctgcccccacccacataggtgcacctgcaaaagtacagtgcatatgatgatatgatctgtggcggatccaaaggggctaggggctccatctacatccatgaaactccattgttgatagaggtcgagggaaactccattgttgatagaggttgagggtagagaagatccggagaggaggagcaggaagaagaggaggaggagagaaaaataaacccacctcgctagcttgtgatgtctccgccactggtctttttcgatttccattgctgttgtgggctgcacagctagcgtactacacaaccatgaaactgtaaggatatttggcacaactaacaccgatgtaatcccttgggtttcaaacagacatttggtccttgatgatttggcacgcacgacacctgctgtgtttatttttagtacaggcacaaggggctagttgttgaaaatgggccacagttcggttaggtctgaccagaaacagtgtgtgccccaaccaaacttcgctttcattttcgtattcgaggaccatgcatgcatgcgctgcatgccgtagatccggcttggcactaaatgatgttgaactcatgtcgtgtacgttgacctgtgctgtgctgtagtcagtagtcacacacacgagtgtgtgtgtgtgtgtgtgtcaaactgtgccgtctctctcgccggattcacagagaagatccgacccctggaccggtgctagctggttcttggcctgccacacccacacatctgggaaagagaaatgcaagtcgtgtgtatcccgcgcgcgcgtccactccactgaagccacacttgtttacccttacatgtgtaagataaatgttgaaacaaaatggtccagggcagattatata

SEQ ID NO: 1397 - DNA, 1051 bp, Zea mays
  misc_feature (1)..(100): optimal_loci_137664_G1, chr4:30917810..30918860, Cluster 9
ctatccatctagccttttatagttttcccattgaaaggaagccaatcgacaatatgaatttttgagtccgacatagggactcctagatatttatatgctacctcaagtcagtcatgccatctttggctacatcattggtaatcaccatcaagtacgcccttaacaggctacctcaagtcacccataccaccttaggttatgtcatccatatcgatcgtctagtacaccatcgatggcctacccaaagtcgatcatgccgcctctggccatgttgtcaggaatgaccattgattatgccctcgatgggctacctctagtcattcgcactgcctttggctacatcgttggcaacaactgtctagtacaccctcgatggtatacctcaagttggtcatgctatgcctctagcgatgtcgtcgacaataacccactcaattattacttcggaatgctatctcaagctagtaatgatgtcaccagcctcgatcactcgaggatgcctttgacagattccctcgagcaggtcaatcgattatgttgccggctgtgaccactcgaacacaccctcgatgggttcccatgagttggtcacaccatctccaactacatcatcaattatgaccattcaggaacaccaccgttgatcacattgccattgactacatccttgagtatgactattcgaacatgcaattatcatgcttcacccgagtcataactaggaaccatggatgcaccctcaggatcataaaggggacaatggtttcaaaatcaccctccaactaattctataaattatttagaggctcggaggcaagacccacctggtctagtgcgtggctgcggttgactttgataataatacaacattagggtgcaaaaattgttagacttccattaagactaaccttgagtcaaattctctaagtcgcacaaggcttgaggtccactgctagtgctatgtacctagggtacctaaccacatggaaatatcccaagaaggatggagtacaccaaacaggctatacaaaaagctctacccatatggggt

SEQ ID NO: 1398 - DNA, 1005 bp, Zea mays
  misc_feature (1)..(100): optimal_loci_13931_G1, chr1:76600997..76602001, Cluster 9
attccggtaatgaggaaggcggctgggtacatgtggatcagaatagtatagttgggaagaggagtggactcgtggagaagctgcagcgctaagactacctaataatgcttgtgtattcatcaagtggtttatttagcgcgcgtgatacttgtgattgatgagtagtgatgatgacaacaacagcttagcgccttaatcagcatcaaacaacaagattctttatttatatatatactatagttgtactgcggactggaacaggtggtggcgtattaccaagagtccagcgccacctgctcaaaccaactgccgccctctaaggctaacaagtcgttgatgctatagaccccgtttcatacggaaagcttcccgtcagcgttcatcaggagcagtacaaaaagatgtctgaaaccatgtgtgcactgtcgttttcactttgatttggttagtttataaccagctgatgaaagtgaacaggctaataaagtccaggggatctagaatggagagggtcatttttcataccctagctacgtgcatgtgcatgaatatatcatatatgtcgtccatttcagcaggcagcagccagccatgtggatgggaacgaaacggcaggctgtggtctttcattgcatactaatcagtaatcaagcacgcctcagtccagcaggctgtcctgctgacgtcgcgctcatgcttagctgcatcacatcttcgccttaatcctgactcgtgcttctttgtcttacgcataaattcgtggaagcttcgtatgcgcgccgaaaaaggctttgccccggtcaggagtactgcacggcaccggaaatgtatgtatatactttggtcacccatctctgcctgccgacaaattcaggccgccccaggtgctatctttttatatttgacaccaaacagtattaaaaatagttgtatttaaaggtgttgtatcttgcttttttctcctaagctgaactgataataaatcagggaaaatagatttattcc

SEQ ID NO: 1399 - DNA, 1192 bp, Zea mays
  misc_feature (1)..(100): optimal_loci_145950_G1, chr4:83187780..83188971, Cluster 9
attttgtatacatgtgtgttgtgcgagaccagccacgccgatacagttactgtgctcacgataaaattgaaaaggacaaccccattgttccagtcatttagtcatggaagaaatgatcctttccaacccaatctcctagccttttttcttcgaaagaaaggaagatctgcccgtttttatctattcccgcccgcaacaagatcgatgattacccaccagtaaaattccgagaagcctacacctaccacaaacttcctctttttttttttggttgttgttgtttgagaaaagaagaagtccataaagcaagattcccgtaggtgggcactgggcatgcgatgcaaggacaggtccatcagtccatccgtcagtcagggaatagcagctgcggtgcaggagcacgcacacccagctccctccctcccttgttcccaatcatttgctcgctctacgtgctcctgctcttcaccgtcggagggaacgggtcttgtctgacggtacagtcctcagcaaggattaccggtaaacacggcatcgtttatctgtaaacttaaactagcactggatttaacaagcgcacaagctagtggacactgaacaggccccccggccgtgccatacaatcaggtggtaataatgcagcaattatgcggctgcttacccctggggctggggggtgggaagccaataatgttacctcgctgacagaaaaacgcatagggaggaattcctttccggattcccttgggtccacaatcaatccccttgcttttccctcgccggtgcctgagtgactctgatgagctctttggcaaatggatgacctgtgtggaactctgatgagctctttggcaaatggatgacctgtgtggcttggccaaatggtgagtgagtggagcggagcagctgccgctcactcagctcctcctcgactcgccccgggcatcattcacgaatctgcttttcccccagccccggaaatacgtttaaaggaggccgttttcagggacgagatgaggttgattaaagcaaagcagagcagagcagagctaagctttcttgattccttcccagaatgtcgctcgagctttaggcaggcaggtgactgaaaacgtcaactgcgagggagaagagaacacgcatatgtggtgaccttatccatggcgtggtgtggtcgtggtcgtgtgtcccc

SEQ ID NO: 1400 - DNA, 1212 bp, Zea mays
  misc_feature (1)..(100): optimal_loci_14600_G1, chr1:80486200..80487411, Cluster 9
tttagggaaaaaaattctcggccggccggcctatatcacgagcagatgaacagaaaaactgagttttagctctcgaccgtacgtcgcgctcgcatggatattttgtactaccgtgcgcgtaccaacaatggcatcgttatcggcgttcggaaaaaaacggcgccggctgcctaataaccggcgggcggggagggggagatgcaaaggtgtagtgtcgtgctactacgctcgctattctacacgcatataattccagtggccggccacgtatcgacgacgatgacgagcaactcgatctgttggaagaaacgaagaagcgcatatcactggctctaacaactctttttttttttggttgttgttgttgttgtctcgagaagagtggggtacgtacaaggatgccatcgatagacgacaacacacccttggtgataatattctacaccgtcactttgtagctagcacatgcacacatctccaccccttcatctttccaccctgtaaagagagagcttatcggcgcaacgtcgtcgtttatatagtgagtatatatatataagtggagttcgttcgaattaatcgacagttgcatcattgggtgggcagagtgccagcagagagggcgcccacggcaaaacgtgacggtccgactggactcccacgcgccttggattctgctggagcggtgggtcggtcacacacgacaacgtgatgacccatcatcagctgcgtgcccacccgtacggacgctacagagaatagagagccgactagtcgtcctatctgctcgattccagccggcgacatcagcgccagcggtgtagagcagaggaggactgttctaccggcggtcgtccggtcaattcccgtcgtcgccgcggcaggcggcagcaaaaaaactagcagctttaatttgacgggaacgggttcagcctttgtttacaacttgtcttgccaagctgaaagtggagagctactctctcttcagtcttcgcgtacgtatactactggtgtagtactacgtattattcgttccacacttccaccgaatacagcggccggcgtcgtccaccggtagacagctgccgccacgtctcgcattcctacgggccgatggccccaagcgtgcgtgtgtgtgcgcgcgcgctctgatgctgactgtgatccacgcttcaagctatggctggtagtacggtagtagcagctgcgtgt

SEQ ID NO: 1401 - DNA, 1231 bp, Zea mays
  misc_feature (1)..(100): optimal_loci_15412_G1, chr1:85023530..85024760, Cluster 9
tacgtatcgacgccagcacattgcaaacgtggcatgcacgtccgacgccccgctgatatttctgttatgaacaggaagaaacatataggtggtatggcgctccagtgacttgctcgtcgttgcaggggacgtgagcatgcatactctgactccgagccactaaaactgacaacgtgcgtactggtcctatgtgtgttggtgacatccagaacgtcactgcgttttaccccggccgcaaggcaggtgactgactgtgtgtgtactagcagtattgaccgagcagtcgaatggatgccggcgttgtccattttaattaaccggccggtttttgaccttaggctactgcttgggataaacgtcgtctgtctcgttctttcaattctgaagtggcctaaactgctgtcccgatacgttcaagtcttccttgatcaccgcaagtactttagcactactcgagcgtcacggcaaaactactcaacgggatgagacgacggaaaacggcgcctaaacaaagcttccggctcaaaaaagggtggtcaggcgccgcggcagcgaccgattcgctgaaccggtctcgagagaggggataccggtccggttgtcactggatgcaccgcgctggtcgatcactgggtgcatccgtgcgtgcgtgcttagttgcgtagcgttcactgaaaagcaaggcagcagctggtctgcccggtcacgcagcccgctaggcctggcccagccagatgctgcctccgatgcacaacgaactaatcacaaacgcgcaccggaaacacgtgatggatggatccatccatccacggaccggatgatgccgcctaacactatcgatcgggcggcctaaagcaaagcggccccgggccccgggccccgggcgcccactcgcgtcggcgtcgccgtccccccctcgcctcgccgccggagttaagtgcccgcgggtcccactgcctccatccatctgtggatctgagaccccgagcgaaccaatcattggtttcgtccggtgcagcgcacccgtcgcccaaccggacggacgagtgagcagagcactgatgtgatggatataggccgtgcgagatctcgaccgaagggagccaggcaggggagcatggcgccgcgcagttcaatgcgcgcaggcctacgaacgtatacagatcaccgatcgatcccagcggggggggagggcgccaaccggtgaggtggtgggcagcggtcacggcgg

SEQ ID NO: 1402 - DNA, 1011 bp, Zea mays
  misc_feature (1)..(100): optimal_loci_1553_G1, chr1:8018961..8019971, Cluster 9
acccactggagcgctagcgctagcgctgattgttgtcccaagaaaacactaaacaataacttgggttcggatatatataacactgcacaataatttaggttcacgtatgcccgaatatgagaaaaccaacaaaatagacaagattttgctggtgagaaaaaaaaaatataatcaatcacacagctaccaaatatcaaacagataaatataagataaacacgcatacataccacggaccgcacaaccagtgagaaaaccacctatttgctatcagtatatacccaatttgcattctttacgggtgccactcgtttgactgatgggtatttcagctatgtgtagtttggaatagttcgtgttcgggtaccaggtgtcgtgccggaccctagaaaaggctatggtgccatccatccatccatcagcgtctaccgtcgccgttgcttttgagcaacgcactgaatggatcccaaggctcgatagccatgcctactacgagtccgaggtagctaggaatcctaccaggataccgacatcggaacaactcaaaagcgctcctgctttcagagacaggcgtggattctgcagccaactcattgcctacgcaagaattcaacccccaactgtcctagtatgagactcttctccagccacatgttcctttcagttttatattgggcggaatttgatgctgcaaaagaatccacggtactcttgatggacttcacaacacaaaatataacatcctatctccataaaaagggggggaagaaaaacaacataacatgcaagctacttgcatatacaagtaataataaaaacaacataacatgcacgctacttgtgccgttgccatgccatgacatgccatgtagcagcagtcataacatgtagctcggttcagaaccctatatatcatcaggcagacacgccaaatatgctacacggcatcgcaaacagtccaagtatcatcaagcactagttcctctcttaatcacacagttctctagcaca

SEQ ID NO: 1403 - DNA, 1244 bp, Zea mays
  misc_feature (1)..(100): optimal_loci_156598_G1, chr4:155314998..155316241, Cluster 9
atgccccaacgcgtgaagcctagacgaggagctccgactccagcggtctgatgcacgcgaggggagcgtggcttcaaaagcccctgcgtgtgcgtctgtacgatgccatgggagctccagcggggtgattccgatggggtaacacctccagcactgagcgggcgtgccatcgagatagactctggagcctggagcctgtgcagtcacaggtcgcatcgccgtccgtgtctttgtcgtcgagctcggtggcatcaacaagctcgtcaagcatcggcgcctttccatggccccggttccattccatatattgactgcatgcatgtcgagtcatcatcgccatgcagtggttcaacccgattgttcgttgtagtatatatgtagataaatatatacattgaatttaatcatcgccatgcagaactagataaatgactctagttcttgacttcttgcagattcggtggtaaggcattttacctcttctttaatacaaacagaaaagatgtgtttgagtttggattcttatttctatccaaattatgttaagcataggactgtttctacagtcataaagttagttagaggagatcagatagagaatagaaaaggccaggtaaaaaaaataaaaataatttccatacgttacgatgaaagatataacatatcgtgacttcaagatttattcaaaactaatcgtattatagaactaaaacatttttttttaagggcctgtgctactcgaggcgttggttgagcacacgaaatcgacaagtctggttgtaagagctgggcccatcccatcgtactcccggcccgaaaatccaccgatacgtggaaaggagggtacagggccggagagcacataccaaacaggcgcatccttgtcacccatgcgtgtggggctgtactgctgccagagttggcccaagcctgaaacccaccgcggtccaagattctgtaacctgtggcccaacatcaaagttttcaggcatcacacgggctgagccatggcctcactcttcaccgatctgtctcgctgagaatttgtgaaaactgaaagcccaccgcctcagggccttttcgattatgtctagatcgtagaggattagagaaattaaatctctcactgataaaaattaaatagaaaaaagttaatctccttcaattcagacgctacttaccgttccggactttcgattgagatgatcattttgaggggtggaccggtggtgtttaccgactac

SEQ ID NO: 1404 - DNA, 1258 bp, Zea mays
  misc_feature (1)..(100): optimal_loci_159522_G1, chr4:172516439..172517696, Cluster 9
aataaagggttatacaccccctatttcgagggtcctatatatgaagtcaccgaaaataagagctctatttttttggcaaaaaaacattcaccatgaagagaccaaaacatccgacaataacatcaggaaagcttccgtcaaagctcaccttattaacgaaagtcttcgcagcagtacgtgagtgactcaacaatgctgggagaagcacacgaataataggactttcgtgctaaaatctgctctatcggcacgtacgtgcgacgaatacaaacttcaacgacgacgacgacgacgacgcttccaagagagaagataactcaggctggctcagagtaaaagccggtgagggtttttatcgatagactggtccacaaacgtacgcaagcacgtgacacacggtcatccatggtgcgcggcacccagagcgcagagaccgcaagcggccgagtgcgtcaacaccactcgcgcagtgcacgactcaagccgccaacatgcatgcatgggtactacggaggtcaggtcacacagacacaggcgatcgacgacgtcgccgcgcaccatgcatgaccgctgaagccaccgcgcgcggagcaaggggacccggccgtgcccgtcccacgagcacagcttaagcgccctgaatgctttgaccgcctgcacgtgtgtaacaaccctgcctcctcgtcacctacatgctactatctatacacgtggcgggcagcaggctacataggcaggcacttgcatgcatgcatgcatgcccggccatgacgtagctagcccctttcccattcgtcggtacggttgttcatcgtcacttgagagaacggtactgtctcaggtgatcttagcctatatatgcgcatccgcatagactatgagtctccttggtacagcttacaatgcaagccgtttaataggccagtctcaacctagaaattagatagtttttgtggtcactaactaggatatatatcaactaagctaaataatatatgacatttggaattaaggaatagaaaaaaaaaaggaaatggattcttataccacaaaccatatttacacgagaaccactataaaaggagataagacagatggacgatataaacaaaatgggttttctacattttctcctactctataccttaattagttttgatctactcattctaaccatgtttttttgtgtagctttttagagaaacgtgtgtcctaaaaactatattgtgtgcatggggcctaccatgcgtccacgcca

SEQ ID NO: 1405 - DNA, 1111 bp, Zea mays
  misc_feature (1)..(100): optimal_loci_160231_G1, chr4:176509399..176510509, Cluster 9
  modified_base (957)..(957): a, c, g, or t
  misc_feature (957)..(1056): n is a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
  modified_base (962)..(962): a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
  modified_base (973)..(973): a, c, g, or t
  modified_base (974)..(974): a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
  modified_base (988)..(988): a, c, g, or t
  modified_base (989)..(989): a, c, g, or t
  modified_base (990)..(990): a, c, g, or t
  modified_base (991)..(991): a, c, g, or t
  modified_base (992)..(992): a, c, g, or t
  modified_base (993)..(993): a, c, g, or t
  modified_base (994)..(994): a, c, g, or t
  modified_base (995)..(995): a, c, g, or t
  modified_base (996)..(996): a, c, g, or t
  modified_base (997)..(997): a, c, g, or t
  modified_base (998)..(998): a, c, g, or t
  modified_base (999)..(999): a, c, g, or t
  modified_base (1000)..(1000): a, c, g, or t
  modified_base (1001)..(1001): a, c, g, or t
  modified_base (1002)..(1002): a, c, g, or t
  modified_base (1003)..(1003): a, c, g, or t
  modified_base (1004)..(1004): a, c, g, or t
  modified_base (1005)..(1005): a, c, g, or t
  modified_base (1006)..(1006): a, c, g, or t
  modified_base (1007)..(1007): a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
gctaatgtcgtgtcgttagtagctacgttggtgcagctacgaaattattggagtggtctttcagtggctgctgtttttgaagttgataaaccgggttttagtttatcccaagatgaaattgaatttgatgtacggattcagggagaaccgggttatcaacttcagaaaatgcgaccgcttttagagttactgaaataattttctggaaaaacattatcttttctcctaaagaacgagctcagcggggaagttgttgtggcatggtgcgtctcacaaatctcccacttccccgacggttgccctctcctgggcgacgccctccgctctgttcttcttggcgaatttgagtcgagagctacgggcatgcctatcggcccagcccaggggaggtggctccaaaaacccaccctctgcgcccctacagccgggggggggggggcgaataccccccccgtcttttggcggtgactggtgccggatgatagctagtgtcagatgatagctgcaacggtgcctaagactattgtaccccccaaatgcttggtggggttagtgatggcattgtgcctagtattgacaagactgtgttcgcgtttgttacaagtattagtcggttggttgcttggtggtagcatccaggtcttgatataacacgacagggctttcgtagttgggtatatggcctggcccctcatccgaattgattgtccctgctcttggccctctattagcgtgcttggccggaaggtaacgacccgtggcatggttagatcggggggacgcaaacagtcctgaagggtggagtggccggcccttggtagcctcactgaccgtctgtgcccccagtctttctctcccagcctgtgggagaagtctcgtactatctatccatggtgggactgatgtgatgagaggcataagtctagactcggcggagccacgatgatcactaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgctacggcgagccgtccacgcgcgccgtcccggcgagtcgacgccccccccg

SEQ ID NO: 1406 - DNA, 1033 bp, Zea mays
  misc_feature (1)..(100): optimal_loci_160842_G1, chr4:180378032..180379064, Cluster 9
tacggtggtacaagatgagacggtacgggtaaccaaacatacgataagagaatttgtggattcaaaatctattctgcattatctttttttatagttagatacgactgttgtttctagacgaagggatgcacacatttcagtccaacatcaaagccatgtcgtctgtccgatgtgcgcggcgggatgatccggacatcagccgtctcctctaatttttcgtggacgcacagctgagaagatataagtagtaataataccattgattctatgtagcgtttggtttcagagctagtggagaacttatgatggaactgactccattgcagagagaggctatgtccgaaagattttataaaatgaaagccgccggatggttcaatatttaagtatattttttagagccactctattgtatatataatcaatctaaacacacaacaaaccggaaccaatcagatcaagggccagagaggcagagattctgagtgaacctaggcacctattatcaacgtcatctactgttcttccagtgttccgtcggccgtatttttttgacatgaacagtgatcgtcattggcaccaactatgtatgtgtcacatctgccagcgttggaagatgcaaggcgcccatccagtttttttgtatcgacgttcaagggtctccgtgacgccgtacatgctacgattgtgctactcccaacatggcagaggagaaaaaaaccgatgtcgctgtcgctggtggaagaactgttctgcgcggctgctttggctgatacgacctgtaggttccttcagatacgaacagcggaacagtatacgtacagccgagcagagactggcgtttggcacctgctgccctctgcatgcgtgtgcgtacaggagacctggaagatcgccatctgttcttatctcttccgctgttgctgcaatggtggagacgatcggttcgggagcatgacgccgtccctgacgtcaaacgtcgtcatgacgagaggatgagagagagtttgcgatcgcgatcgggcggctgcta

SEQ ID NO: 1407 - DNA, 1050 bp, Zea mays
  misc_feature (1)..(100): optimal_loci_161093_G1, chr4:182048449..182049498, Cluster 9
cattcggtcgactggccatgtccattttacttcgtgttgtgtcgtgctttagacttctattatcgccaaatagctcagcccaaacttttatgtctacccacgagcacagcctgagccatacccgtacggcgagggtaatggctggactctcgtatcagtttcacttgtaccctgtcgctgatcaggtgaaccacgacggccgctaccgcagtaataaccagtcaatcaatattcgaaaaaactaggcaatcaattcatgtgctctgtgtccgctgtgatgctgcgtgcccatgggacatgatcgcagagagggaccatatcgtctctgcacacaatagtagtcgtgctggggcgcccaaaacatcttcaaggaaatacaccagtttcagtggcagcacagtgtttagcctctgcgctttgatcgaatagatttcgttagatttatcaagcaggtcttcaacaaattacccagggcgagttcaagtttttttaaaaaagaagaagaagaagaagattgttctggtttgatgttgttttccttgcgttgattgatatgtaaggctcgcgaaagcacaagtcagactgtcggggcattcgacactcgacagcaccagactgcccatgcaatttgtagaacgattgtggcgatgcagctgctagaagacaaagcaatacaacagcagcgggacaggatgcaggcgtagtgctatggtggctttcgatgttggccatcatggaggcacgcccacgaatccgtattttcttatatggcacttgaatatgatggatgggtgtacaccgatgatagtacgcctgaattttccgtgtttttgttgtttttaccaaaattccacattcacatatctcgtgaaactattattactacgtttggatccttgatcagcgtcgtgacctatctcgtcgagtgtaagaaatgtaatgacgaaaagaaagataaattaagcaactcagtgttctatttttaaccatgaactttgattgttacccggtcgaatcccatttaatagaaaaactatctacatatgtaac

SEQ ID NO: 1408 - DNA, 1092 bp, Zea mays
  misc_feature (1)..(100): optimal_loci_16432_G1, chr1:91236617..91237708, Cluster 9
gcaccgtcttgttgttgacgacgtgcccacgcgacgaacaaccagacaagccttagcgagcaagcgttcgtattcttccttctacctctcaccgaacacatacaaaaatgtgggaagaactcatcgggttccctccatctgaactaaggtaaaagtaatggttttatacttctctcaatactgctatacacctctttataaattggcctatgaggttttctaaaaattattcagatttttaaatgagcttggttcgataattgcaacataaacaaggccccagtaattgcccctacaggctacagcgcctggccggggagcttctataaccttcgatatttttttctattcttcacaatttgatttatttgtttcctttttttcatgcctgcatgcacggactacagtacggagtatatggtactctatatgtgaacgttagtttgggataaaatccaaattgtagatgtaattttattatatcatggtacagagtgaccggtgctctatcactgtgcctgccagaggctgaccgagaaagtgatgatctactcgctattttgctcggtggatcgagttgttgggccgtcaatcagagacgcgcggtcaggctcaggcgctcagctcggcctgcaaacggaagatagcgtcgcgtgtcgccatggattcgccggacacatggccaccagcaataggctgcatcacgacatgacagtagtagctgccgtacttgctagtcgacgccgggtacaggacgctgctgcagtcttttgactccatcgggcttggcaccgaccgcatcggcgccatgtccatgtaggcgcacatgccgcggaccgcggggaaacagctcaatccccggcggataaagaaaaggcgaaggagaaaaggtgcgcccgaaaaaaaaagaggacgtgtatccatgtgtcggaataaaaatagatgggtgaagatcttaatccaaattataagtctttttagacaatgtgtaaaccaaacttatacaactttggctataaataacaattttattatttggttttgaagcttaatagtcatatgcatcggcttaacttaaaaaatatttttaca

SEQ ID NO: 1409 - DNA, 1221 bp, Zea mays
  misc_feature (1)..(100): optimal_loci_170646_G1, chr4:231493941..231495161, Cluster 9
ctgaccgcgggggacggtgggtgtcggggccggccggcgtggcgtggagccaacaggattgcagaggagatctcaatcgcagccgaaccctgcctgacgcaggccaatcagccagcctgctgcctgcctcataacataattgcgtcatcaatcagcacacgcctactacagtacagtacgtactacgtacagtgtcgccatgtccattcggcattcgtttcattctggctacgtacaggtggtggtttcgaatgaaccggcagatgaacagaacaggacaggtagggttggtattggaattggaattccatggggacgcgacgcgagagtagctagctacgctgtcgacgcggccactatagtagtggagtactactactctttaatccggttcaaacatgtcgaagctttacgcgtacgtacccactcctacctgcctgcttcttctgtgtgttacttccgtccgtgttgtcgtccacccaacgggccaaatgcgaacaaattggagatctcgtcggtcatgcatgccgatccatccatccatctatatactaccgtatgatgttttttttttgttgctttcgttggacaggtagctagctaggcacgacgacgtcaaaaaggcgcatgaatgcatgccatacaatacacaaaggtagtctgaaagtgcttggccgagaccacatacaaattcttgctcgttgaatatagcccagaatacacgtaatatatatatatatatagttaatcaacgccaggtctgcgtgtgaattagactagcctaaaggacgtggcgtcgtacgtcatcgttcgacaaccttgatgaagcgcctcgatcagcatattcaacgctgctgtatatgcattattctgcggtccagtcaaacatatgctgaaagtctgtacttattacgtcacacacgtatatatgaccgtcgtcgttatccccgatactgattactggatgcaagatgccaaccaatgagtccatatctgcgaatataaatacatcacaccagatgtcatttttgattaaaatagaatcagcataatcagaccgacccaacccggacctatcgcgctttcggaacaaacaggcttggtccgagaagtccacaaataataataataataaaactttcacaccgtgtcctgcagaagaaacagtagcctatcccgaccttaaagcatgtcgtgacttcattcaccgcgccgtccagg

SEQ ID NO: 1410 - DNA, 1062 bp, Zea mays
  misc_feature (1)..(100): optimal_loci_171183_G1, chr4:234514360..234515421, Cluster 9
gctaaaaaaaaggccctagaagacatacaaagttagctagcggctagtgttggatgaccataagacggcagcaagagccagatgcgcttgtgtgtaagtgtaactgatattctacaaggagaacaaagtgtccatatctaactagttatgcatcattccggcctcttggagctcagtttcaatatagggtttggcaggtttaattacacgagaggacgacactgggggtactatactacggtgccaacattgttggaggcgcctacctcgcctcggtagtgctccatgactcctacttcaacctgccgcgatggaccctgcacaacagcatagctagatctagctagcactttttgtcgagagcttctttgttatcctcccacttcctatgtttcttgatgaaccctatcgtgaacatgtgctaatctccggccgatccgattgtcctgcgtatggctggcagcaggacggaggatctgaagatctttgaatcaccagtcggccgatgctcgcgcgtgcctcgattcttttctcgaggctagctagctacctacaggtgacgcatgcatgcatatatagttgcatctgcgtgtgttagatgagcacttgtaaaagagatcatgtgatgaggggggggggggggggggagagagagagagagaggaggaagacgcggccggactatttagctatccgtgtgtgatgaagggcagtagcagtatatgtgctgctttgatgaattccatggttggatggcatggagggagcgatattggcgaggttcaatcagatgatgtatttttcttatatataaatttgcatgcatgaaggtgtgaatccagtgtctgattgagccgcgccaatatcacttccttccaccataagtttacacacagagaggattgcagcgagcgcgtctacttccaaaggttagaccactcgttatttcctcatttccaaattacacttgtctattatactccctctgtgccattatagtgttcgttttagcttttctttgtccatattaaaatagatatcaatgaatatatatatatataa

SEQ ID NO: 1411 - DNA, 1349 bp, Zea mays
  misc_feature (1)..(100): optimal_loci_171923_G1, chr4:238115087..238116435, Cluster 9
ttgtatttgtagctgtaattattatttaaatattggatgtgacacacattaacttttgttcagtggatatctattcctatccataccagtataccacaccacacctttgcatcccgccggcgccgagcaccattttccccccgcccatcgtcacgtcagctccatcgtgatcggtcactgtgtctccgccaaggacagggacaggccacgcctgccgtgctgcgggaggggatcggagcggcctggtgctggggcaggggggcagtgacgtgcttgctgcgttttatttattttattttattatattggggaaccaaccaaagtacagtacagtatagtagtagaagagaacctgatgtgccatccatccatccatccatttgggttcggagatcagatgccatcgcctttttaattgccctttggttcgtcaccgttccaccgtccatccacggatgcgcgattgcgtggtatcgtcgtcgtcgtcttttctgctagctgctgctgctaggagcctaggagcagctggttcactgtgtaggagggaatggaatcgtctctcccaaacgccacccgcccatccatccacttggcggctagtcggctacacagccaaacgcacgcagccagccaagttgtgtggtgtggtgtgcttgtgctcccgtcccgcccgacgagacgagaggacggcggtcgacgaacggtcaaaagacacccttgctctgcccgaccgatcagctgcccccctctctctctctctctgtgcctggaaaggatagggatgctcacgaagcacaggcacgcaccggccaccggccaccgcagcgcaagacgacgacacggcactggcagcagagcagaacagagcagatgagaggccgggagtcgggaggggacagcgtcgccaggtcgcgggagcaataatggctcatggccggagcactgcgcagatgagagagagatagagagagagacggtcgaggagaccggccggccggtcgctgtcgtgtccggatggctctgccagcgcccgtggggtggaggacgccacgccaggacggtggccggtgccgtggcctcaggtaccggcacatggccggcgcgagcgagctggcacctggcagagtgaaagcgaccaccagccggcagggccggtccctccctgcccccgatccagtcctgtccagcactgcttgcttgcttgcttggcgcgggggtgggcgaatcagaaaatggtgagcccgcgcacgcttcggctgcagcggcggcctgcgctgcggtagagacgagatcggggtcggagtagcacctgggcacagtcgcgagccgtaaaagatacgctatacaca

SEQ ID NO: 1412 - DNA, 1000 bp, Zea mays
  misc_feature (1)..(100): optimal_loci_172219_G1, chr4:240345335..240346334, Cluster 9
tagaaaacattaatcttgtacgttgtattttaccgaaaataccattaaaaaataaaataaaaatatgatatatttcggattaatcagaaaaacatatagcctttttaccacattttcttctaattttttattttttaaatcttgagaaaagttttaaaaagcgaccgaaaaagggaaaacccattttcaaatcgggccagaaacgagaaccggtctggaaaccgcggtaaaccctgatctcaagcgaaaccataggataacctggcacacggtgggttgcttttcgaaaatcccaatagagacaggctgcgtgccaacaacactgagcccatggtggtggtgcacgtgcgcatcacagtcgtccgcgcgtgaaaatctgtcgctgatacccccgatcggatggcccagtctcgttctcgcgcgaccccatccctacgggagcaggaggatacgagacgacccccgaattcccaccatgacacggactcctttcccaaaagcgtccatgacatccaaatcgagcagagccatcggattcggggccgcaaatcggacgactgctaccgtggcctggatgtttctccggtcccataaatacgccgcaatcacccccacctccaaacgctcgctcatcgtcgccccgcgtcctctttgcctagtatctacgatacgagcgagcttaagttccaaacacccgaatccgccatgttggtatatcaggatatcctttctagtgcgtgcgaacttaactcaatctaattttctcctctattccttacccatttgggtcgattgctgagttggcaattggaggcggatctggttcctcgttattctgtcgatttgtatctcagactcaaggctctattgtgacctgggtagctataactgcgatcaattcaatgagttgttgtgtgattcgtctaatccgttgtgcgctctggtacgcatttttgcaggggacaagcttttgtctgactccttctcgtacaatgggctc

SEQ ID NO: 1413 - DNA, 1090 bp, Zea mays
  misc_feature (1)..(100): optimal_loci_174513_G1, chr5:12661008..12662097, Cluster 9
tgcaagcatattcctaccaaattttctttacaagcgctttccacgcacgagtgtccaactaccacaccccatctaccaagtaccactaccattccccccaccgagtcaccaattcatcacagatcccagagcgaagctgcattgcatgcggctacgacgaaacagatgacatgtcgcgcgcgggcccgcctccgatcagaactgttccgcacgggagcatgagcatgcgtgcgggtgcagcttttggtggcttgccaggcttggcttcgttcagttcagatcactgccgcggccaatagctgactcgatccggtgcggcgtcagttctgacttctgaagcagcctctcgatcggtcgcgtgattcgcgtcacgtgagggtcgtcgttggcgatcggtgcggcgccgatccatcgaggacgacgacctttcaattgcaatattgcgagccaactgagtgggaggagtacatcttgtcggtgaacactcaaatcgcactagtaatcaaagatgttgatgatcaataatcataagctctcgtcagtttcacaatgtcaaaagtcaaaggaatgaggatggcatgcagatcccatacaccactgatggtagcgcagaaatcttccgagacgggcgtcgagcacgagcttgtgcgccagtatctgattttttatgaactttttattatttcttccggtgcacgaacaaggaacagcaatagttttatgcgcgtcggtggagagaaaggtccaagtagatgttatgtgtttgtagtttgtttcctccacacatctcacagatgaatcatcacatgctcagaatgttctaaataattagagattttttttctatcacgagaactttctttctttatgttttatttctcctaattataatcgtgtggaatataaagaaaattttgctcttcatatacccctatggctagatagtaattttaagtggcatacttcttatttgttttggtgagagattgaaacaatgtttagcggacatcttttggagagagagaaaaaaaaaacacaaggtccaagtgtgtgttatgtgtttgtttcctccacatcttctatgaatatt

SEQ ID NO: 1414 - DNA, 1234 bp, Zea mays
  misc_feature (1)..(100): optimal_loci_174747_G1, chr5:14092056..14093289, Cluster 9
gcaagcgggtatcatggaatatataggcttttgacattttttttttgggtgtgtgaatgaatgaatcgatctcctcatcaggacagcatacaaaagccaaaggtaggtcgcgtcagctggcgtatctcgcgcacacacagactcggttggcatcgccgccatgatgcccatgttatttcgagttgatgggagcaataataataataatagagctgctgatagcttgctagcccatagagttttccacgcacgcactcacgcatgcgtcaacaccaaaacgacaacagcaggaaaagaaaagaataaaacaaaaaaggaatatgtatacgtatcgcattcactcgcatggctccgcgtgcgtcgtccgggtcgatcgatcaggcataattttacccacgccttttaggctttttcacaaatttcaaccccgccttttctttcctctccttttccattcggcctctccttttcgttatcacataagtatccctatatattccttgcccctgtggcacagcctgatcggaaaaaggcagaagcgattccgatccgtgcgttgccactggtctggtctggcctggtggacgcacgcaatattatttgcatctcttttgctgtgtgagtgcatagcgacgacgcacgacgacatgtatatccatgctctctgtcgccatgcgtcttctcctgccgatgctgccgcctgagatgtgaacgtagctagctagtagccagtatagctcagtgccttaaagcactaactacacaaggctcaaaaggctaagcgtacagtatgtagtggagtatgtgtagaatgtcgacatgggatcacgtgccgtgccgtgccgtctttgtttgatggatggcgcttctcgctttgccgtccaaggaggaggaagaacaactatacgtttcgttcttgttctttttttggccagtactagctagagcggagcaagtgctgtactacgtcaccaatttgtagtagtgggtattattattgggctacacacgagcaaaaaagatattcgtttcttttcctttattgccgatcgatggaaaaaaaatcccacgtccgaccgacggatccacggtgttattacctttaaaagttttgtcaaacaatgtcgtcccgccggcggccgtgtctcttttgttgaactctagctgtatagaacggttcccccttccagcaagtagtgcattaggtttccgacgtgacgcatcgttatctcta

SEQ ID NO: 1415 - DNA, 1302 bp, Zea mays
  misc_feature (1)..(100): optimal_loci_176403_G1, chr5:22774960..22776261, Cluster 9
catagtagttgcacacgcgggcgctaggggtctacatgacagtagctgagagaacgttacagggcgcgggaggggggcacagagcacggcgctgaggagaggagagtgtaagcgcggaaggtgaagtcgtggtagcatcagatgtccatattaaattttttaatatagaaatatagatcaatagatatgaccttctctcttccatcccactttgtgcatactgcacacaaccaaacacagcgagtagcatcaggcatcacgcggcgctaaacgcttgcggtcaaatttaaaaaggcgccggtgcgagagcgaggccatgtagccggccactgccaagcgcgtacgtgcgcgcaggcccgcgcccgcggaacagacaaaaacaaggccaacgagcaacgagggggatgggggccgcgcggcgcgcgcgagggaccaccagcagggatgccggcacggacccagcgcgcgagcgcggcgtgcgatgcgatgcgatgcgatgcgagtagcagtaggtgaccggtgtttcggttggtagctagtggcctacatacagtccccccgcccggcctcctgctcgtcatgcactcatgcaccgccgccgaggggagccgcggtgggccggcccttgtctctcccctccaggcacagcagagaggcgacggttgtagcaggttgtacgagtcgtcgtctactcctcctacctgcccctgaccgccttgctgccggcgccgccgcctcagcgtcacggatcggacgcgcctagaagacgggacacgggatgatgtgattggtaggtgtgcgacctgttcgatggccagagagtgccaggcaccggtgaggtggaggttgtacttgtacgtgtgttgaacgagctaatccgggtgcggcagactggggagcaaggcgtaggcgtaggccggtggatgtttaggcaaggcgggcggggagcaagactggtcgggtcgtcgcgcctaataagctggcgtttgcagtagccatcacgtgtcagtcagcgatgcagcgacagatgcatgctcttcttcaccatccgtggattaaactctaaaaaagcagtactactagtggtgtgcccccgtcgacagacaggtcattttccctttcctggccgccacgtcagaagctctgaagaaaccggtctagtaatgcctgcctgccaagtgccaacacacgctgtgccagtgccaccctgcatatggctctctgcattctgcaacgatgtggcgacgactgcggtggctggctccaaactagcgtgcgaaaaatccctcgcggtcaccaacg

SEQ ID NO: 1416 - DNA, 1036 bp, Zea mays
  misc_feature (1)..(100): optimal_loci_178311_G1, chr5:32464110..32465145, Cluster 9
aacacaagtacatctgccaagcccttagctacgccgacccagccctcgcctattccagtcgagcccttggccgcgctagtcgatccctcgactgcgataggtccatcatcaattgccacaaaaccgagaggttattctctctagctagagattattcgttctttaaattttgtatcttgacagtcgttgcttcggtgtaggaaccatttggacgcccacaccaactgcggtggcagcggttgggtcgatttcgacgggcacaaagcacaaccattccgtcttccgtgacctccgcttcagtagctgccattcttgcttgccggcttgtcgttgatgccacgcatcagcgctgctgacaagtactccgtaacaagttgcaccaacgaccgcagcataagcagacgcgagcaaggccgtacccgtcgctattgagaggtccacggcgaaggcacagcacagcagcacgtgtgcagaaactagctactactcgtccaggcacgtgggcggaaaaacttgacaacctttttggtcgtcgttggctgaggcgctcagcagccaacgttgctgcttgtaggttgtagtagtaatgaaaggacagggccggccgatggctcgcgtgctgccttgctgcctgtctggtccgcccgcgtgggacgaaaattatacacagatacgcatcatagtgcaggagattcgtctgtttggcatggtctcttgaaaatcaagcagtagttttatatgagggggaggccggcaggtacggtggtttttaaatccggagataagaccaggtcttgggaagatcgatcgttggattaatatccagcctttgtgtgtcatttgctcctgacctcctctatgacatttgcgaagataaaagagattatggcaatcaaagtaaaaggagctaattatcttttggctttcagaatatggttgcaaggtggtcagttgatgatgtgggagaatatttgtaagatgagtagggagtttgattgtctggctttagccaccgaaaataaaggcatgtattttc

SEQ ID NO: 1417 - DNA, 1277 bp, Zea mays
  misc_feature (1)..(100): optimal_loci_185386_G1, chr5:79850214..79851490, Cluster 9
gctgcatgcatgcatgccctctttcatcacacacacagacaaaagtttacagctagtgtacgcctccttatcgccaaccttgcacagaaaggttacaacgacgacaagtgtgctaggagtaggagtagtagcatgtagtagatagacttcctacgacgattgcaagtaaaggctcgtgtggacgtgacgtactgacgtgcagagcggcatgcagtgcaggtcagccggccgtgcttggagaatttggggggtcgcattgcagttgctgcccatcccaattccatgtggcatcgcgtcggtggacgggtggcagtggcactgctgcatgcagcctacggtcgcctcccccctcagctcgtcgtcatcgtgcgtccactcactgtctcactactgcaccagcactgctagctgctgcctctttccttcttttttttcccccagtacaccccggccagagccctagcgtaggcggtagctactactctaactagcagaaaagggaaactgtcgtcacagcttggcagacagacagcgggaaaaaaaaaagggagatggatcggagggttggagaggcggtagcaactagcaaagcagagcagagagtgagagtcagcaggtgcgtgcatgggcgcatacgcgcatggccgctcgaaagcggcgtgcatgctctgcttcgagctgagccgacagccgaaaaaagagagcgcggaaatgtaaaagtgaaatggcaggcagctctacacctagctagctataggtctagtaggcgtagctagtgtactcgagcccatactaggaggaagagtagtttttttttattaatgagctactgacggtcggccgtcggagaaggtatgtgcatgtcgatcggcgcatacacgtcgacgacgttacacagccaaggaataaataaataaatagataaataaaaaggagagccatactagaaccgaagcaaataataataaatcctagtacgcgcgcgcgggcaccatgcataataaccaggccaaaaaaaaattctctcgaaaatagccggccggccaggtgcagctagcacgcatctgctagctagacacggcagtagcgctatctgtctgcatgctagagactgccactatcagagctgctacttctgggccattcggaatgagagtactactccgttgtgtgctgcatgcgctcgctgtgtgttggagttctggcggcagcagtaaatatctcaaaaggcaacaaagaatatatataaatatataagattataagttaccaagtat

SEQ ID NO: 1418 - DNA, 1013 bp, Zea mays
  misc_feature (1)..(100): optimal_loci_1912_G1, chr1:10021311..10022323, Cluster 9
tgactatggctatttgcatgtattaaacgatctagagatagttaaacaaactatttggctgtccgcgtcattgaacatacagataacttgtatgtggggttgaacatacctttacatacatggcgtggagcagcctccgatccaaccaatgaggtgtttgccttgtggttacctcatcttgcttaggttagtgtaagcggaggatctcgtatcctacttttcaaagctctcgtgtactgaaaacggtgtggattatttgctaaacttgtttcattccaatgaatttgtctttcttcatcgatgttgtgacatgtcatgagcatacggagtatttgctcaagttgctattagtttatttcatactatatctatgaaactctcatgacaacctacacaccaagattggtcattgtgctgtgtgcaaatttatagcattaaactacgcacactgtcagggtgatgtttacccagaaaaccaccctgcaaccctcgttaattgtctataggtgaaccggcaccaatctgaactttcgaacgcatcatgctgtcatgcatcacgcatgcctcaactctcgagtcaaaccatgcgcgttgggtatacgatcaaacacgagctagtagtactagcatctatcgcctcaattatttgtattaacacgaggacgagggaaatgcgaggcgggcaacgcattcctttcacgctgcctgtgcctgcaaatcgcgatgacccggaactggaatgacaagtcgcataggatagtcgaccggatagcatgtcaggtttggttagctcgcgggtcaaaatgttactagccgctcgcgtagcgctgaagggttgctcggtgcagtcgatcaccgtccatcatcgacctgatactgactgcagcggcacccgctcgtcatctctagcaggccttgcattgtttttatatattgtacgtttgtagagtaaaatttaaaatggtaagtgatatagaaagtgagataagaagtctaatattatagtcacactg

SEQ ID NO: 1419 - DNA, 1039 bp, Zea mays
  misc_feature (1)..(100): optimal_loci_198287_G1, chr5:164142830..164143868, Cluster 9
tctttaccctaggagagaagtctacttgttagacacggtgatttgtgctcatgaagattttcttattgccaccgtcgaagagcccatctcaccgacccagctccatcaacttcgactacaacttctgattacatggaggttgaggtacgcttgggttaggcagatggagccacatccatttggggttagccttttttagatggggatgtgatctaaagggatattatgattgatacgagcccctgtttcatccagcactatactatctgccattataggcatgatggcattccactctgtctttgtcgtggtgtcttcactaggaggggatgggttgtcacgtttgggttttcccttgtactataaggacactacattcataaaacagacaatctcttgttttggtcagttgatccgatggaatggtgcagatgtttcaatggctaggtttttgtccaaatgcttatttaataacctagaggatgtcccttgtacccttgttttgaaaataagtagggacctagatggtgagacctattcgtgggtagtccatgtatacatgttgaatgtcaatttctttgatggggcgcttaatgatgaggttgatccacgaccaaacaatggtaacccccactctctccttggcctagttttagagtaggtggtatagatgtttgatcaattcatggaggaagttaacaatcatccacaacagcatcaacccatagccccaactcatcgagggcggaaacattattcttgttgcgattgtccacacctttgtcatgggtctggatccacgtcgtgagatggctgtctatatgaagcccatggaggagtagtgggtgggttctccaagtctaaagagtctggtctcaaaagttcacaatcttgctaatatggacaacatcacattcaatctttcccatagtttggatggcgcgggtgcctccatctcagtctcgctcccttgttttaaagacgagccttcaagagtctagggtttcaaattccaaacaccatgtctgtcagtgaaagc

SEQ ID NO: 1420 - DNA, 1015 bp, Zea mays
  misc_feature (1)..(100): optimal_loci_198700_G1, chr5:166409127..166410141, Cluster 9
tttttctattgctagattcttataaatttttatgttagtggccaagatctctaagaggtctagttttatgattttgcctacatgggcctttggacttgtctaagaaggggcttgggctccaacctagagtgccttggagacctggagacccttgatggctgtgtgggcctcaagatctagatcttatgcctagggcactagaggctagaaagccttagggaacatgatggccctaagacttggtccctttcatggagggtgctgaaggatggaagatccctggatgtcgagagggcccaagatctattcccttggcattgatgacaccaaaggttgtgaatgtcttagtgactaggagggcctcgagacccgcctttgacctaaaaggtgttaaggctaagggagccctaaaggccataatggcccaaaggttaggtcccctagcattgagagccatgtgcttagtatgagctgagcatggggccttagggatatgtcgatggtatcatttgagccctctttaggtttccttttgatcactagatctttgggaggcatattacacacattcgacggtgtggtcttccaataaccctaacatcactgttttggagggatctcccacccctagcattgagatccttgggcttagtctgagctaggcatggggcctcagggatatgtggatggtatcagctgagccctctttaggtttccttttgatcactagatctttgggaggcacattacgagcactcgacggtgtggtttaccaataaccctaacatcaatgttttggagggaatcccatcaataagttgatcctttttagtggaatttcattgggacctttcaataatattgccttcttgagaggcatttctaggtttttctcctatagtcttttggagagcttagctatttcatgtgtctggcttgggagttgggacttagtcgcaagctaaataactcggtgccatagtcataggagcatttcaagttggctctaagtgcg

SEQ ID NO: 1421 - DNA, 1283 bp, Zea mays
  misc_feature (1)..(100): optimal_loci_200519_G1, chr5:176908836..176910118, Cluster 9
taggtacatgtaccgtatacgcatgcaaaattagttagaacaaaacaaaaatatcttttgaatggtgatcggtgaacgttcatggtaacatgcgtgttctgttggctgatcgggtgtcaatatatgtttagagtcaataactaaggttcaaattctcatttacacataatttttagtaattttaatattgaaatgtctgagcacaacgtggaacaaggaaactggctgccaaaaaaacgttgtaatcaacagcgaacgtggccaacaaaaaaaacacagcatgatgaattcatcaggtaaagtctagccatctaatcgatgagacgactgatccacttgaactgattccgcgacccgactggaaaagatctcttgcgcggtcctcccacagatgttttcttctctcatgacaggactgcacggcgtactgggctactggctggttggctggccgggttgcgtttgcatatttgcaagtaccagaaattcagatcgccgtagctacacaaagtaggccacatcccacatgcacgcatgcaaaagagtactagctcgctttgcagagggaggggtaactggaactggaactggacgaggacgaacatgtgcgtggcggtatgcagtgtgctgcggtgaggcccacgtacttgtataatttggctgtgacgatgatgcatgcatgtgttgcttgctatgctgcctactagctgtcgtctgtgggagcagctggactgcatcttttgccgtatgggcgcttgaccggatagggccaaacaggatatgcgcgccaaccgtcgggtcaacccattcctgtttcctgccacggcgaggctgttaggttcactgtttggaatcccaaggcagcgcagcgcagctactgctgtattcttttcggttcggttcggttcgatgcatattgttctcgtacgttctttactgaataatacgtaatgcatgggcggcatatagatacaccaaaaggcacttgatttttttttttgctatgatttcaagtatgtgtaatccgcgtttgactactctcgcctacagtaattacgaagtaggagaccctgcccccacacagccggcccgaacgcgctgctgtgacgtgttgttgcttcgccgccacgtctctttcttcttccctctaagaaaaaaactgcagcacacagccccccggccgtctcctttcgcagtatataagcacatcgtctccctcacaacgtactctaataaaatcgctcccctcttgacaaccccccccccccccccccccccaaatg

SEQ ID NO: 1422 - DNA, 1313 bp, Zea mays
  misc_feature (1)..(100): optimal_loci_202979_G1, chr5:190717228..190718540, Cluster 9
cctagaggtgaagagttttaacctcgacaattgcactctaaactttttgacaataatatgaaacggggaaaaaaccctaacaatatggttggagcatatataagttcttactgaaaccaagtaatgacagaaaaaatcgcacagtgatacacgccacaattaacagatatacaatgcaatcgtagctgtggtcaactagctgattatattattcttcaaaatgctgaaaagggtctaaaagaggcttggaaagcgaagcaggtaattatgtaccgcgcgcggaagtggggctgcaaaagatgctggcaaacaaaacacatggctggtggcagctgctgctgctgcaggcacgcacattgatgtttccagattgagccacggtttgctggaggcaggggggcgaattcctatcattgcgagctgctgcaaaagcctcttcttcaggtcccccgtagtatgggccactggacggtccactgctccccgatgcgcacatagtacggtgtcatcaaatacgtactgctgatgacgctcatgcatattatatttattcccagctcacgtttaaactttcatatgctaaatgcactgtcatcgtgcaaataataatagtgcatgtgtactaggcttgtttggttcacaggctgagaaatccgcctcgtctagtaggcaacgatctcaggtgtccgatttcagatgcctaggactagattgagttgtctaccggtgctcccaggctatggcgccgaccaaaaactctaagagggtgttcatttccgtttatttcacatcggcgcagcgactgagaactgaataatctttggcaaacgcctcccgatgagaccatgatttttctgcctacagcccatgaagagcaaaaccaacatttgaactgcaccactgattccctatgtcgccgccacggcgccggccggctccaaacgcaaacagggccaaaactagctagctagtggcaggccgggtcgtcggctgtgctgctggcacggaaataattgacaagtcgcacacgggtggcgtgctctgctccgtgcccaagaaatcaggagcgagctgataaccgtgaacaggaacagttgcgtacgtacgtatattctgccgcgccctgcgcaggcaagcagcggccgcagcggcaacaaaagaatagaaaccctaaagtggcggcggtgtcgtagcttaccactgcgcgcacacgtcgagacgacagcgtcggagagatatgatgcatatggtagcatgcgtgcatgcatggagcaggccgggccgccaaaacgacgcaaggtgacaacaaggag

SEQ ID NO: 1423 - DNA, 1388 bp, Zea mays
  misc_feature (1)..(100): optimal_loci_204800_G1, chr5:201110846..201112233, Cluster 9
gcgcactcgacgacccgcgcgcgagagacgacgcggctgcgttcaaaaactgaggctggctgtggctgccggcctcatcgctatcttcccgaccgtcagcgaccgggtacgcgcaggcgacgtcgttgcctgcgggcaggcgaatctcgaccgttgacctcctgtacatgcgttgccgccggagtcatacaaaaacaaataaatacagtggcagtttaaaactagcgtcaggtcatgagatgcgtcgtggacagtggcacaagatgtatcgggtgccgtctgtcgctaatgttgtatttctgttataacaaataaatacagcacgcaacacgcagcggttgtatatgaatgtggccgcggtggaatttggtaaggaaaaaaaaaaaggagcacgcgtgcacgaccttttttgaccgagaaaggtatcgtcgttcgttggtggacgtgagaatcggagagactgagtagtggttggtctcgactctcgactctcgagagggctcaaagctggatcgtgtatgcggcatgagccgctggtgactgagatgtgagaacacgggatggagcttcgtcatcgaggtggatagcattattatacaatacaaagaagatgaaatgaagtgacatggtttttatattgctccaagtccaatacgcgccagcacacgcaaaggcaaagggagcgttacgtttacggacggcaatgctcgctcacgatggcttttcaaacttgaaacttcaaacatgactactactacaaacatactacctgctgttgcatgtgcatgaccgcttctccatttgaagaagcctgcgtaggtgtgcggtgcgctaccgagcggtgaccagcagcgtaggggttgattgacacttagcttgacagtgatcaggggactaaaacgtcgtcttaactttgacggtcgtccgtcccggcggtccagccaggtgctcgtccctgctgatcgcccaacaggcaaacttcggatgcagattctcttcacaccgcacacacgcacaaattatcgtacgcctgcctgctgcgtgggtttgacttcgccaaacggagcaatcagagacgtgcgtcagctagctagctcagggtgttgttacttgttagcgtgcgtcggaacgacagagagtcaagggcggtttagaccgtctccaaccattctctctaattctccaaccattctctctcaatatatttaggatgttcaatatatgaacttactatgtttatgctgtttatctgaccagtataagttatgttttatatcagtgtccgatgattgaaaatcgcctacttttctcgagtgcgagaggagggtaacgaataggcagccggtagtactcgcgtcgcgtgtcaggacaggaaccgtggtccgtag

SEQ ID NO: 1424 - DNA, 1161 bp, Zea mays
  misc_feature (1)..(100): optimal_loci_206146_G1, chr5:208551499..208552659, Cluster 9
ctagaactaaatatgattcatgtaacttttagatatactttcattgtctttaaatattatgatttgaattattatgtcctaatctgtctctatgacttttcctaagaaattttagaaacttagagatgtttttgttgtttaaaaactttatagatatccatttaatttttttactaaaatttgatggaaccatttataaggctgtgacaacactatttatagagtggagtttgaaatagaagatgggataagtaatgttgccggagataacctaactgacccaaggagatttttaaatggtttatttttttcaaaaagacaaagcacaacacatttttatttttttcaaaaaaatatgaaggttgattatagaatataaaatataaaaaacgtgtgttatgttggctaaacgtaaaggcctgaaattgaatccctacttgaactgatcggcagcccatttaaaacatttataggtacactacttgaactatatacatgcaacaaagcataggtactacacaatcgacctacacgccgaatgagcccactagcccatatatgcctccacaattggaccgcaccattgcaggtgcagcctgcaggagtgcaggtttgcatcgcaagcagcagacacagggcactagggcagtcacacacacagcagtcgccagcctagcatttgcaagtaagatcgacagacaggtcggcacgatctgctgctgctcgatttgctgaagagaccggcggccacgatccagaagaacacaagtcatcggctacggacgggagtacagtacagtacaggaccaattaagtacagtacaagcggcatcgatcgcgcctgccagacaccggagcagcagttcgcgtcctccctccggccgtccgggcagagcgatttgccttgtcggctcgccgcgaaataaatgggcgtacacgtttgcgcgtgtcgtatcgtaccgtaccggcgtaccgcggcaacggcaagcttcgtgccgctagctgccggctgtctctagcgcgggccgccgctaaagaccctttgcgccagtggacagcaaacggaaccccccatctcccgtcccgtcctggacgaaacagacgccagccagatgcgcaggaacttaaaataaacaacgcgagcagagcagcgacgataaa

SEQ ID NO: 1425 - DNA, 1193 bp, Zea mays
  misc_feature (1)..(100): optimal_loci_206891_G1, chr5:212220015..212221207, Cluster 9
gacgaggcggtgttgtagacttgtagtgcacgactgcactgcacgtacggccggccggccggcgaactgacgacgatgatgggggcgagaagacatgctggagaaggagcgcacgtgctgcatgcgacgatcgaccgcgcgcatgcagccagctagcagaccccagaggcccagaccagcggccggcggcggcctgaggcgccacgccgacgggccgggtcgacgagcacgtgccctgcttctccagcacggtctgctcgccccctccgcatgcacgatggagccactgcacgcgaagctcgctgacgctgaggcacacacagtcacacacacacacacacacacaaaaaaaggaactgcctggccgatgagctagacgatcgaccatgggcagggcagcgtggcgcactggcgctggcactccgagtctctggcaggccgcaggcgtgtagtgtgtgtatatataggcagcaagcttggtcgtagtggtgtgtgtgcccgcggatatctagctcgaaagcaccaagcttttgggtgaagaaatggaggccgggctcggacccggacctgctggctggctgccgccgcccgcctcggatgcctttgctgagactcgagacgacagacgacgaaacgcagtgggccagtggaagaccaccgtacgaattgaaaacgaaacctgggatctccgtccatccgcgccctccatagatctcccctctccctcccggattgcagtcgctgtcccagctgcattctttaagtttgaaacttctcgtccgcttctttaatttcacgacgatcgacggcggcgcaaatggtagctaatttaaccagctgatgagagacagagggcacgcgcgtctgcccctcgcgtcgttaccgccagtggccccgtgtgtcgctgtgcacagtgcaccgcatgttctaagtgagatctgaattgattatatatatactgcttcatagtcatagtaggaatcaattcagacgacggagacgatgagctagcagctgagatcgcggcggcgcatgcatccgatccatgtgggagcgggagcgggcgagcacgcgagcgcatgccggacagcgcggcggcgggcaaggttgtcggagcctcggaggcggtggccggggacagagcatgcgcgcgcggggcagcggcgacgggcggtatctctactacttatata

SEQ ID NO: 1426 - DNA, 1115 bp, Zea mays
  misc_feature (1)..(100): optimal_loci_207127_G1, chr5:213273749..213274863, Cluster 9
gggtctaaccgagtgggcaggatcacgacctgtgcaactgcacggcctgcgcaacagccacagatgatctacgccatcatttcgcgactgaccgccgccgacttgacgcgtgcactgttcgtctgtttgctcgccaacaccagtccgacccgtaccgtacgtgcttgaccaaacaacacggcccgtctgcaccgcagagcagtgcacgctgccttgctgcatggtgctgcgaccgcttccgttgggaactcggaagccggccaggccgccaccaaggctgtcaaaaagttgtggtgaaaaagaagaagaaaaaaccccaagcggctgcacactgcacgtacgcagaagttccaggaactttgcgacttgggagggatggcacgtcacacacacacacagcatcagtgtactgtatgaaagaggaaacaccacatgcaagatccgtcgagacacgtcaggttttgtttgcggcctcatgcaggagctggatacacggcaccgatcatcactggtcagatgacaaagacgtacgcgcaggaagaaggctacgatcctgtggccaggaacaggaggaggacgacgcacggagcaccgggccgggcgcctgcctctgagtgccgccgacgaagccaacgcttgcacgccagaaatgggcgaagcggaacacacggttgcttccgtcctcggccaacgtaaacctaaccctcacctcacccagcccctgcttgctcgggacgcgtgccgcgaccgaggcacgtcacgtcacgataggaaaaagccgagctcgagcgtgatgggcggactggcagcgagtcggcgacctgtaggcccgccgtagccgtgactagcaaagacgcgcaggtgatccgccccgcccggcgcccggtggtggtcatgattgccgagttcgttttctgtcacctccagctaatcatgggcaaacccatcaacggcagtgcgattagccgattagcgcggccacgatggcgtcatgattgcgccaatccactggtaaagtggcatcgctttggtttttgttttaatactgctgctgctgcacaccaagagaatgaccagcagatcgtgtatatgactgtagtcctcatacaaaacac

SEQ ID NO: 1427 - DNA, 1016 bp, Zea mays
  misc_feature (1)..(100): optimal_loci_207244_G1, chr5:213741968..213742983, Cluster 9
attgctagtagtacgtagtagctacaacaatcaacaatagatatagtatgatccagcttgaaattaaaaggctatatatctacagtcgtggcgggaggagctgagtgtagctaggcgctctccattaggtttatttatgggcgtgtacacatggtaacagtgtggtagtacgtacgtacttactatagagagaagagctatcattcagtcgtcgatcggtccagcaagattctcctgcttttgctgcacatttagttgcttgtcgtccatcggcgaaaagagcgcgccgggcctagcatgcatgcatgtacacagatcgaaggaggaccagtacccggccgatcgatgatcatgcatgtttgatttgatcctcgagggattatgggatacgatgaattattggagtatatactgaagaaaagaagtagatagatcgatccatatccatcgagatcgataggtacaagatgctaaatgaatgacagatcaatcgatcgtgtgtctaatattatttgagcacgagcatgatgattcttcgatcgatcaataatcaattggtcgtccggccaaaacatggatatattaattgagacacacagtgccggattacaacacacacacacagtgacgcagtgtgcgtcgtcgttactgcgaaataaatccgcagtctagagacatgcatcatcactcgacgtgtggccccgtcgacgtgatcgcctgccttgctattacgtagtacaaacagatgtatagtactgtacgtttaattttggatcggagagctagcatagcaggatggaatggaagaacccacgtggtcgcgtagtacgtaatgcatgccttacatatatttactactacgcgcgctacatgcacacacacacgtaccgtacgtactgctactcctcggtaaagagctagagatctcgatcatgcatgcatgcatcagtaggaccatgcatgctctcgtcccttcctctggcgccacgcacgcttcttattgacgacgatctcca

SEQ ID NO: 1428 - DNA, 1397 bp, Zea mays
  misc_feature (1)..(100): optimal_loci_207324_G1, chr5:214274062..214275458, Cluster 9
cttgtgccgtcttcatacgaaaaaaaaagagagaaccactccttgctaacccagtggccgaatcccgtacaccggatttttgtgctgcggcagactgcagccttgaagaacgtcggacgtgctctgcttacatacatttgctcaggcgttgcccatgcccttcatcgatcaagcggatgttggaacatcgattagtttacacacatgttggtttacaggtttttgtatgcgcagattgtgctctctgctctgtgcaccatgcatctcgcacaacgtacagaacgcgcatgcaaattcactagtttattttttttcttcttctctgatttagcatatgtgatatgtctgcaaaaaaaaaatgaaatttatatcagcttatacgcggaaactcgaatatagtcgcattattgtttacaggctagctgcctttgttgagcttgagcgtgttccccgttgcgtgttcgggttttttttctgagtgttgtagctaggagattagtatcagcagcccaggagaaaaaatgtgctggatctatgacgatgctgaagctctctgcctgaaaaaatgtgcagcccgtatatgaactgggcctgcggggctaggcctatgtgggccttacagctcgatcgatgggttagtcagggtttcatcatcgtcaaccagatagaaggctctcttgctcactagtcactcctccgtaggttagcgtatctagctagtactagcaggacacgatcccagcagacagcgcgctgttttccgtgtccgccagaaaacggccccgcccgcgtgcgagggaaactgaccaggcgcaggcggaccggaccggaggacgcgagcggagaccgaggggaattattccggaatctggtaggcggtagcggcggcagcggagccatccgtgccgtgggcactggcatcccaggttccctgtcgcgccggatctttttccaccggtgcggatgcggaggagggcgccagccaatgattcggtccggccgcttttgcgcgcccacccacgcaggagcttgtatttgcagtgcagcacccgggctgatgttttccgccgcgcctcccgttctccctgtctttttttttccatgtactgtagcagcggcgcttcctgcttctttcttctttcttttttgtttgccccctttccggaattgatgtcttgaaagggagacgagtcgagtagacgacgggtccctttacatgtatatcagaatcaaagcaaagaaagcaagtgctggtagtgagtggtgcacgcacacgcggcggtagcgttgcgtggatccatcgtttcagttcagtggccaggggcgggcacaccgcggggttggccaatcatcatcaaaaggaatagaattctcgtgctgtagctgatgtatacacc

SEQ ID NO: 1429 - DNA, 1238 bp, Zea mays
  misc_feature (1)..(100): optimal_loci_207499_G1, chr5:215071525..215072762, Cluster 9
agagcaactgtagaagtggtggacgctgacgtctaccttatcagttggttgttcctcgcaatttgtccggaacaatttccccctgctttcggatacacggaaaaaggtgcacatgagatgagaggttttcagctgtaaagagaagccacgaaagccacgtttccttcctccttgcttttctttctgcggcatttttatttcattttcttcgtttctgacttctcctcttgtgtggttgctgctgtttgtattgtacgtgtcatctgtcatgggatgatggagaatgaggtgcagactgagggtcaggtttgagatagatggatgttttcagagctgaggttggagaagtccgccagaaatgctctggtcgtatgcgttgtgctgaccatggttcttgtccatggtgaccgcagctgttggtatcttgcatgcatgcgtcgtcttgccatcccatcacctgatctcgtatcttgaaccaaaggagctgagcttctttaggggaagaaaaaaactgaaaaacagtggcgcatctctcctgaacaacatgatccatatgggtgcccagcttccaagaaaaaaaaaacttcctggtgctagctaggcataaatacaggacaatgtagcatcatcggataaggggaatctgggttgatgcaattcctagggaggcatcgtataattcaggaggcaaggatggaggtgaggtgacggcatggcatccaattggcaatggccttatggccagaatgtacctttctgatacctaacactgccattcagtggtggtggacgtggtgcatattcactgctgcatcgggaacgggaaggaaagagctccgcgcatctgcatccactctgcacagtttctgcatttcctccctccctccctcaccacgtccaccacccaagctgaatcaccaggtcaatggattcctctgggcaaggctaggctccttttttttctgaaggctgaagccggcgccgccatcgttcgtgcacggcaccctcctctccggggctgctgaagtgctgataaggaatctcaacactcccctcaagtggggagcagactgaaatgcgttgagcacgtgtccactacgtacctgcctctgtatctgtatgcgatgggttgcgtcctccatcactgctacgtacgtcacatagacgggagttcatcttttcttcttcagggtactgttacagggtccctttcaggtcatcatcatctgcctctcact

SEQ ID NO: 1430 - DNA, 1145 bp, Zea mays
  misc_feature (1)..(100): optimal_loci_212845_G1, chr6:31431184..31432328, Cluster 9
tcgagctggtgtgtaatgacagcattatagatcaggaattcaggacatttaccctatggtcgaaatgtgattttcgttccacctaagatataaacatgaaattttggtcgaaaatggctaatataggagaagacaaaaaattagttactttggctaggcaagcagctagttatacagttgtataccaaatacctgtctcgaaagtaacaacggtccaacgtccaagagcaagactagtggtttggcatgttgctcccaggtcagacaatgcatggccagcgtgggccttcctctagcctacctgcaaaccaaacctgataacccttcgggcaacccaagcgagtcgagtagtatgcatacatgtcagagttggctggcctaggctagccgtccagagtccagacaccacaaggaaaaggtgcctgccgtctgggttagaacaggtgacaagatgggtactgccatggctagctgcatgcagggacgacgatatccatctgaatttctgttcgatttgtatacacacacatttgaaaagtacacgcgggcaagaaacacacgccgcccagcccagcccagatagcctcggagcgttaatttgggcacatccgatgatccgacgatacatgcatgttgctaagcagttccatggctccttggatgcttcttgcttgccacctcggagaaccgagcagagtagctggaagagagggaagagcaacctgcatgcatgtgtgagcatgtgtttgtcgtgctgctctgttggtcgtctgcaatcctcctcctcttcgtcgtccagcacgatgggaccggagagagaccgacccaaggagcgagcggaaaccgacggcggtcaaaccgaagcgcctccgtcgaaggcacacgtacgacgtggtgggggcacgctctccaagtcaagctacaaacatccaacaatcctgccgaacttttttccgcacgcagcggcaaccggcaggcatcatcagaagcgcaggagagcacatcgcggccgttcgatcagaccgggacgaggcaggcagcagcagcagtggtcgtccaacaagtccatctcgatgatccagctacttcctggtgtgcgtgtctgtcttgtcgtagcggaccgtttcgtctgaacagcagatgag

SEQ ID NO: 1431 - DNA, 1162 bp, Zea mays
  misc_feature (1)..(100): optimal_loci_2164_G1, chr1:11219739..11220900, Cluster 9
ccgccgctagatgtaatatactgctcggaattgaaagcaattgagcacggcatgaagcgacataagaggtgcgctttgtagtctatcaagcatcatgcttgccgagttgtcgagttcatattgtgatataagttggattttgcggattagttgccaaccgtattgattttaaacgagttggggttcttagtttattatagacataagcattaggaattaagtgcatttcatacgtaattgtctagttttgaaccttggctctaattctatccaaatttagcacctaactatcatagccatttgactttgacccatcgacctttttaggtgatctttgagttgatatgacaatatgctttcctttatttggtttctagtgtcattgataaattagtggcaccataattgttagcgctcgaagaaagttatacccctagttgttgtcaaaacacatttaagtagtttaatccgagagactaactttgagatcccatcataacaagaccaccgctcctagatcggccttgagtcctagaaacctcccctggcctttgccaaatgggagtcctgatactaaatgacataatataaaaatgttcagatggaatgactcctcagttgcaaaagggtccggtggcctttcgggctgcctagatactttgaggcctcgacccctagtgctctagaaactctaagggtaaaatatttaagtccccaaggcaccttaatccatagggcactgactagagatcaagtgctcggggcaccatgccctagggcaccatgggactaagtcctcgaggcatcctatgtcccgaggcacttataagtataagtcttcagggtctttcatgtctcgagacacttattagtataagtccgcgcctcgtgtcctagatcacttataagcgtaagtcttcggggctccttatgtttaggggcactataatcccaagtctcaggtgcccttagtgtcctaggttaatatggtaatgggtgctcaaggcaatccatctcctgagcaccaacaaaacttagtcgtatgaggcccttcgctagccctagggtccataaagagtctccaacctcatactccgagagtggtcgggacttgggctctctagagtttggatccccctaaggagctaagcacttaggatag

SEQ ID NO: 1432 - DNA, 1077 bp, Zea mays
  misc_feature (1)..(100): optimal_loci_217718_G1, chr6:65926463..65927539, Cluster 9
acgcctttgtgttttaaatatatagcagaatgattaaaaaatgctactagtcaaaatatggcaggtccagcagcaaggggaaccgaataacatggcaatcatcgtgggaccaattgttcgttggtgcctgaaagtagagagtagtgttggtctactctcaaatgacgcgttgatcgtcgtgtctgatctcactgatggagtagcccgagatcttccacatgcccgcgtaaaagcaggtttccacggctttggccagacggagtgcaccccatgatgatgtcctttggtaatctatgatgcacatgaagactggagaacctacgtgcggtcagtgagcgagtgaggaccggtacgtagacctttgtttctgaaaacgaaaaaggcaaaccgcccccccccccccccccctgccgtgtgcaatctctagtaaactacttactggtcactagagcagagtacatgaccatcacgcatctgaagctgctagctaccagtgatcatacgaacaaagaaaaggacagcgcggacgacaggcccgcctgccccgttctcttccatgcatgcagggcagggtagcgtagcgcatcagttagttgcgaagcaaagcaaagcaaagcgtccgcagtggaatacgtctccttccttaccgggccaagtgttgtgttggttgcttgccgacctgtggcgtacagtacgcctttcaagtttgaacacgtacacgcgctggacgtacgctacttccccaggcgggggcggcatccatccatccatccagagtcactaacattggtgtcagattattccctacgttaatcccgaacgacccccaccgagaaatcgaattcgccggacaggtggcgcggcaagtgtatccttctttcctcagcaagcgctctctgggtaattagcgagagctaattaacgggccactacgctcgctctcgctctagaacgaatcatcggcgaataagaccaccgctataattacgtcgccgggtggtgcatgctttgacaaatcagttgtaacggtgcgcgcactacgctcgcgccagcgtaaaccgcgcgcgttcgtccacg

SEQ ID NO: 1433 - DNA, 1349 bp, Zea mays
  misc_feature (1)..(100): optimal_loci_217719_G1, chr6:65927573..65928921, Cluster 9
cgtctagaacgagccagacaggaggccgccgtccaccgccacgcactgaagcacgcacgtcgtacgcccgggtgacacggcgacgccggcgagagcttccccgccttctcgccggacggacaaacataccgcgacggcgcaaaaaaaaaaaaaatcaaacgcaggtttcgtcgctagcagtagcaggcagcggccggccacatggcgaatgatctggcgccgggacccagggtccaggtgcgaggcggtggtggtgagcgtccacgacgtgcgtgccgccgtcttctgtggcgatcgacgtgacgtgctcgctgctttcagatgctgtgtcgtcgttggtgtctgtctgggatccagctagcgccaagcggggcctactaggccggccgctaccccggcctaccgccgtcggtaaccggccggaagccgcgcgccgcctcctgctccgcccgcgctctcgtcggtcaccaactgtgtttcctttttcgatcgacgtcacagggtgggtcactgtggcagtagcgttctcttatcccgaggcagcagggacgtcacagggtggatcgcgacgacggacgtcggacggacggctgaagaatctacgcacgtagcgcgctacctgatctgccgactacagtcgtcgtcggctcggcgaggaggagggcggatggatggatggaaggatagtaaccgctcagtaaaaaaatttaaaacaaatccgcgtcaatcgatcgatcggggtggtcgctcgcatccgctggccggccggtagtcgagacgatcacccgtcgaatcatggaatccctcgcctttttccgggagaaaaaaaacaaaagctccgtcatgccatccacgcgcgacatatatatcatgcatggcccatacatacatgcatgcatgcatatgattatatccagggcaccaatagaagacaagtttgtttacgcgaggaattctttttagcttaccttacgtattacccgtattattttcttcttcctctgttattatatatttgaatatcgagcaccctgctctgctacttatttctctctctccatatccttctaaggccttaggacggactcgtttggttatagttataggagattaattgaggaggattagttagctagctagctaggcgttaacattcaagccaacatcttgcatgcgttactcttggatcaagagcacataatagatggctagccttttgccgaagcactacaaccttttgtgtgtgtgcttattaggaaagtccatactctcgtcgtcccgaaaaatctaataagaactagagactttctctctcttgccttgagaaaggggaggataagattcgacag

SEQ ID NO: 1434 - DNA, 1149 bp, Zea mays
  misc_feature (1)..(100): optimal_loci_225290_G1, chr6:109886085..109887233, Cluster 9
ggctttaatatatagaaaataactagtatatcactggtccgtcgtgtcatcgctcgcatcttgatatgatcatgtggcatgtgccgaggttgatttctgcgagctagggcctagggctaggctgttaaaccgcgtgagtgagcgtgggccaggccgattttccaaacgcaggtgagcttcttaataaagtttggaattcttcttttatatataaaaaaagagacacaccatcctcattattactacacaggtaatagcggcgacaggagatggccacgatcgtcaaagtagctgcgggctgcagagcatcgtcgttcatgagcaaagtcgctgtccggtgcagctcagctccagctgccccgcgacagacaccgcgcacggcgcacgcggcttcgtacggtagcaggagccgtggcccgtcactgccgtgcctgacgccgtacgctgccagagagagtaggcaggcacatctcctgtcgccgtctcaccgcctacgtccgcccccaccgccaagaataaacagtaatcacctactcacaccgtttttttttgttactagatatccgtatgaaactgtaataaaaaaatatctaatacgataaagataatactgtagtaattgaagttaggatataaaactaacgtgacatgtgacgtgtagttggtaggggtgtgtgccgccaagtgtgaagtcccactcccaccgcggttcctaatcatgcagccgcagcagcgttttggtgccgacgtgggggggaaaaaggctgccacggccatgtggccatcatctcatctcatcgaggcaggcaagatctatgtgtacagtcaactcgtcggcaggttaaaaacccttccgcctccagctggaaacgaccaaactagtagtacacatttcattgaccagtcggtagcaggtgtagggttaggttcagacgttcagtcgcatgcaagattaaccggcccacagccaaccaatcgattactctcctctcctgtacttgctagctagttcctagttctagatggatggttaagcaaactccactaatccatgtacattagatgatatttatagcaaatcaaattacatctcaatcaatttcattacagttcaatctacgtggaattgtaataaccaaacaagaccta

SEQ ID NO: 1435 - DNA, 1088 bp, Zea mays
  misc_feature (1)..(100): optimal_loci_225889_G1, chr6:112943426..112944513, Cluster 9
ctgcatcttccgatgatgatcaggggcttccccccacgtatccccttattataccctaagggagcacgacgattacatggaagcagttacatgttagatgtgcaaataaatgacttatagctgagttggttagatggtctaagtagtacttttgtcttgatcttgtcttgagttcgattcaacttcccgtgggagtaaattttagagtatctttccggaagtagagtttttttttacatatgccagaggcaaaccgatgtacagctgaactgttgttatctagctcattgttttcatggcaaacgtccctaaaagccaggtatctacattattccagggtgctgccaacgcgaaaggccggctgacacaggaaaatctggctcagatgatttttttccctcccgcacccaggagccttgagcgagacaaaaaaaaaagagcaaagcagaggctgtgagacactccgtccgtcctccatatccaacatgaggcccaaactccccgcgaccccgctcagccttttcgccccgatcacacacgcaaaaagctggacgcgcactagacggccggcagcaagcaaacctctcactcagacccagcttcgtctttgccatgcactctgatacagcgacgatcgatagttaccgtgcacgagttcaactcggccacattcctgtccagtgtccacgcggaccagctcgatcggcgtcagccgtcaggtcaccaggcccggcgccgaagcggtgaggtgaaagaaaatgacgcgcggcgccaccgcaccgtgcgcccctgtctgtctggctgtctggctggcctgcttttccaccactcactcacccagcaccgtgcaccgacccagccggccgcgatggaaaaatcatgccaaagattccagaaccactaccactgtgtcgtctgtatcacctcgcaaaataaaggtgatctgatgacccccaagacctaataataaaggacataacgtagcatagcataaccatcagccatcacggtggactttctattagtggcccgtcaaaaaaagcatcggatcggagcagcattgccacttataggcttatacctagcca

SEQ ID NO: 1436 - DNA, 1051 bp, Zea mays
  misc_feature (1)..(100): optimal_loci_227594_G1, chr6:122673076..122674126, Cluster 9
ttaagtacaagctatgccaaactgggtgcttttgcgacagcttatcagttgggttgcttctcaaaatgaactacaagcattgcaataatccatggtagtagtccgattgatatgatcaattccaaaatgatttaattgttttttatatgaatgatgtaattttatttgcttgttttatggtaatgaggtggttgtagtttaatcataagaactgtgtgatatagcgttgcggtaaataagagctgccatgatcgattagcaggatatcaataactgagatttgacagtggatagagaccatagtgaactgatgagtcactgattattccgcccgttggtgtccacctgtcgtcatttgctgaggtactgtactagtacatcactactctactactactactccatacgtcgtccgtcggtgcaaatggagccaagtgtttcgttggccgacaaatggagcggtggtggtgtggtaggaaaaaaacgccgggtttcccacgctacgtactgcatcgttaactcagtgcaagctgtgatgtttacgctgatcaattactaatactgtaaggctccatctatcttggctgatgagacttgttccaagctagccatgccatgtacagactctctatcggtctccagagatccggctataaaatcctgtgatggatgatgggttgtaaaatgtatgtgcactagaagaacccacatgacaaaaaacaaccagatcttttttttttatatataggaagaaaaacaagaagaactagaagcaaggaacagcgagattcgcgacaggcgtgcggcacaggagatgcatgtgcaaggcgtggatcgcgaaacgggttcgtgcgtgcgtgcgtcagaatggaaggcgcgaacagccgggagcgcatctccccgccccgttgcacgcgatgctggattattcgttccggggcaagtgggggctggctggaacacggaatagaatacggttcgatcccatctcgcgtcgccaataactacagctgccaggttatatgcgtagacattaagtacgactattttg

SEQ ID NO: 1437 - DNA, 1134 bp, Zea mays
  misc_feature (1)..(100): optimal_loci_227627_G1, chr6:122972471..122973604, Cluster 9
tattgttcaacctcgaccggcagcaggtttcacatcgaaggcatcaggcgtgccgagttttcacccgcgcgcatgcacgtcatcgtcgtcatgtcgctaggatgcgaaagctggggcatctttacctaactccagctgcctgcctgttgcatgtggggtggcgagatgattagctttcttatataataatataataataaataaacgtacgaacgggaaggttggttgctctgtgatggattcggtgagaggtttgtttagcaagtggggcagcggaattgcaagggaagcagctgcagacagccgaattagtgtgtgctcgtcatctgtctaggtgatggtacctcttcgtcagttttattttatggaggaaactgaaaggtgggtgaaacgagagtccatgggcggctgcctattccgttccatttccatgttcctgtgcgtatcccattagtatgacctgtcctaatcgtccagcttagcgttagcgacagctctgtcgatctagctagaatacggccatggctctacctgttgacttttggagcatcagacagacacagacgacgcttgctgatctgaacggtgatgaggtaacaagtcgtacgtgtacagcatgcttatggtgtgatagattagatgacggtggtggcgataagcatgcatatggtgttgtagcagatcagatgatggcatacacgaacacgacgtacagtagtacgtgttcgttctaagagttatgagcactgccccttcatgcatgtgggtgtgcgtggagatcaacgaaaaacttgtctcataattaccagaaaaaaacaaagcccctaaaaagaaacgtacggaaacaatcttctacgggctacgacttgcatgcacgatgcagcatgtcacgtataccaaccaggtatacatacatatatacgcgtcaaaattcaaaaagagtacgtatagagaacaaaaagcacgctctcctccgctcaactgggccgtcgaagatgaaccggcccagcatttggcggacgctccggttcggcttccaggcagggcggccccgcgggtgagatcggggagcgagggcaacggattccaacttcacagcatttctcctaaaaatatatctcccattaaacagat

SEQ ID NO: 1438 - DNA, 1025 bp, Zea mays
  misc_feature (1)..(100): optimal_loci_227958_G1, chr6:124689722..124690746, Cluster 9
ggccattttgaacatataaatgcaccaacattccaaatattgctttctggactaaaaaactcagattaaccatttgcagacatgaggaagctagcaaatttagtttcattagttctaccaacctatgtttcaagttattcattatttaagacatacactagataaatgaatagaaacattttctgcaaagtgacgcatgccaaatatatatttaattcaaagctagacacataccaaagccatcgcaaaagtttcacaatttttgaatcatgcatacatgaggtatggcattttaaacattcgaagtattctctggaaaaaatgcattttctggatttttaactggccaaatctttttctcacccacatctacctagccagagcgaatacaagtgggtctcgaggccatagtgaccaacagccaagtagcgtacccgtgcatgggcgctggaacacgacgcgcgcacgacatcgccagagcgtgcccgtcacgctcacggtgggatgcgccggtagcgaggtgcgcgacacggctcgacaaaggaggaaacaggaaatgggcgtgggcatgagcttagggaccagagcttaccacgacgtggagaagcagggaagaggattgaaaggagctcattgatggagcttccatgcgagcggaggtgaggctcggcgtgggcttagagaaggcggaggagctttggagaagctccctaagcaactagacaagcgggggcgagcacaccggcgataaatttccacgacggtgctcagcgagctcggcagcaatggtggcaatgtcggctaggggaggaaggatacgaggtagggtttgtgaacaaggacatgggcttatataggcaaggtgcagactgaaaagacgatccgaacatgtgtcattggctaaccattgcaagggcgttgttagctgtcgtggctgttaaccaacacgcgtgtggcactaacaggggaggggaaggatctgacaagcggggcccaccgagaagcaagcgggcggacgcgcacgc

SEQ ID NO: 1439 - DNA, 1017 bp, Zea mays
  misc_feature (1)..(100): optimal_loci_229515_G1, chr6:132074862..132075878, Cluster 9
tatgatcacttaaaatattgttttataatgtagatgctaatgtttaagtatagagttgagtttgaatataagaatatagatcaataaactgttgatagccttatctctttcccatgccacaaacgcaaggggaaacatatctcttccaccgatggttatgaaaaatcgttcagcttctcggctgtgacggcgctgccgccgtccaggatcgtaggcactgctaaaggaggaccaccggtccaccgccatgggccgatggcagcggcagggaggaggaggcagcctgttcgcgcacggttgctggcatagggtgcgtttgcccctgcttgccgcgggagcctctccgtcgggcgtcggcattcgcgcgagcactgccaggcagcctcgtggctagcgggcgggcgccgctgttggcctgccgcgcgagcactgctgaccttgtggctagcgggcggtcggcggtctgccgcgctagggcctgccgcacaggagcaaccgccgccgcgctggtcggtagaccgggcaccgccctggcctggcgagcgaggtctggacggccggtcgggcatgccgcgtgcgtgccctgcctccgcaagccttccacgcaggtgcgaggtagccgctgccagcctgccaccgggagtacgccggctttagtcatcgccaccgtggccacagtggccgaagggcttggctcgggctgcatgcgtctgacgaccgagctaggaaccggttgggttagtgcggagcagaatcaccaccgcggcgacgatggccgatggttccatccgccgccaccgatgagcgcttggatttggagcaggccgcgccaccgccgggccaaggggcgcaggcaccgccgctgatcaggttatgtgcagccaccgtggccacaccgggtgcgcggcactgtcgatttcggcctgccatggctgtggctgcattcgtgttgctgtggatttgaccggatacgggcgcgcaactgccgccaatcgcagctattgcggacactaccga

SEQ ID NO: 1440 - DNA, 1208 bp, Zea mays
  misc_feature (1)..(100): optimal_loci_230776_G1, chr6:138072402..138073609, Cluster 9
ggctgatcatgacgcacgaataaggtgcttctcagcatctagatttatccttaacgttagtgcatgcaagcgcattccatatttcatgattccagtgccgttgcagtcagggaactcgagccgttggaactttcaggcgaggagggtgtttgaagaatgcagaggcatagcccatgacctcctccatgcatggctgtcctcggaacggaactccatgcggacaggggagcaacgaccagtgctccgctctgcaagtcacttcatcgctgcacaggacccttctgcttccctgaaactgacgctgtcacgagcctgactagtcgatcgactttatgatgatctctgaatgatgggagccttggccgtttccgtagctctcatgcgcctaaaacaatttcgaggttcttcagtttcaggtaaaagtaacaggatgactgttttttactatatgtaaagggatgtttagtttgagtaatcactccatccatcatgaggtgattgaatgatttttcactactaatgaaggttattagtactagcaactggaggaagaatacgatggtggggatttgactggcaggcagcacctgctcctgctctggcacagtgccgccgccctgtctctacactctacgtaccagcgcagacatggtacgacactgacacgtaaaccgctgcactgcatggctgcatcgatctgctgcatggaggtatactatgcattttttcttcctgctgtccagtgtttcactgtacgtacacacatgcatggttccaatccatctttgctgtgtgtatagtagtattagttgcgttgtacagcagcacagtgccgttgttgtcagtgtggtcaccggctggccgtgaaccatccccacacacagccacacgggcagagagactcatccacccacccatgcatcctctagtcagcagacagcaccatgtcatgtgtgctgttccgcagatgccaccgggcacctccgttcacctgcctggctctgcctctcgctgcctgcatccactcgatcttgcatggaaccatcagccatgcagcgcatttggttgaagtgcgtggcattagcatatcacaactctctgcatgcatgttgtgaagttgccatggaggaagaaagctgtgttttggtggccaggggagagaaggggtcaattaacaccgtggaactggaatagaatacagttgtaag

SEQ ID NO: 1441 - DNA, 1145 bp, Zea mays
  misc_feature (1)..(100): optimal_loci_231838_G1, chr6:142420376..142421520, Cluster 9
tgtcatccctagctacaggattgctgcatgtatcaaacaatggtcttgagtacttatgttgcctaaggcatggcaacagtgtggttatcagaccttataattgtacaacatatttaatatggtgtacgagaacccttttttgaagtactagtgttatgaaactatcagtagaccctaaatgtggcattgtgcctttagggcttgccatgcccttagcaggggggctactacactccttagatttgaaggtgctttcacacttagccattgtaagagtccctctatcccctcgtgatgccctgagtccaagagaggattgaggcctggccaccgaaatatccaatgctaggaccttagagattctagggttggtagagggtcctagctactaacaaaacatacaactgttctactgttaggagcaccctagaactttaggggtcctctgtcctagatcattcttatgaacaacagtggtcaaaaagaacttaagtatgtgagcgtctcatagcctatagtgtcatggcacctaggtcttagactaatcctttgggagcacattggctacaatagcttttattctttcaaggggcccaagatagatctccctagaatgacgggcccatgccttcatcgaggccaaggcaagtctagagcatggggcctcgggtacttcatagggatccttgaaggcatcttagtagaatctagtctcatgggactgtgccgaaccaagatggtttagataaggtgtgagagctcctaggctggatcacacaacctacttccaacaatgtcaaccaagtgagagctccactgtggaccccttaggaggagtcatctagtcacgagagtatatttccttctattctcatgtgatggttggcctaaatttccacctatcatgcttccttattagaactcttgattactatagctccaagttggccatctctcccaatgttcttctttccctttcaaccttcacacacttatgtcaagtgttcttgggggtgagtccatgtgtagaagtttttcctcatttttcatccttcgagctttgagcagctaaaacctctttggcaaagtctacttacacctctacactcacccctggtaccagactccatacatggccactaaca

SEQ ID NO: 1442 - DNA, 1104 bp, Zea mays
  misc_feature (1)..(100): optimal_loci_232305_G1, chr6:145282610..145283713, Cluster 9
cgcctgatcggaggtagctcatcttcatcgtaatgacgtaatttgagcatgtatctatatatttctgtcacagttttgacttttgtatggtaagatggagacaagctgtgacgacagtaggacaaggcttggcaagccttatacgtgacacagttacatttatgcagcacaagtccagaccgtgcttacgtacgcacgtttcggcagcattaggtcatcgagcttgggggcacgcacgcgcatttccgtcatccatccctgcgctggggccggcgttgaccacgcctgctccacggccctccccagtctggaacggccggtccacgtcagcggtggtggcatgaaaatgtcatgcgcaagcgcaacatggccagttaataaataattcgggatctagcccggaaccacgacaggggaaccgatctagtttacctgatggctgatctgtgcatttccttgtagacaaaacaagcactcctgggaaagactgatggtaacactgtattaacagcctgacaagaaccacgtagcgcgatgcaactcgaaccggtttaattagtagcgatgtgtgtgcgcgaaagaaatctggcgtcaaaacgcagaggccacgaacgcggcgccatcatcaagggcaggcactactgattggttggtagtgccagtggacctcggcgctggttggctgttggccccgggcacgcgcgatcccgtcagcgtcgaccgctctctgccccgccgcccatccccaatttgctttgttttatttttaatcactcggtcgtcggctaacgaccgttggctgcactgcataattgcctctagtttattgggcttctgtatgagcagggtctgcctttgctttcgaaattcaactctcctaaagatgacaggccctgatgcgccataatgctcattagtttgtgggaaatgagacaactataatatataatgctcgtcatcgaccaaccgctgcgtgctaaggatgttctatactgtattggtccacgcgttgagctgacaggatttccactttttttttttttttgcgttttccttaacttggtgatgtttgtagtagcattttgttttattttagaaaacgat

SEQ ID NO: 1443 - DNA, 1003 bp, Zea mays
  misc_feature (1)..(100): optimal_loci_232831_G1, chr6:147677421..147678423, Cluster 9
aggttccatgtagaaagttacctcaatttgatgggattaactttgccaagtaaaacatacgagaaagttacatcctctttctccttcaaattgttcttataacactcctctatgtctgtctcgtgtggaagaggccgggcgtgtgttgagaggtggaaagctcgcggcaccacgaaaaatcgcaattccccagcgacggccatccctttcacgcagattccacgcgatcgttcttgggtcatgacagcgagcaggagcagcagccagcagccaccagcggatcgatctgataacggacgggtgggcgccaccgcggcggggcgcgaccaccggtgaccggccgcatgtgcggatgtcccgccaacagccaggcgcgccgcgggaggcagtggcagccacggcccacgggccacggccgaccgcccccacccagacccagttcgcttcgctcggccagccccagccccagccgcggcgcttgatttttcggggaacccaacgaatcacgcctttgtttttcgtgtggacgcagatttttttggccccgtcgtcggctcgccgtccacggaccacggcgcgtccactccaccaccggccaagaggacgcgcgcgccccggtgcccatcgccatcgacgatgccgacgcgagtccttttttttttggtcatcccgcggtgctgtgctgtgctgcagtaaacgaatcctttttagcgtggtttaccagtaatcagtccgctaaggacctcgtgccgatccacgtgaaaccttcgcgtgaaaggaaaatcgatccctgttagcacgcgacgggcaccttcgttctgcgcctgtcggtgtccgtatgggcgcgcggttccttcttgagcttgagggcgagggcgctgaacatgactaggattttgtggtcgctggtcgactttctctttctctctgtgagataccgatgatttgacaactcgcgatgccaaacttttcctcactgtagtcctgtagatatctccacatt

SEQ ID NO: 1444 - DNA, 1338 bp, Zea mays
  misc_feature (1)..(100): optimal_loci_2338_G1, chr1:12506998..12508335, Cluster 9
tttatactgggacgtagagagtatttagatataaccgctgaaactttagatattaaaatacgaaactatagtgcggggaaccgagcattaattgtctgtcttccgtagccaacaccgtaggttcaggccttggggggttattattcctactagttgccttctccattgctccaaatgagatagcacatctcagaatagtagtactactctactagtagcgcgtacgtacggtatgtacatttccatggcaagcgcacgcttggcagcacagagcgcatacggccggccgggcaggcgtcctctgctggcgggcgccgtacgtcccttcccctcgcctcgctcccaactcctgtcctgtatacctacggctcccagtcgggctagctgagacaatgaatgcgcgcgcgcgcccacaggcacgagaggccgcttgttcgtcgatccgatccgacgccggcatcggcaccggcacggagtagctaggtagcctgaccgtagtgtggtggcggtcaaactcaaacagggctttcgtcctactcctccgtaactcctaatcggtcgacccgcatgcatcgtgtctagccagccgttccttctcacgacacgggagcggagcaaagggcacgagacatcacgtcggtcgccaccgcctaacgctcatttgttcggattctttgatacgaggctgatgcgaggcaattctgcttcgtcttccggtggaacgggtgatctgaggttgatagagaatcttggtcctccctccgtagccaccaaaaaatggtcgatacattccgccgtgcatccaggccccgtcgacacgcacacgcgatcgcttcacatggatctgccattgccaagcagcgccaatgcggatgggatattctgctccagcgccagcgggaggagaaggcaaaggcgctgtccggtgtccgctctgccttctctcgtctcgtgaaaaagggagcgccacggcccacgggccgggcccctccaggctcaccatcacacgtgcaaacccgcacgggagcactgcaaacgcctgacacgcgcgggaccatccaaccccaccactccacttttatcgaccggtgtactccttccgtctgcacgttcagaatttattttaaaaataagtacacttctaggtactaccaatcaacgtaattccagctacgtttttctattttcttccttcgtaaagtacaatcccgtagctcctactacaactctcctcccccgatcgggtctgtgttagtgcgagttctattgtttttcataaagaagaagaccatctatgtacacgagaatcgttcgacatgacctgctcatacaacgaga

SEQ ID NO: 1445 - DNA, 1123 bp, Zea mays
  misc_feature (1)..(100): optimal_loci_2339_G1, chr1:12508905..12510027, Cluster 9
taaaacatgggatttggagccttgtgaccacgatcggcgtctgcctaacaggatatgaacgaaaacataacacggtgattacgtagctatagcttaattgtctgtccatgtgcactgctgctggatctcgttcacctgccaagtccgacaccaatcaacaggcatgcatgtagtttgtaaagttggctggctccactccacagtctacactctacacccaatgcgcaagtactagtctaaagtactaccgtggctacagcctacagcattcccttccctgccgatcatcgatcgacaactcaaaaagtgaaactgctctgctttgcttgcctgtaggctgtaggctgtagcatatcatcactcgtctctccccaaggctagaactagaagctgtctgggtggtggtgtctctcgtctcgctctccccgtgatcacatcagttcacgcgaggtcctatcgtaccggacccgcgggcccgccccacgtgcggcacacccacttctcccgtgtccggcccgtccccacggaggactgcccgatctctctctctctctcgcgtctctttttcctttccaccagccggtgaccgttgaccaccgccacccgcgagaccgcgagggcgagagcaccgtggaccgggtctacgtggcgcggggcagggcaccgcccgaggcggagggcccagcagcagcgatcttgaccgggcccgagcgtgcggtcgcggcggggtccgccgtcaagcagcacgagggagggaaagccaaggccacccaccgccaccggcccaccaccaccgcgcgagaatcgcccccgacacgtgggcccgccatgtgcctgcccgggtcgtttcggtcacgtcggcatggggcgcacgaggggcgtggcgccctgcccgtggccgtgggggtgggaccccgtccctcgtcggagtgggcctcgtatccttcgcgtgcaccactccacccaaacggggtacggttcgtgcgagccccagcagcagtgcagaggaagtgtgcggctttttttttttcgccggacgtgacgaattgatggaccgatctggcgacgccgcgcatgcagcgtctgcatgcatgcatggaaatacctgttcccgtgcgagcag

SEQ ID NO: 1446 - DNA, 1242 bp, Zea mays
  misc_feature (1)..(100): optimal_loci_234240_G1, chr6:153772394..153773635, Cluster 9
tcctaaaaaaaccagaccgaggagacagaaaaaaaacagtttctatttttctctttattggacccacatcacaggataagctagaaaagagctagtgctctttctaaaaataagaatgtaactgttttctaaaaataagaatgtaacttttagagctagtgctctaaaagtgaaggagttgcgtagactttttctttttcttatagaggcctatatgagcgtggtgaggataagcacgacacctctagctttgcgagaccatcgattttgctgaagtagtgtacttcactgcacacgaaagcagtaacaagtggaggagaatgtttgcatggctcaagccgttgataaattttctctgatgttattttttgtgaaaaacgatttctctgatgatatttgtacgaataacttttaaaaagttaaaaagaatgaagaagaaaaaaaaaccacgctccggccggcggctttgccgctgtctttcccgggccgtccacgcaaacccgtgctagctggagatttgccagcccaccactctgggtcgttgcctccacgctcaccggccggcgcgcacgccagcggctcgtcaacatttccagctgcggccacgtggcatcccgccacgcctcatcctgagtcataactggatcggagggacggatcgggtcaaacgcagcgtggatttgtttttaatcggggacgcgaggcttttggggcctaacacgtggctaattgcgcatttttttagtctattttatttttcttaagaagggaaaggcaaccggtattctattctatcgcgtgcgtgcgtagcaggacacaccgacctggccgtactaacttgtgaagcctgcatgcccaccgtgctattcattcagttttgtcaaatgattccttttaccgccgaaggtttgacggcgccgccgcggcgccggcaggctagctgcctttagattagacatatttctcgccggatgcgcaggggcatgtagcgtccggcgcacgtagtcgtgaacgcagcggtgcgtggtacttgagtcggcacgggcctttgtcaattttggccacccatctctgacgacgtgagagatctagcagccctgtacttgggcctagctactcgccgccatatgccccttctccagttctcttgcctctctcggcatagcatacaacaagtgcgtgccaacttggttaggcatttgtttctgccctgccacagttgttgtttggccgttcgttatg

SEQ ID NO: 1447 - DNA, 1343 bp, Zea mays
  misc_feature (1)..(100): optimal_loci_235293_G1, chr6:158642439..158643781, Cluster 9
ttatacatttttgtatagaccgtcatacaaaaattgaattcaagttatatgcaaaatatccacagtttgtcacgatatccgtaaaatatatggaccgtcatagatcaagttatatgcatataatatacatggccatcattgaatctctcaagcccatttagtcaggctaggccgaagcctttttgtcaaaaatgaccgttacagattttctgagcccatctagcccagacaaagctatgaattcgaatagtgattagattgtatttttccttgacagccccataagcaaaagccacgccaccgacgggcccttggagcgtcacatcactgagcagcgctacagtatcggtcacggtcggcgaggcaggagcgctgttgcattgaccggtggacaggagcagcagccgcctgtgactgtgagagccaacccaacccaacccaacccaaccaatggcgcaagtaaatcacgggcgggcgggccacgccacgtgaacgtaggcaggcaggcaggggcagacaagaagggcagaggtcagagacgagcaaaagacggctggacgcagcgcgcactccgggaaaagcagacagacaccgccccccgtgaaagccgcgcggcctcccgacctgctgctgctgcgtcatgtcatgtcatgtcaatcgtctgacgcgacgcgccccaccagaaagggaccgactgaccgccgcacggcaaggcctgcttgtcttgtctgacgcgcaagcaagcaagggagtgaaagctagctacctacgaaagcaaaggggtcgtgggtcgagcgcccgggcgaggaggccgctgctgcctgctggtgctggccgagccgtggcgcaggctggcggaccgccaccggctgaccgcgcggtcgccacgacaaaagcgacggcgacgcgatgcatgcgccgtgctgggtcgcggtgttccggcagacgcagacgcagacgcatgactagatagatactctactcctcctgcctacggcggcgtaccgtacctgcatgtttcggtccgtccgtgtatgcaacgcggcttctattcccggccaggccgggctctcttgtctgcccagacacgcttcacatttccgtttacccaatgtgccatagattttttaggctaccatctgcattctgaaatgctacttctatataaagaaatcatatatagttctataaatgataaataaatgacttctctcacgtgcttaccttctatgtgctttttatatattgttcctgttcctgatgactcgataaggtaggcagaatgtacctacaacttcgtagctaataatgaattgatcttttcatttctgatccgtcgttta

SEQ ID NO: 1448 - DNA, 1044 bp, Zea mays
  misc_feature (1)..(100): optimal_loci_235525_G1, chr6:159694352..159695395, Cluster 9
ctaagttcgtgtactgaaatatcaggaaaaggcaggttggctttctacaagaacaggagcacattccatatgaaatccgatagctagctagaggagccacacacacctgcatgcagaaagcagaaaggtttcggcggaatagtccccgggctcggagcatatgccgtcccatggcgcgctatataaaccaggtcaaggcgtagacacattcatcagatcagagctcggaaaaaaaaatacagggccgggccgggggagaggtagctggcatggcatggcatgtgcttgctgagcatgaattacagggtacgtctcctttggcacagcagaatgcacacatcatcagtcgagagagtaagctcgctgcgtgctcgccggcctgggagcggaagtcgcaggccaaatggcggcggtgcagatgcatgaacagcagctgccgtatatatgcgtgccaaaggagaattgccctgcgattctaggctcagcgatttcggcgtggcggttcgtccagctccagtgcgtagaccccagttgattaagagccaaagccaatgtcagatacatggtatatttacagtttgaggtgggtttgcgatgcgagtgcgactatatgttcaggtaattgtcttttataattaagctagctatactatacccagcatttttttacctgtcattagctgtatatgctttagtacatatgaatgttcaatatttatattttcgtcttattataaaattggtggaagcagtggtagagttggaagcacattgttcgatttaaagtattgattgatagttgaagtattgatgagtttatgattgaaatttggattaaagtattgattggtagttgactcgattgaagatttcaaaaatattgaacatttgaattgttgattcaatatatatatgggttgtgaattttccgaacgttaggattgcagctgtgaggagatatttgataacacaatgcggtcgacgacctccatcatcaccaccacctcatccttctgctccacctcaagacaatagccatgggtt

SEQ ID NO: 1449 - DNA, 1205 bp, Zea mays
  misc_feature (1)..(100): optimal_loci_235821_G1, chr6:161471748..161472952, Cluster 9
aggtcttctcgcagtgccggccgcgccgcacatattgtgataagcatccacagcaaaataattaggttcagtttgcaagagatcagagaaaacgacccagcttgattgccactggtttgtttcagcctccaaaggtcgcgtgcttcttttgtctcactcgcacaggtgtcactacgcctggatccacccatcatcaggccagccgccagccgccagccatcaggtcgatcagttcagttgcgtctgccgcctcgcaacccatcttttaaacaaaaggggtagcttagcttcgccggcggtcatcaatccactaacctaagctaggtgggcactggcgggtagagatggtgatcactggtcgatgtgtcacgtgtgcgtcgttctgcgagcgacggcgacacatgcatctgcacccgcccggcccgccggccctcgcgccacggcacggccagggggcatctatctatcggtgtctctgcgcgatgcccggcaaccgaccgatcgacgtctgtgaggtcatgtagtgtagaaagatcagaagtcggccgtacgtgcccgaacttcagcgggctgcggggctcgcaccagccgcagggcagggcggattcggttcggccgacgacgacgacaccagacagctactcgttcgggaaatcgggacgcatcagccggcgacgacgcagcaacgcatgggggccgcgaataagttcaccagcgaagctgcggcgaatcaggccagtccatggcttctagatcgcgctctgcagggggatagagatccatcacggcgcacgtttcagctcggcttgcgttagttacgcaaatttttgtttttgtttgagatcgatgaggaatggaaggcgacgtcgccgtcgtcgtggatcccagtttaatatgcggtgcgaacggcgaccttgacatgtgaaaaagacgtcgccttggacgacgttcggctccatcgtcccgaatcattgtacttttgtgtgggcctgccgtcggtcgccggatatgatcggaggagggaggacgacgtggtgagaacggctgtcgtcctggcctcacgagccacgggggaggggaggtgcgctccgtgcacggaaagcggccggtttccgtatgcaaggcaaaagattcattagccaagcatgaagcatctttcctcgactaatataaggagtatttagtttctagtgactaatttttat

SEQ ID NO: 1450 - DNA, 1298 bp, Zea mays
  misc_feature (1)..(100): optimal_loci_236381_G1, chr6:164510504..164511801, Cluster 9
ctagtatcatgcgctcagcgtctctcagcctgtgcgcaccatgctttttccccgtcggaaatattctccaaatgtccgcggcgcatcacaagcgcgcgtgtgtgtgctccactgctcgtgtcgacccccagcggcgcgcgcgcgctctctctctctctgcccatgccccatgctgatgccggctccccaagaccccacctcacgacgggcacgggccccggccgaccacgagcagcaggagagggcgagggagacgcacacgggagacgggacacgcacccgtcgcgcaatcatactgcgaatcatggcgccctcccctgcccctgcccgcctccccgcgcgcttcggggcgcgtcgcgttcgcctagtcgcatcaggttcaggtcccccaccccccttcccacacggtggcgcggggactgcccctgcggccctgccctcgctcgtcagtcgtcacggttcttttcctgcctctgcgttgcctgccccacggcgcgtaccggccagcagccgaatatccagtacagccacatggcgccccgccgccgccgcgactctgtgttgcccgcccaccacttgcgacggcgacggctgacgcgcgccgcggtacggtaaaactgctggagacgaatagtgcgccgtgtcgtacgaaccagacgtcgtgatccaaggttacacgtctacgactcactcactaatccggtcttaataaaaaaatctacaagactttcgtattgcaatatataggggggggtagatttaagcattatagtatcatcacggggacacccacgtatacagggcccgttcgagtcagcttttttcttggataatctagacagtagtttatatatcgtggaggttgcgtggtggtgagaaagatgaacgagtctgcataattttagggtttagaaagagccaaatttctctcggctcgatgatttggcggattttgcatcattgatttggatgatttttcacataagtgctgctcacaaaaacggactcagaagcgaatcattttgggaacaagcacttggccggactcagaagcgaatcattttgggaacaagcacttggccgccctctaagtatgaggttgaagacaccttagagagtggaaggccctgagatactaagggttgtttgtgttcgagggatacactcttgtgagcaccactaccttattacctcgagacacaatgggttctaggatttaggtcctatttgtttgagcttctcgtcaatttattagtgtaaaaagctggagttgaaacaaacatatagccctatttgtt

SEQ ID NO: 1451 - DNA, 1361 bp, Zea mays
  misc_feature (1)..(100): optimal_loci_237735_G1, chr7:3177679..3179039, Cluster 9
catcaccaacaaataatgcacgccatgaacacatgcaccggccggcctcatgtattcatcgttcatgtatacgcctctttataacacgtacactgccactcatggacactgtagcagcagcagcagtgtttggtgcacatgtaccatatcacgcacgcacgaccatcatgaactggccgacacgttgcgcgcgcgccaatgcaagaagcttctttaagctaaaaaaaaactgcaagtgtttgtattagctactagtacttggacgatcatatcgtatcagcatacagggtctgtacatacactgctgcattgcctgcctttattattaactgcacatgcactagatcgaacggcgcgcgtacgtatatataattatatgcatgcgcagtcgttattggagtacatacgaaagtcaaggtctagctatttgttaattagaaacacatgcatgtataatgccaacggaatgtagctagcgtgtaccaaaacagctatagctagcgtgtgtactcgtctgtgtgcaagtgacagtgtaactgcagtacgtacgtgtatattcatatatatatacatccgttcgtatcgcgtacatgtacgtacacagctatagctagcgtgtgaccttctcctcctccttattgcatgcatgcatgcacaactgttggtgtggccattgccatgacagatggacatcaagcaacagttgactctcacacacaccatgcattatatgccatcgccattctctctctgctcgtgtagttacgttagttgtggacaggtaccgtacgtaccctggtatagtaacagtgtgtagagagcatgcacgcggcagctgcagtgtctagacgacagaggtacgtagtagtagtgatatatatgcagtaccctgtacacaagtataaagagtcatgggatgggttgctctccttcttcagaaaagaaagcctcgtcgcatgcagcgctttgaattggataggctcaggaggcctcaatcagatcacttggacatatgtattgctgccattgagggagaggcggagagaggcccgccctgcacagtagtggcgccacaacactgttgccaagtgactgcctgtgctgtgcctgtgcagttggtatttgccctagcacaacaaaagtggctctactaaataccctacatatcctactaccatcgatcgaccacatgtacagtacagtgtggtggatgcagatgagcacattgcttccttcccactttttcctttatacgaaagggaaggctgtacactacatgcatgtactccgtcctccttctctgttagttgtgtatggtgctttattagacactggttgatcgataactgatatgcttttta

SEQ ID NO: 1452 - DNA, 1111 bp, Zea mays
  misc_feature (1)..(100): optimal_loci_238349_G1, chr7:5968659..5969769, Cluster 9
gaccccaaattttccatctatatataatgaactgttgtctagaatcagcacagcgaacaaaaaaatgtttttatggatcttttagtttgtactatacacattgttttctaaaaagttagatataaacatataattagtactatgatctcttcaatcacacgataaattttaaaaaaaaatgatagcctaaaagggcttatactgcctagtttgtccagagacccttaaaataaccatagagctagccgaccctgactatatattttgatggagaggctattagaggagctagcccgtcgtttggtactttttgttttggagctgttgggtgagcctttgaaagagtcgggagcctatgtggtgttggctagcgctattattggtggggttagcaaacaaatctgtctcgtcttctcagctagcgaaagaaactaactggaaatcgcgcgctggattgtatgaacaatcggtgttgacgaaattggcaacagcatcaaatcaaacccagaatccgctagctggaggaggagcttaattatattattaactatacgatgctgattacggactaattaagctaacatatgttagtgtgcagtgagactgatagttgcaccggccaattcagttggaggccgggtgcggattccacgtgtgagaattctgttttaatttacacgtacgtacacggtgcgtgcgtgtgagtgtttgacgatatgatgtgtagtacgcgtgctgctggcttctaggaagctacgcgaccagattcctgccttctccgacgccgcttggctggatgccaggaggttgcagctcagctgatagcgccacctcactaggagcagagcatgcaggagatggagctggaggcacaggagccgggttcggtgtccacgtgtcccatcacctgatgtcaccctgctagctaatcgcatacgatcacctgggttttaataattgaccaaggcctactctgatagtgatggaggcgtcgtcctgagtgacctaaccaggctactctacacgcttgttctaacgacgaccaagtcttgtttcccaacgacgatactgctttaatttcctcggagctagcaccagtatcagcatcatg

SEQ ID NO: 1453 - DNA, 1163 bp, Zea mays
  misc_feature (1)..(100): optimal_loci_238350_G1, chr7:5969854..5971016, Cluster 9
taaaacgagcgagtattatagtattatactgatcttgtccagttattagcttgcatgtcgttgatgtacgtgtacgtatatacgtacacgcctcctagcttgaactctaatgtgccagctagctagtgtgtgcaagcatgcatggtgccgtgcagggggggtatgcatgtgtcgtcacccacagtagtctcctgaccgatcgagcttgattaacctactgatgaacacatagattaacaaataaaggtgcatgatgcgtgactgatgactacgagtgtgtgagtgcgacggcagcgtcatcggatcttattagcacagcaggcgtgcctggctatccagtccagtacgaaataaatatataaaaaaggtgattagggcgaaaacggcacgattccgcgttgaaacggtcgaggagaggcaggcagccagccaggtggaaataaaagcctatctctactggcatagcacccagcaggtatagcttttcccgctttctctgcgtgttgtgtgtgcggtcggtgcagtctgcagtgcagtgcaatgcgagtggtacggtggaacgccgccgggcgccctgggcccgacacgtacccggagtacgtgggcgcctcccactggatcggagggggctgctgtgtgtgtgctacccggccgggccaaccgccctagctagctagctaacgtacacccacgctgcacggtgcagcactgcattatacgagaacgaaacaagaaggcgcaggtgatgacgcgtgtatacgctcttgcatgcaccccttggaccaaccaaaaggtgccgcgtgtgtgcgtgcgtacgtgttcacctcgcttttgcttttgatggggtgcttcactcactcggatcatcagcaggcctacctagctatagctaataagcgctgaagccaacagctatatagccatgcatcgatcagtcctggtcctggaactgcaagcaccacaacgtaacacacgtacgtactttggcgaagcaagcaagccaaggggctggccatggctagctccaagtgcggtgggccgccggacgtctctgcgctacctaatgtacgttaatgtcgggcatcaagcacaaattaaagggcactttatgcttccttttctaacactaaattgcattctagatggctagagagggggtgaag

SEQ ID NO: 1454 - DNA, 1121 bp, Zea mays
  misc_feature (1)..(100): optimal_loci_252700_G1, chr7:100245591..100246711, Cluster 9
tccagtcctacctctagcgctagtgctggccccccacttacttatctagctgtacctgtcaatggcctctccttttcagcagcgagcaggcgttttgccgtgccgccgcggtgacacacacacagtactcgccaataaaataaaaacgctcttctttttttacacacgtagtaagaatcattagataagttattgaatatatctctatactaaattcattcaaagatgtaattatatttgcccgctattagacttcgtactatcgctacttgatcatcacctatctgccttggttttcagattatttttcttggttgtgcatgcaagaggcgcgagacgtgggggacgaaaaaaaagcggcggcggttgataggccagtaggatgatgagaagacaatagggaggaagagaagagggtgctcgcggtgtttgtatggttggttgtgcatacaaatggtgaggtttggtaggaaggttcctctggttccttccttattttcaggaacaactatagatagaaacaccctattttggttgaaaaatatagctcgtccttagcttcttctaagatgtagcattcgacgaagaaaaaatatgggagatgagccaatagaagctctttttttctggctcctgatttatgctgtttttttggaggacctcatcactcttttataggaagagcctatcaaagcctcgcctttggtagatctttacgatcgagaagtcgttggaggagtcattgaagtgccgtgtcaaggatacacagtctaggtacgcaagcgggctagtttgttgacaaagttaaaacattagttaggttcccgagcccacctgtatctttcggatgagatgaaagcctggaacctgcggcccaggctcccagcctctgcaacacatcagcgcaacaagcggtccgtccgctaagcttcggccctttgggtttggggtgggcaacatccaacagcgagcctgtgttgttgtgttgggctacgacttctctctgttttagcattcctctgtgggcaacgccgcaacgtgacgttgagtgggcttagcgtggcgtggtcgctgagcaagtgtgtgtaacactttgattatgtgactagctaggcccagtt

SEQ ID NO: 1455 - DNA, 1185 bp, Zea mays
  misc_feature (1)..(100): optimal_loci_254305_G1, chr7:108825190..108826374, Cluster 9
tgctactttatgaaaaaaggtagatataggaccgagtactgctacattcgcattcatatcatatccactacgtacatttctgagtgaaaaaaaaaatatttttcctacaataaatccgacattgagctgaccttttttctgtgcttggctctctattgttctgctgtcaacacggcatgcagaaacccgaactgtggacggaggggaaaactgacaagtggcagcaatgatgataaagaataagtaaacaacgacaacgtcgtaccccaccagatcaggatatgctgctgatcgaccgactatggagtaaggagtatggagatggactggacgcgtcgtctaccttttcgtttcgttggcaaccggcgccgacccacgcttgcaaagatttggattggattggcagtggcactacgtacaatcccggccccctgcagatggcattgcaccctccacagctggaggccagctgcatgcaatgcactactactgtctactacaatgcaatgcaaaccctaccactccatctgggatcgtcaacagctattgtcatggacatggtgattagcaggatctggatccctccgtgcgcagcggttgacctaacccggcccccccaccggccaccaccaccacttcgcgctctcgcctcttcggtgacgacacatgacggagaaggtgacgccgatggtgcgctgcgcacgggctggcctcgctcgcgcctctaatcaaacccaacccatcaagacaatcaccgtgcgtgtactgtgtgggctggggaatctagagaagcccatgacgaaaccgacgggggaacgcccaccggacttgaaacgcaagggagcaagcaggcttcaattggagggagcccaggaaagctcgagcttcccgggaaggagtaatggcagacaggcaggctggttttccgggcaagaagtaataatgaccgcatccaagttccgaatgccgcttctctctcggaaaggcgaaccgcgaatggtgcatgcgcaatttgaaaggcgactcgtgcatgcacgtcaagctgactcgcacttctagcagcagcagctgacgaagacatggcattgtttggacatgcgttagcacattcttaatgaaacaaatccactttttgcacataccctagtactaggagcgtgcctctggatatatacaccctctggt

SEQ ID NO: 1456 - DNA, 1322 bp, Zea mays
  misc_feature (1)..(100): optimal_loci_255412_G1, chr7:115142223..115143544, Cluster 9
aaccactagctcctttcctggatccttttccaaaacagggtggcattttcctcctttggaacatgtctctatttatctccccctttacaaacttatatattggccttccttttaaaagtgtgcatacaagtaaccggagcaagactgttggtacttatgttttcaagatatatccacggtagttgtggttctagagagctatacagtctagaatgttgcctgccgcttgaagatcgtcgccgccgacacgatctgacctaacctcccgtcgcttcacctgctcggctcgtcagcctggcctcttcgcgggctccagcgatatatataccagatgcctttgacagcctgccatagacccacacatgccaaaattgctctctcaaaagctctcgaacagccaagccattttcctcaatgatttttgggacgccaaattcctcatgcccctcgatacgatactcctccaaccggctctaccgcgtgccgcacgctgcgctgcgctgcgctccgtacgcactcattcgcgtggacggtggacctgccgctagatccggcacacggacagagtcacagagagagagagagagagatcgcctgtgccctctcggtggtgcctgccgggcgggtgacccgcgctctctacctgtccgccgctggcgtgaccggagtgaagacggcgatccacaccgtacgatcgcgaggacgccgcgtcactgcaggctacagccttgcttcgccttgactgcagccggtgacctggccacctgcacctggggccctggatgcacacggtgagtgcgaacggtacgtagtagagcagccgcttctgctgcgtggatgtgcagtgcaggagcctgcggtttcgaatagagtggaataaaaaaattacttttcaatggaagatcagcaatggcgagcttgaatcctccggctcctgcatcagcaatggcggcatgcaggtgcagagggggctcaacgtacctaagccggtgtgcacccagtaccctgttgcctctttttttttgcctaggaaaaagcaaaggttgtgtggatctatcttccgatggtaatgggaaggatgcaaaggatttctctgttttcggtgctacgaaccagggcaggcttaaatgtgccatcagatcgtaaaccagggcaggcatggcaacctcgaatgtgtcatcagattgttgtgcgaaatctgtggcggtagtactgaactgatcacacctgacaaggaagtgtcccccccttttgaagcaacctcgcacagctgtggcggtactgaactgattatctggcattgctgttgctgatgatgcttt

SEQ ID NO: 1457 - DNA, 1124 bp, Zea mays
  misc_feature (1)..(100): optimal_loci_260278_G1, chr7:141585663..141586786, Cluster 9
aacagcacggatctctctacgtggaattgactgtctgtcacgcaagcaagatatcaggaagaagaacatcgttgccgagaagatatagggctggaaattcatatcacacctgggccgatcatccatggcccctagggacaattattggcctttctttagcacgtgctagtaatatgggccgagcctaatcacgatcacgtcgtcatgtttctttctacacgaagcggccccaacctgatatgtcttggaaattggaatggacggcgtcacgcctctgaagatagtgttatatcgtttcttcttacatagcattcagcgacaaagatgaatgaggatgactcggtgcttttcggcgatcatgggcgggagaccggtttcccaggtttagacgccgagaggttatttgtgggaacgacgccgattctgcgccaggaggaagcaaatggacatttgaagatgatgttgtcgctgtcttcatctgcttgatggcataggtcacatgtggcattgctgatgatcccttttttcactagattcgggttttttaaccttggtggagagaaggaactccacacaaattccggtttttcaagttcagaggcagccattgacttgatcactttgtacagcatcccagatttcaggtttcctgttttgttcttcttcctggttagtgtgtgaaaaatcatggagcttttgctgaagaatgttgagttcttgtcgagcaggcctgctcaagtacagtttcaggtggttttcgacccctcctagctgcttgactgacagttgcaccagggttctttgcatgactcgcgatggcaggcaagtagtctgcgatctgttcgaaatctaaccagtcatcaagccagaaagaggtggttctagcattgccgattttgacagaggtaacctcttggtacagagggagcagccactgaagagttttcccagtggttccctcttcaaacttatgcacgaataacagtgtgttttcagtcatctgtctgattggccatgcttcgctgctgcagcttagatgttttcgaatgtcgttacatgtaaaatccagttcctttatcctatttatttgataatttcatttagttattgaggcttgagaaatg

SEQ ID NO: 1458 - DNA, 1140 bp, Zea mays
  misc_feature (1)..(100): optimal_loci_262299_G1, chr7:153187385..153188524, Cluster 9
gcgcgccgccggtccggtagcgcaggcgctgctagccctttgacgtcacgagtgacgcgcggatccctctactactgacacaggatttgcgaggcatggagcgataagataatttaaatctggcaagttgcaacttgcagatttgatttctatatctactccctccgatccggtccgtcccacgaagcttatgttttagggttcaggatctgtactagaaaaacaaatttatatattgatgcgttttagattgatggacactgcctcgcagatcatacgcggttctagtttaatagcgagttattcgtggatcatcttcagtgaataagtggtacaagggtacttcgttttcattgaacccgcggtcctagcctcccctttccttacccccttgctcgcgccgcgactcataccgtcaacccttcctctcacaccgccgccaacaacgtgaatctccctctatttttcgggatgttttcgagatcgtagcattagcataagctatacagtggcaaccatagaacatcgaagcttttctgggtgaacttcgaattgacctccggtgctattgctactgcctgcaacgacaaacgacttctgctgtagtgctgtttgttttatcatccggtaaaccaacacttgtctaccttgttgctgctatggaaactcactcagttttggtaccattcaggagttcagagaaacaacaaccataaccacgcgacgcccatcagtttgatgccaatggagccatcgatgggtcttgtctgcttgcctgcgctttttgctcaatcaaggacggcttttagaacgtgtttgcttgggaacccaccactgcccagacccagagttgtttgattcacacagcagatcgagtcggtcggttttgtcagcttggggggtctggatcgctgtctgtcggtgtgcgtgtaggtcatgctgcccggcctgatttatgaattgaattgagagttcggtcatatgaattgagagaaacaacagcagatcgctgtttgattttaagtctgcctccaactccaacaatcatatgaattgaattgagagttcggtcattattgcaatgattatgccaacatctgtactagtttaggtgcgaggttgttcgggctataataaaag

SEQ ID NO: 1459 - DNA, 1130 bp, Zea mays
  misc_feature (1)..(100): optimal_loci_262401_G1, chr7:153829141..153830270, Cluster 9
acgagtgtcggcacacgcggccacgacggcctctcgttctagtttccggcccacgccatgcccagtcgctgcgcgggcggctttataacagggcatgctcgatcggaattagtaaatttcagccaattttacagtacaggggaacgcataccaggcctcccccagtcccatgcatgcaatcttgtagatttcaggtggaattggttcccagacggcttgattaattattggcggcggtgaggggccccggcttgattaattattttctctcctccgcaaccgtcgcggtcatgtccattttttgttgtaatgacctggctcgatcgtctccatgcatctcgtcgtcgtctcttccatctctacagtcaggcgtgtgtctgacgcgccggttggtctcggcagaccgtacgtcacctccatccaccaccacaccactcgatggccggctccatgccatgcatgcgcgccgcggggtctcgatcgcctcggcctgaggtcgcgcgcggtgacgcggtccgttttcccgtgcttgcaccgtgcacgattcatgcacggcatcacagcagggatcggatcggagcgcaggcgcagcgcaggggagcgtcctgtgcatggctccgctacgcacggcggcacgaccctcctccgcgcgcgtgcatgtgacgaacacgtacgtacgccgtgcgcgtggagcggtggaaggaggacagatccggtggagcgtggagatggagtggcgcggcagctagctgcatagcgagtgtatacgtgcgcccgcgcgcgcgtgccgacacacgtacccgccagacggcctgcacgacgccagtggatcgcccggtgtcaaggttaatttctgcgactgggatgcattatgacgcttgcttgcttgcaaattcgaagcgccaaaatacgaaatgtcggattgttctttggaccgcctcgacggctttaaccaggtggatgagcaacagacgccgtccgacaacggccagaagaaatgcgtcgatccggcccaagagaagggtgaggcccagtacgaagctcttatggcccaaaactatctgaatgcatcctgtcctcggtccgccgtctgcctacctctctctctcgactccttcctctagccaggc

SEQ ID NO: 1460 - DNA, 1153 bp, Zea mays
  misc_feature (1)..(100): optimal_loci_263139_G1, chr7:157196138..157197290, Cluster 9
atctcctcgatctcctgtaaatccatttgaacttccagcgagcgctatagtcctacgtcatcaaattcaatacaaacaaacaagcagacatgtatgcatacgtatgtatatactagtagtatactgtacttcctccgtcgtggtccctaaaataagttcccaagaaggcaatcattttaaatttttaatcaaatatatataagattacattaatatcatcaacactatataattggcagcattagatacatcaatcgtcggatctggctatttattttatttatttaaagatatatatattgcaaatatttctataaaattgactgaatatagctaggaaattttaaccggaacacaacgggtacacacgtgaagcagttatttaagtaccctagctagctagcgacgtacccggtatggcggtatcgtaggtacattatatatgattcagtacgtttcatcacgcgccccggccgcaagacaaaaccggccggtctagatttggatgtaactttgaaatagtgacccccgtacgtgtctctcgcctcggggacagtatatctttccatggactatatatatatccagattattaatagtagtcgatgacgaccctgatcttctggtaactccctcccagcccagcagccagctagctagctataccagcctaccaatgcaaatgcaaagatctgcgtacgcgagcagcgagacgacagtacgggagttgttacgaatcacgcgacatgcatacacacacacacgcactctggccagcgctagcttacgcgtgtcctcgcgctcccaataatctactgatgataccccagcagccagcatatatatgcgcattatagtattaattaggctggggcgatcgagacgacgagatctgcagtgaggtcacccgtggtcgtcgcgcctgctccatccgaacgttgacgacgttaacgctggcttccttcttttggccctgctgcattagttaaacgtacgggatggattatatatatatatacctgtttactttattatacgttgagagtacgacccggaatggtttttgaaaactcgggcgtataggtatatgtgtgaggagtcaaagtgctgctgtgtcgtcccgtccgtcccctccagcaaatcggcatgcatg

SEQ ID NO: 1461 - DNA, 1091 bp, Zea mays
  misc_feature (1)..(100): optimal_loci_263804_G1, chr7:160616813..160617903, Cluster 9
tgtcaagacggacgggggcggcctgaaccactggcctcgcgttatctcatttaaccaacgcaaacagaaagctcgcgcggcccagctgcgttcttatcggttattgcagtaggtcacgggcggcccagaccgcgtgcgctgctctcgcagggtcttcagtcatagataacccttttcaatctgagctcccaggcaggcatgtcaaaatggccggcgtgccgtttcattttggcccaagcagagtaatacgtggcccggctaaggcccagtgacgttcggcctactatttgagaggacacgatgcgccctcgtgtttatttttttagattattccaacgatacaactttacttgatgcgattattacaggtgtgcctcaattgttcggacagcacgttccaattggtcggtcgagtagcacacatagattcgtctaacatctcgttgtcattgtcacgatagtgtatttcaactgttttcgataggagatgggagcacgcgaccagctagcccgactctcgtcaggcatggtgcgtgagcttaacgtcgtcagcaaatgtcacaggtaaatttgttgtcgtgtactagtgtattttgtgtcggaattttctgtgcagcatagcatagcaggttattggctaggcggacgagccaaataccttggatccgccgttgcacagaggccacacacaccatttgccatcagtaacaaattgcgtgcaagaacttaacactgcgcacgtacacagcggttcaacctatctaggtcctaggcgtgtcacacctgtagatgagtagatcacggctgtttcaggcatttgtttttttgggattggaaaagattcgctgctcttgtgcgtgcctcatgcacggcgtgcatggctggagaatcgctctcgtggcggccgcagcgaggctcctcactaatcaatgttatcctcaggttttgtacgtagttttgtttttgcttatctttttgcctggctttgctatgccactgttacggccacgggttttgcatgtcgtttgatccgtttgctctcgatcggttggtacgaattagcaacaacttgatgtggtcctgcagaatgc

SEQ ID NO: 1462 - DNA, 1243 bp, Zea mays
  misc_feature (1)..(100): optimal_loci_265081_G1, chr7:167619903..167621145, Cluster 9
tctctctatacagcttcttcaaggcaagccgagtctatatgagtctgagtctaagtctaaacgagtacgctaacaaacctcgatctttctttttccacccccgtcgggcttgagccacgtctggctaattttttttctccataggatcagtgtttgctccaccgcacctgttcatgtatccaatcagttggagatacacacacggtcgccggtttctgaccgccatcccctggacgcgacgcaacaataaaaataaaagtggggctttccggtgcagcctgccgacgatccctgtgacagagtaggcacagcctagggcacatgaataaagagaggcagaggcagtagccagggcaatgaatgcctcgtgttaccttggtactttaataagcgccatagatagaccaatacgtacagtgtacgtatacgcgcagttattaatgtggtgcaccaaacccgcaggccggcgcggcgcccactcgccactcgccagtgcggtgcgcgggaggagaccgaccgaccgaccgaccgatgcatccaggaaacagcagcagagtgttggtaccctgcagcacatgcgcgcgagccggccgcctgcgcttgcccaacctgtgggtcggtacggtaatctagaagcaagaaggagatgcaggtcaacgcgcaggagtaaagcccatgcgacgccaagtcaacatactagagattccactgcacaggagtagtaaggaggagtacaagccgcacttggatagctagctacacacgcctagcagtgtgatacagtatataggttttgattgctgcgagaaatctttaagttagctagcctaaatcactccctttaaattttgccatcttgatcatttcagtccattttagtcaaaatactttttcattaattttaaaactcgttgtaccaaaacaccattgtttacaaaaaaaagacactattgttagagcaagtttaataatatagcctatcatgggttttatgactttggcatgttaagtgtaatcaactaaagttctagtcatataataatgcaaactatatatttaatactcgacttatcttttttctctcatggagtcgatgactagtctactttcagcgggctattactattagtgagcaacctatttctctctccatttctcacttctcaacgacaccataaatttgatgtggtatatgttatagcccacctacgtcaacttcttaggtcctgtttggttgaggatt

SEQ ID NO: 1463 - DNA, 1349 bp, Zea mays
  misc_feature (1)..(100): optimal_loci_266066_G1, chr7:172795787..172797135, Cluster 9
tcgacacgaacggtatattatatgacagtgacattaatttgttcggatattcttcctcgaggaacgcatgtgtgatgaacttgcagtcttgagacttatatatgctcgcttgagttggcgtgggtcagtgtggctgtgtgagcgagtggcagcaatagtttaacctgaccggcggacctgtggtcactttcttggcctgtcctgggatccgtgcgcgcgttctgaactactaatccaatcgaatcgaatcgcacctcgcgtggtcccgttttgcacgaattttggtcggtactgacggttctttttctagacaagttaggcgccaattttggatggatgctgttgccaaagacccaaagtgcgtggagtggagtggagtggagtgcctatccgcgaccacatctacaacgacaccaacatcatcaactcgacacaaaaatcaggcacctaagataaatggactccatcagtacgcccgctcgtttgcgagctctacccaattgggctcagcctgtacacgcagtgggccggcatggcataaggcccagcacggtctctcctactaaaaccctctgcttcctgcaaaagcaaggcatgcttttgcagttttgccaaagatccaaaaccctttttttctcaatctgcaaatattgtacacaaatgaacatgatttcatatgcgcttgcttccaactgagcaggaaattcattcaacttcgattcatgtaagaaaaagtgggagcgaagtgggggaacaaatatagatccaaaaccccttttctcggtctgcaagtattgtacacaaatgaacatgatttcatatgcgcttgcttcgaaatgagcaggaaattcattcaaaatttcataggctggtgtgagctgccgagcatcctctgtgctatatgtttccttcagcaatggtttactgcaaccactgtggatgatagctgcccctccataaaggacccagacaaaggatacatgcgagacctccctgttctcaatacaaaaccagtcagtgttaccattgttatggacatgggcttgcattgcataccactctgttaatgcatgcatgtccatcaagcaattttggctagtgtccttgtttgttggtacatcaactaacatgtttagcaatcagaagctgtggttcatgcgggaaggttcctgatgacacggtatttagtgatgggcctaattaggataacagagggcaggttggttttgtgtcctttatttgtataatctttggagttttctgttttgtttaccaattgctcagattgatatgttttggagatatacagatccgcatggctggaaatgtttttgaaagcattgagtatg

SEQ ID NO: 1464 - DNA, 1400 bp, Zea mays
  misc_feature (1)..(100): optimal_loci_266130_G1, chr7:172965587..172966986, Cluster 9
ctcctcccgggcggcgcgcgagatgatgcgcgcgcatgtgggccgatcgatccgggcggcgcgctacctacggaaacacggtgcggtgcgtgcgcgccaccgtggagtgtgagcggtgctggtacggctccggccaacccaccacgacaagaggcgtgtacagtggccggacttgcttagctgatcctacactgcacgcatcttgcatgtacaacagcagcaggtgaatgcagctgatcgccggttattaggttgatagtatcatcttggagcggcactgcctgccagtactccacactgccgcttgtcgaagatgctccttggcggtggcaggaacgatcccgtacgtccgggtcgatcgggcacgagatcgaatcattagcgcgcgcgcgatgattcctgtgccttcgcctttggccctttgcctgctgcagcagaacgaacgatgatccagccccagcagcccccgcgaccggaatcgaatcatttgcaatcacctcatcgccgtcgccgattgaaatgcatggttgctgcattggctgcggtcggctccaatccaatccaataatcggatccttttctcttgtttgttttttcagtactccgcctatcctacctatattcattcgtcactccaccgacaccgaccagtagcgcactcctgtattgtatttgtatcaaagggctctgaattgcgtcgcccccagtacagtacaggccacaggaggatcaaagcgaatcccttcggattcgtatagaagcagtcgagcgtcgtgtcgtggaccaagcagtagactttgcatggccccgccccagcctgcattagcatgccaccgtactgctgctttagctccagagataggccagccagagtgacgccctccgtcgacggacgagctccatctccacggagacagacagtgagcgccggtacggtacgggctggctggtacgtgaaaagctgtctctcaatggctgtcgctgaatcactgtgatctctgtctgcctgcctgcgccctggtcctggagtagcttgggggagtcgggatcctcccctcttcggctcttcgccccgccatgggcgcaggcgcgcctgcttcagccccgtccctagggcctggagccctggacctctctgtgctgtgtgtgtggtccggagtccagaccagacagacagcagtaggtttcactccgtatactccagagattacacgcgcacgtacggtcgacatgcctttcaaattatttgacttcctaccttgtctaatcaatccattgcccgagcatcaatcaaatgggacggaggccgtgcatctctctctctcaccgatggaactgtgttggctccggcctccggatcgggaccgattactagggttgaatctttaaccggtgttatc

SEQ ID NO: 1465 - DNA, 1398 bp, Zea mays
  misc_feature (1)..(100): optimal_loci_266233_G1, chr7:173523501..173524898, Cluster 9
gtggagggaccgacgaatcgggagagagtgagtgaaggaaattgtagacgactagacgtacgagagatatattcgctcgaagtaaaataatagtattaaggtattgtagatctgtagactttatagatgttaggtttgaaacagcagctcacacacgctcgtcaatatctaagtccagttatctagctggtgtttgaagttaggttcctgcagctagctcactgaagagtgacgatcgagctgttcgcacgcatgcacacatatagcgccatatgcaagcgctgtggtgtcagcagactagcaaattagagaggcttagctaagacacgtgcatgctcattgcacaggtggagtttagctaagaagctacgtcgtctggagcgtggcgagcaacacgcaccaaacatctgtgtggcaactataaactgaaaaatatatgtgctttgattatagtagcaagcgctgctgaagctgaactagccaaataaagagttcatcgagcagcagtgtgccaagagagattcgcatgacaaggaaaggcaggtcaagcaagaacacgcgaattaatcccgatggttgatggagactggactggagagcgaggcatgcatgaacctatatctttctatcaatctatcttatcaacaccaccacatgcacccagcagccaaccagctgcttattcttggcaagcagtgcgttaacgttaaaggcatgcatggtatctatagcggcacaaagctaattttgcgttttcttagccttttcgacccgtgcagaagctatctgcagtctgctacatatatgagatgcgtaccacactgcagcacgtacacgggcacacggcagtagtagtgcgctcgtgtcgctgccatgcaccttattagctctgctagctagcttcctgtagtgtccagtgcctattattagtcagctagcaaagcaatataatgttgcagacgacgaatcgtcaaagctacccgtgcttggccgtaacgacagtggcacgcgcgcgcgcaccggccggccgtaccgatcgatccaacaggcaacagcgacgccgcagtaacttgggcgggcggccgtgcgcggttagtcgtcgcgccgtcgccgtcgacggcacgtgtcgccgtgcgcgcgccgccacctgtggagtggatagtccttgttgcgagccaggcatcggcgcggaaggcgatagatggatggagcggcggcgacgacggcgatcgacgacgcaggctccatcgcacacaacaagctagctagctaagctagtgctcttcttcggcactccacttgccaaaaattgacgtccatgccataccaaataccagttgccaacgctgctgtgccatgcagctccgtgacgcaacgacgatagctgctgtggctcta

SEQ ID NO: 1466 - DNA, 1168 bp, Zea mays
  misc_feature (1)..(100): optimal_loci_268912_G1, chr8:11004103..11005270, Cluster 9
gaaaatccttgatagcaaacatcaaggatcgtccaaattttttagcatcagaccgtccgaaattccctataacacgcatcatctccactgacctcgtgatgcgaacgctcgttgtgacgtgtcccactcccaccatatatcttccaaactgtttgaaataataatatggacatcagacctcttgttcgttcacaacttttcatcgtatgtaacttaaacaaaggattaccactccactacagaaaacaaataaatctgtctcggttaaacttttttatgtcggctaaaaacaaaactggcatagattagatgttttccatcggctacaaaacaactgacgtaaataattaattatttacataggtttcaaagtggcctacataaataaaattattcatgtaggtttgctaaaaactgatgtacataaggcttttacttacgtcggtcgttctagccgacatagattagtcgtaaaaacccttttctcgtaaacccgccttacttcagttcctcatcctcccccgctgctaactcacgcccctgctcatccctcccggtggctgttcctcttctcctcccatcgtctgctcccccacctggtgacgcctccttgcccgtgctcgtcgtagtagctgccccctacttgaacttgtcatagccgccgccgtcttctcgcccgcaacgtcagcacatggttcctgctctggtctgcccataaccagagagtgtctcgacaatgtatgtggttggctcacgccattgtctctcatctgtgcaggagaaggaagctgccattgtcggccaccgtgggaaggagcccactggtcacacagctctagtggtagcttatccggtcaaggtaaggtttccctatgagcaagccctcctcaagtccccagatcccttctgtccacgttactgcgacttctgctatgcataaattggttaccgcgtggcatctctcatgttccattcatgaagtcctccttcctaacgtcgtactgggtaaggtgtagtgagccaccagattaggttcagttaaatgctcttgtcatggtttgagaactagacagacttcagactgctgtaacttaccaagcgtcgaattggtggtgcaggagtagtggttttgtacaaacacaccaagttgtgtcgtacaattcttatg

SEQ ID NO: 1467 - DNA, 1231 bp, Zea mays
  misc_feature (1)..(100): optimal_loci_270127_G1, chr8:17981651..17982881, Cluster 9
aatgcagctccaccggaccggagttgggatcagacaaaggaccagacgcaacgcagcacatatgcacggcaccgcggtgcagcgactgcagacgtgaggagtggagtagcagtagcaggcaggcagcactcatcagcagatacggtacacagctagtaggacgggagatcgggaaacagagacagacacaacagccgacgggacgacggagtccgtccgtagttcccctccgtaccctacctctccgtagtaggagtatactgctactagacggcagcagcttgccgctgccaggacctgacctccgacagctgtggagcgcgccgtgcagcagtcgccaagaaattgtacgcatctcccgcccagccggcgccgtccggtcgggggcagccatccatccccacccctcgccgccgacccgcacgcacctgcccaacggccaaggcctcccgccgtccggtgcgcaccgcaaatcgcactgcactgcactgccgcgccctcggctgcacaagacagacagaccgagacgcccggccccggccggcccccaggcagtctgaccgtgacgtcctccacaccgctgcgccaccacccgcctgacgcccagtagtacttgggttgaccattcgcccccccgtaccgtactgtggggagcgtgggcccactttacgggcgcgaatacttgtgcacgtatggaaatccaaattgtttaaaatcgtgtcaatttttactaatattttatattctaggacttgttttatatcagtgtctgataatctgagcacgtatattccaaagctatacatatgctgcccgcccggccattcgatgcaggcatataactcggcgtttgggttcgcaggtgtgggaagtgggaacgcagcaacccgggtcggggtcgctcgctgtcttgggactgctgcaagctgccctacgggcggaggccccgaggggcctggactagactgcacttgcgccagagtgctcggaacgagtcaagatgtcaaaggccagaggggcaggacagacggagagtggaagggggcaaggcggcaagggccaccagcccaccaggctacggcgagagctagtacagtactcctatcgtaccgtagcctcatagggactggggaggcgatcgatcgttcttttgctggctcagatacccacgggacacggtggtacgccacgcatgaggccgtctcccacgagggcttttaagggatgttta

SEQ ID NO: 1468 - DNA, 1036 bp, Zea mays
  misc_feature (1)..(100): optimal_loci_270614_G1, chr8:20812601..20813636, Cluster 9
atatattgttatgaatacatgcgagttgcatctgattctgattggaacagccgcatcattattggatggacggtttatcatatcgtattatattcttcttcttccccgctctctgtgataggaagcgctcgcgctagcttggcagccagttgccaatatgctccaaattaataaaccaagtttattcccctcaattcttggacttactggatcgagaaagcgatacacacacacacaaaaagtacgtagtagtaaaataagaatcatgttcgttcgtgcaaaaagcaaaacaaaggaggaacaacgagagccgagtaatataactcaactagacagaagcaagctaataggtcaagctgatctggctagcttgcaaaaggctgcgacaaacacgtacgtagtgcgcagtcaaatcaatgaagggccttttattgctgctaggaatcatatgcactcttaattattttcttcaggttgcctgtatcaaaacgaactgtttgcagcccagaagcgaaagtttgtgataataacttccgtcaaaaggttagtgagtgagtgcggtcgtctcgtgaaaacctcacttgtggtagcaacaatctagtgagccacagtgttgtcttagtaggatgctaaccaacttggtgacgacgttggctgaagtaatttgacaggggcacgcacactagcagcactgtagcacatgctgacatgcatatacagatactattagatacaaccaacagaggttatcgtcaaggacatcctcaacaagtggttgacaataaaatcacatgatgaggctaggccggatgtgtgtggtgattgtgcgcttggcggcggcttctggcgagttcggcaggcagtaggcacacaaggctacaagggcattctgcgtaattgttgtgtctttctctagggctttctgtgcacagcacagatgcacttgtaaagctccaactcttttcaacaatgcatatataatttattgagaaaagtttgtttagcctaggactcatcgtttctcgtgcaaagcatc

SEQ ID NO: 1469 - DNA, 1143 bp, Zea mays
  misc_feature (1)..(100): optimal_loci_270648_G1, chr8:20954978..20956120, Cluster 9
tgcttatttatgtgcttgttaatttgtgaggtgtttctcgggtttggtatagagttagtgcttctacagtagtatctttcgagtgatgaatgagtctctactcttccctatgaacgaggctctagtgtaccctagaaaactctataatttactcgatctgattttctttgggtagattttaaattgccatctagataaggtttgtggacatgacagttatgattggcctcgatacatcttggttcagcgtacctagcttcgtccgccttcccacgtacgtacagttgaggactaggaatgctgtagcacggatcgggacacctccgggctccggccattactcgtcaagtataatatctgcatgcaaagctgctggcatgtggcaaagccgcatatatagggtggacccgtggagtatatgagtatgacagtacatgcatgcatgcatgcacgcgtgagcactgttcatcgatccatcatccatccatgggagctgagagctgactagctgagcgagaccatgacatgagagcctaaagcctcaacaagacggcaggcgagaagtcctctttgtagcctactcgctttcgctagttacactctgcatcggctcgggtagcgtcagcccggcctgttgttggtctggatggaggcaacggggccggccgtccggcctgctgcgtacgcgtgctgcctgccgttgcatgcatgcgtcgccggggaattacgcccctggctccatcgacgtgggcagccgcctaccgcagcggaagcgccggcgacgacgacgacagtcgacaggcgggggcgccgatgcgtccatgcgttactggatgcctggcccgatcggccgcgcggccctttttcttgccccatccctcctggtcttctccggcttcctctcacccactactcacctgcacctgctagctgcgcatgcacacacccgatcctctgccgctgcttggccagtagcaatcgataccttcgctgggtttctgcgccggtgggcgacggggctcgagaggcgagccgccgtggcccgccgactggccctcgtggcctcgtctacgtacgctttttttttttttgtacaaacacgctgtttaaaaccgctttaaaacttcactttaagaccgcttt

SEQ ID NO: 1470 - DNA, 1101 bp, Zea mays
  misc_feature (1)..(100): optimal_loci_282509_G1, chr8:101856221..101857321, Cluster 9
aagttaaaaaaaagcctaaatctaataactttgtcttaagctagatattgagtcagaattatattttttgtgtgggcgaagtagattggataaacttaataactttgtatgaagctagatattgagtcagaatcatatttttttgtgaacgaagtatattgtataatcttaataactctgtattaaggtagatattgagtcagaattgtatttttttgtgtgaacgaagtagattggataatttttcagcatccccccctcccctcttgtagaacgtcgccttgtcggacgtcaaatcggagagtaacgcccgacggccccgatctggtctccgtacggacatcgcgcgacgccgccggtggcgtcgctctcagtttcgcttcgccgacatcgacggcgagtgatcccgtgaaacgtgcccatcttttcacatcgttttctggctgtttcggactctaataaaacgcacgaggaaacccagctaatctatacagatgcatgcaagacaaagctaccagcgaccattgatatatatggccgttgacaacaaattaaagaccagtgaaaaaaaagctacatgtgaataaaaaataacggagtactaaaagaggcagtactatcactatgctacaaaagtgaaagcaaagaagaagaaaaaactggtgaaggacgacggccgtagaatcactgatgatgacgaatgaccatgtcgtggcaaaaaggccggtgcggtttgtttttgtcgcattcatctcgaaaggtgaatatttctttcgacgctgcggctgctctgtagtaccgacacaaaaagtagagctcggactagggactcgcctagcctggccggtgtctgcggtctccaccatctgagatccggggtctgtggtcatgactgacacattcaaacagtcacgtggctgtcacggttctagagaaaaaggagctgtaaaccaaagaatatagtggacaatgtattactcgtgcagtcgtgctagtgtccttttaagcaaccgtagtggtgcactgtttcatcgaggtgtgaggcatcaacgtgccaggttattctcatttttaccccggggttcaaataatgggttactt

SEQ ID NO: 1471 - DNA, 1352 bp, Zea mays
  misc_feature (1)..(100): optimal_loci_282821_G1, chr8:103632663..103634014, Cluster 9
ggtaattcattcaaatgaagtgggtatgttgtggctttcttgcttagcctaaaaagaactggaattccccgggcggcgaaggccctccctttcgtgcagattccacgcgatcaattcgtgggtcgtgacagcgagcagtagccagcagcggatcgatcgatctgacaacggatgggcgggcgccaccggccgcatgtgcgggtgtgtcctgccagcagcaaggcgcgccgcgggaggcagccacggccgatcgccctcaccccaccggcccacccacggccccgcgttcgcttcgctcggccgggggttaacgcggcgcggcgcggcgcttgaccacggtgcgtccatgcaccagcggtgcccatcggccatcgccatcgccgacaacgacaacgacgcgaggctcacgagagcccatttgtcatctgcgctgcagtcggtaaacgattctttttcagcgtgatttcacgctgatcagtccgccagccccgctccacgtgaaacctcttcgtcaaaggaaatccgatcccagtaccggtccaccagcacgagctgcgcctgcgcctgtcgctgtcggcgtccgggcgcgcgcggaggtgagcgctgaacgtgcgtggtgggctcctcaggccgtctcgccgccggcggtgattaggtgggggttcgtcctcgtctggtgaaaggccgtcatgctctactctcttgccaagttgccagcatccatgtagtacgtcttaatttctatggtgtccgtccggtcaccggcggcgaggcgcgacttgaacgggctttttttttttctttcatttctactgtatttgtatctcaggtcgcgtcactgttcactccacactctaggatggttttctctagtcgctcgcgggtcgattttctctgcgtgagacaacgatggtctgaccactcgcgaagccaaccatttgatctgtactctaacggggtcagacgaacaacgctatcttcggcgacgcgcgcggtgagcgcgcattcattcattcattcattcattcattcattcatgcaccgaacaaatcggtccaatcacattcgtatgtattgagtggactaggacggtagaaagggacacctgaactcaatttcccccgctaataagggccatgtcatctttgcacacgctgacatcctagtaatatattattagtactacatgtacttatgttcctacctaatgttgtatataatgtatatatttatagagctacacactatctatttgtatgtttataccacgtgcccgtcttagttttgacaaatccatctagtagtttaagccactcagtatgtatcaacctactcagcactcttgtcctatt

SEQ ID NO: 1472 - DNA, 1195 bp, Zea mays
  misc_feature (1)..(100): optimal_loci_284217_G1, chr8:110800625..110801819, Cluster 9
cattggcagattcagaaatagatcaaaggaggggctgagaggatggagatagccgcaatacaaatgaatagagccaacatagagagtatgcacgaattagaaacacgtgtaggttgttgcatgccgtgtgcatgggtaatgacctattatatgcctgcatcttgtaatggtggatcttctttctatgactgctaaaatcactatagagcactaagaacatctccaataatgtcttaaatcagtgccctatttttttcaaaaatagggctcaataagtcataaaacagctccaacgatgtcctattttatatttttttatcaataaaatataagagataccatgaagtgaactaaatatactacactccggattagtgtcatattcttattttatagatcatcctcaacaatttattttctaaactacatgattcaaggtataactgttggagctcaatttgtttggaccaaaggtgcagcatcaacccgaggctgctggagatagtctaacgtgaccatgcttctctacacctgtttctaaaggaacggcgggtcgttgttgctgtggatcgtcttcaccacgaccacaccgccgctggaccaatgagatcgaggcctcatatcgtaccgatcgagcttatggcggaggagacgccagccactgctacctcatatattatcctcctccacgatctccgggccctttgggttctgaacctcatgctcctcgctcgatcggatcctcatcctcaacttgctgctcgatcttcaggcttctcagtccccatcgttagaagaggtagctctctcaaggcacatcttcaggctgaaactcgcagcggttgcagtcatatggtacggtgttcctattcgtggccagcagcactgctgttgtcgtgttcgtcctcctcttcgccgtacgtccctcgcatccctcccccccaccccccaccccggtttcgtatctttccgcttccatctcccaatgaaacgcgggcgatagatgcggtagcggcgagcagccacatgagtggctacgaagaagagcagggcgtatccgcgtatgtgaagtaacgtggatggatgagaggcagataaaatgaagagggtgaagctgtgagaatggagcagacggagaaaacagaagccactagaggtggcgttccacgctacactacggaaagcagccgattac

SEQ ID NO: 1473 - DNA, 1060 bp, Zea mays
  misc_feature (1)..(100): optimal_loci_284287_G1, chr8:111176773..111177832, Cluster 9
aacactgcaccaacaggcaggccccatcggccagtgaccgtgcgtgctcactcacccacgcggtggccgacaggtggttcccctcatcagtcgtcttctaccccagatcaaactcaggcaatttggctgttgcaattgccaccgggattctcggaattcacaatctagccaggcaccatctggcttatccttcatctagcttgactcgaggatatctatcgagtcccacttggagtcctcgggccccacactccagatgcgtccccgtgctcatgttgttgcttcgcatctcacacgattgcaaccaccgccggtcgtctccatctcacccccgcccctatataaatgtctgtgcacatgtacctttgaccagaaactcgtcgcctcacagtcgcacgccccaaagcgccttacatgcatcgagattgaccaccgctgccgtgagagaggggggagtgcgagccaccattgtcgccatacgttcgcaacatccttcagagtccgagatcaggccagggcgcttcgccattcgacacgcaaggcgtccatgtcctatccaggcgggattattggtcggtgtggcggtaactgctcaccagagcaaccccatcactatgaagccgcacggagtcgatgtcggggcttgcgcggttcatttgtcggtaagacatcgcccaacatgtctatctcgctctcctctttgcgtaggaacttatagcgtatgggttagagctctggattggtcgggcgccttgctctagcgagtatcgtcgcagcggctatgctgctctgagcactggccttcaaaagggaggagatcgatctatgaccgtcgacttcttgatgggtggctagggttagtgcttacgcatattggttcggatttggtatcgtagtcgttcgattcatatctttcggatgagaagcgatctcagggctttaaattggggatgtcgattgctgacccgaggggcgagggccagcaatgcgtatcctttcactattttaatctagaccttagatcctgaaacggatagctccaagccgatcacatgttgct

SEQ ID NO: 1474 - DNA, 1001 bp, Zea mays
  misc_feature (1)..(100): optimal_loci_285467_G1, chr8:117591942..117592942, Cluster 9
ttagattagcgcgcacgtggaacataactgtagctagtcaatagtcatagatgcatcgatatgcgaccggcggtcagaccgcgagactggttagttcatcagcacgcacagtcacagctcacggccagtcgtggacgtaactgaacgtttcctcccctgttagacgtcgtttctaggagctgttaacttctgatggacgtcgctgaacgacatgtagtactgcagcagcacatgaagccaagcctgctgctggcgacatcagtgtttaattaaggagcacgcgctacagacgtacggttatctcgtcgtcggcgagatggcacaagttcagtgtatctatctgggaccgggagcctgatcgagtgagtggcaggcagtctggcagaccgatagcctccacagggcttgcttgaggtgtcgtgtcgtctcagctgcagtctccgcagcatgcaccggctcacggagcgacaccgcggcccatggctaggcctaggctagccgccgtcggtatgtcacgatcacgatcgagagcagctagcagccctgacagtacgtctctattcgccatgtgatccaatgtttttgttgcacatgtgttctgtcatgttcttttttttttactattttgtaatactagctaggaatgagatactaacgtttggcttaacagtgtttggcttctgcatttttctttaacctgcaatttgcctgatattattacactacctaactgaaaatatatatatggcagatgctagcagaaagaagctccggtctgtctgtggaaagagagacagccgggacacaccacaggtccacagtccactactctaataataatataatcccacgtctaggttcatcaaacccgggggctgggatacgtatgtgtgcgagggggctgggatcgaattattagagcgatcctgttcagcttcacttcacatcgcaagtaatgtaatataccaccaacgagtactacatcatactattactacgca

SEQ ID NO: 1475 - DNA, 1106 bp, Zea mays
  misc_feature (1)..(100): optimal_loci_285689_G1, chr8:118806509..118807614, Cluster 9
gagccatgaatgacccctccctatacggctataccctctctacgtggccttgttggctggctccgacgacctgcgggcaaggtcgcgctgcaccgttgggacgagacggcgacaggcgtacaacgtatttctgccgagtcggagcaccagtaccacgcgatgcgttatgcgtatgccaggtgtggtgtggttgtcgtagtgctcttttatatattatctcagctatatatagccgccgtgcttatagccttatactatatataatataagttatataacaggttgttggaggagtagctagtaggagcgcaggagggagctagagcgcgcggtgcgtatgctcagctcagctcacccgctagctccggcgtagaggatggcgaggtgcgcgaggtggagaagcagggcacgtgtgaattcattcgttccatcgacggtctggcgccgactcacgcatcgccggcgcggcgagctgagcgcgtgacacggaaagcaggtccgccgcgccggcgcccgcgctggccgatcgaccggctaactgtagctccacgaagcaaagccaggccagccggccgatcgatgcgtgcgtgcatgtgcccttcttctccatcgggcacgcctcgcctgcgcatcttttgtgaccggtgcatgcaaataagcaaaaagacggtaggtttgtcggctggtttggtggagagaaatggggccaggttcttaattgcaagcggctgctgcaaggcaagcatgtgcatgtgtgagtagtcttatgttttgctccgtcaccatgcaatgcatgggttctcttttcctaataataaccattctcggttttcatgattccgagcaaaaaagatttgtggcctgctccactgcaacattattcatctgcgcaacttttttgggtctaacattctttacccttttgtctatatattatatagctagttatgcaggtttgatgctcttctaggctagtctctactacttcttaagaccttagtgtaaatgttcataagcacggttctgccaaaccgcttgcctccaccccgcgacaccccagcacccaaaccacgcccgctccccgcgatggccgctcatcccgccgc

SEQ ID NO: 1476 - DNA, 1041 bp, Zea mays
  misc_feature (1)..(100): optimal_loci_290498_G1, chr8:145292452..145293492, Cluster 9
gcctataaacaggacaaaaacaaattcatgagcttgatcgtttttttttggacaaaaaacaggcgcttgatcttgccaaagcctgaaagcaacaagcaaatgagcgtctgtatacgcacactgctgaagctggacattcgctggagtccggacgtggtttcctagtcaaatcgatgtagtgtagcataatgggcctcgcagagcacgaaggcccaaagcgccccacactgcagcgtggttctgtactggcccacgcgccgttgcggacgcgcctgactgccgctctgcctcctcgaaggctccaactgcgaacggaagcctgcgcttccatgccacccagccgttcagggtcgactgataggccttctgcccgcctggcatggccgcggattttccttgatacgtaacggtgccaaaccacgaaagtgatggacggttgtcactgtcaaacacgcgagctctctggaggcggagacccagcgttacgggcggcagaggaaaagtcagagcccgttatccatgtccagcgtcctaggggtacatctgatcatgcaaggcagcaacagcaagcgtagataggccggcggaagtggttactggttaggtcatgagctggttattatttcgtgcaacgaacgccggtgggcgctgaaacgtgtagccgtaggtaagcagagcacgacggcacccacagtggactagatagcacacttttgatagcaacatctatatcatctacgtaacatacttcagtgaattcttgcaataagcatatctatattgatatcttattgctgtttttaatatttacatacactctctgtatcatctcggtttcttcgtatcggctctcataaataacaacactctctctgttgatttaatttcttgccacataagataaatgctgatatgaactttttttatagagagctgacttagtaacattgtggctctcctgagcatgtcgacaacaattcctcgtcacggcgactacgaggaggcgacaattcaacgacttgtgaggcgatgatgtctccc

SEQ ID NO: 1477 - DNA, 1105 bp, Zea mays
  misc_feature (1)..(100): optimal_loci_292438_G1, chr8:155045342..155046446, Cluster 9
gttgacggtaaacaaagcatcgtagtgagcgaatgaagcgctggcactgatccctggtggcggcagcgacatctgcgaacgagtgcacagacacaaacagctgggtgcacgcaagttgagccaccctgcggacatttgaggtcgccgagacaggtcatgtgacgacagtgtggatggacgcatggatcgatccgagagcctggggagtggggaacgcccagtccaggcgttacctgggctgccgcacgcgctgcagcctgcaggcctgggctttgcgtgtgtctctcgcgctctcgccatgtgcggtgcgctttcagtatccggcgtgtttgccgtgtgggagggagtcgcaccgtcagacttgttctctccatccccatctcagaagacagactcctccatcgtccatccgcatctcagaagacagcagacttctccatcgttgtgaagccaataatgcgagggggttgcccttgccgcccgcctgctgggctgggccagagagagagttttcgcgcgacgcgacgacatcgccgccgacatgcattgagttgttcggtatcagatgggcaggggcaacagttttgctttttgtttatctcttgtcgtcagtcctcgcctcctcctgcctcctcttcgtaacgacaggcagcagacccagaccgatgcaggcgcatgcacagtcgtcacctgcctgccaacgctgggcgtacaggtgggaagtgggaactgcgatcagcagttcagcaccaaggaggaactggagaggtgcggattgttatctctcttctgatcttctccacggtcaggacgaagaacacacgagtcgtgagctgtgacctgaccctaatctaagcatgcatgcatgctactctactcacactggccgctgctttcagccatcaggtagcagcgagcatccaatccaatgactctaaacccatcgggcgtcttggcctgattgattggaatggaacgggacgggaggagggggagtcgtctgcgtccatctcatcactccagtgaggagttctcagccacgcaagttcgtccgtcatctgtcatgcatgcccatcatcatatcgaccggtgcaggacgtggctc

SEQ ID NO: 1478 - DNA, 1381 bp, Zea mays
  misc_feature (1)..(100): optimal_loci_293943_G1, chr8:162543458..162544838, Cluster 9
gtattgtggcgggggtgctggtggccggtggcgatgccgatggcgacggcgattagcgattagcgattagcgagcggtggttagatcttgaccgggcgtacgtgcgtgtgagaggggagcgggagccaggcaggcagcactgcggattagattgcgatcgcgagagcgagcgaggccgagcacgagcagcgattagtattagcccaagacccaagacccgcatgcgtgcgcggggatgggatcggtggttagcgagggcaatcattgacacgggattagattagattagattagattagattagatgtccgggtcccggccggccaaggccaagacggtcagagaggaaaggcgctccggtgattccgtccgttacgcggcctgcggcattcagcgcaggtccggacctcctctacagcagcagtagtagtaattcctaccattatattggcagcgctaaactatactccatggcccatggccgtgccgtgctggatcatattgtcgagttcgtgcgcagcgcggggtactgtactgccgccaggcgccacgccacgccacgcatcagccggcaatccgtcaggtcagaactcagaaatcgggaagcagcgggcgtgggcttgcgtgccagcgtacagatagtgtcacagtacagtacagtacagtacagtacagtactacgggtgtctgtccggagtgttcgtgcccctgactgtagcagtagcagccggctccttttgctaccagtcccccaaacaaacatttcacgctgcgtcgatcaaagtcacaggctcacagctgatgtgatgtaccccctgtatatacttttgcagatgccgcatacatccccatccataggccgtagcaacgttgtgattgttctctgaaactcctccggaaatccacaccccgccctgactagtagtagtagtaaaataaactagccacagacagacagacctttgatgttttttttaatgtgggcatgtctttgttttttctccccgcaattagtgctggtgttgctgatgcgattgcaatgggtgtgggtggggtgtgttcgtcagcgacattccgtttccgagggaaaggaaatgatcggtcgatgtgtgggcctctctgtacaagaacaggtcgcgtcaaaaaacagtgcggcaggcggcagctggactggccctggccggatggatcggtgaggggggccgccgcccgccgggcgacgtgatctgatctgtggtgacaatttctgaggaattcggcagcggagggcgcgcgcagggatcgacctgctgcacctgctggctgcgtgaatgatgcgcccacacgcgcgttctgctgcgtcgggcgcttggcttgttcaacgcctccaatgatttttctt

SEQ ID NO: 1479 - DNA, 1086 bp, Zea mays
  misc_feature (1)..(100): optimal_loci_293950_G1, chr8:162551507..162552592, Cluster 9
aagtgcacctgatccgaggttcacggtctaactgcaatccgccatgcaaatctttactgttactgttagagcttatgagtaaataaattgcagtactaccggtagtagtacgtaatgacgcggtacggagaggactggcgacactggatcaacgcgtcgtatctaaaacttttgtgccgggtgtcgggagatgggacgttagggtttacgagcggtggtggcggtgataaaccatagcagggggcgggctaggcttacaaagcgcgcggcacggcacggcggcgccgatgctttgctgcgggagagcttttgtacgtgacctgggctctgagtctactaaaaggcagtgacagtgagtgaaaaaaaagggcagtagatagattagtgtaagacctggaaagagagggtaaagaaagccggttggttagtgcgccgcgtgtgcagcaggacgactcgctgctccaattggccttggcttgctggttgcggccgctttccatccatccacggtgcaggtgcaggtgcagcgcagagagatacgtagagagagagagatgtctgctgttctctcttcttcctctcctgtactgtacgtttatggatttttttatgatacataaattaatacacacaggccttttgcgaagggggaattcccgttcgtactcgcagccgtattctgtgctctgctcaccggcaagcggagcagaggcatgtggctgtcagcgccgatcccgaggtggcgattagaataagatgcggggacaccgtgccgtactcgtatctgtctgtaaactagtagtgttccaccgtcaccgtgccctgccctcctctgtgttgatgaaaattggagcagatcagcagagggacggacgacgctcgaggctttgctctgctcaccgccccccaccaggcaccagctcgtaccgcctgtccgctgtcccatcctgtcagcgccaccgccacccgcaaggaacgggtcggagcgatcgcgtccgcgatttcattggatccgtttcgtttcgcctcgtcgcctcggacggcgggattaaaaaaatgccacctcttttttagttgactagctag

SEQ ID NO: 1480 - DNA, 1021 bp, Zea mays
  misc_feature (1)..(100): optimal_loci_294304_G1, chr8:164635623..164636643, Cluster 9
gtcgtgcccaaaccaaccggccggccgtacgtagggcggcatcactccgatccatcactgctcgctcgctctctagccactcgccccccttcgtccctccctccctccctcctcgtccggcccgtcgtcattcattcgctcggggtgtcgcggcaggtccaggtcacgtaccggcgtgcctgcctgcctgctggccggtgagctcgctagcgagcgaggtgcatgaacgaaccgtacgagtacggctgaacgacgcgaagatgccgacgcctcattccgcgcgcgccggtggatgggcgcgttaaatacgcgggggatggagcagatagttgcagagagagagagagcagcacagcgatagcatagcgtgcgttgcgtactatagggactggttgcaggctgactggaagtgacaagtctttggaatttcggagcagcgcagcatgcgagcgaggccgaatgaatgaatggaccaaggacaaggaatgaatgcatgtgtctgtgtctgtgtctgtgtcatttgttggcaagggcgcgcgtgccacactgcctgctgcagcgaccagtaaatgcgagggcgaggcgaggcgagcgcgcctcggagtgcacgttgacactccagcagagaccgccacactccctctcctgtagctgactagctgtagtcctgtcgttggaggttggagccgcagcgagcgtggagggtgtgagagggttgactacttgacttgacccctcttcgtcttaagacgtgggcgtatgcatgcaacagcacaagccagcggtgtgtgctcatatatatatactggcactggcataggactgagctccacgatttgcaaccgaggaccgacgatctagccgaaaaataccatatcagggtcatgcatggtcgtcatccagattaacttcaacgagatttgttgccatccagtaccggaaataggaaaaattcctgtaatccaccgaatcccgctcggaattttaaacctttcatgcctccacatttttttttcattgg

SEQ ID NO: 1481 - DNA, 1357 bp, Zea mays
  misc_feature (1)..(100): optimal_loci_294497_G1, chr8:165626838..165628194, Cluster 9
cgcatgaacctctctaatcacactgacggagaaggacgattcgatcgcctgcagcaggcgagccaatgattggtcgccgcaataattgtccgtaccggcagctgcagcggtatctggtgctgttccggcaggcgccagatcggcgagtttttttttcttgttttcttccccgcgcagtcagctgccgcggctcgctggcgatgatggcccgtacaaaattacccgacgggcgacgcgatattccattttgcaccacgcgattggcgcagcgcacccgcacgcatcgagatcgtccgtttcagaaaattataaccgggctcgggcccaccgtgggcgtacggtccgtatggacagcagatccaccggcggacgcggaccagtcaaaagaacccatgccctcggcctccttggattcttcttccgagcacgcccgtgtgactgaggaggtcgccactcgccactcgccaggtagcacgcagaaggccgaggcagctgctgtcgctggtcgcggatggcccatctggccatctcgtcgcagatgagatgccaccactacaccagtgcggcagtgcccccacgtactcgtgtactcgatgcagtacagtaacgctgcttcggatctgggcaacagtggagtggcacgtagacatgcatggcgtgggggtagtggggaccttcctaaacgactccgatattctgctcagcgcgaaatggcagaactctttagtactgttctttttcttcaccttcgaaaaagacaaggcacaaggaggggagggggcaaggagggccaagcaggactgctgctgcttgcggttagggggtcacttcgcacgccacttgactggaccatgtcccggacgagcaaatgctcgcaccaaaccctaagggattagtgccactcactcacactcgtaccggaaaggggctaaccaatagcagcgagcggcagcaaaaaaaaaaaggaggaaatccaacagtgcagagtggttgagcgaaacatgaaaggcgggctggtgtttgaccttgttccgccgcgtccacgtcaggtctctcgcgctacttgattttgactcgccaacctataagcttttagttagaaaagcgccgaggtgaaatttcttcttggggtcgcatttcagtgcaacgataccaacacgccacaccttcctttttttaataatggaataaaatccgggtttcgcctcgaaaagcgccaaagttacacatcatataacaacttcaactactacgtaagaaggcaaaaactgttagcctaaaagaattaaactctcccttattcctcaccgatgcaacactctcttaaaaaaagaagaatgatcaatacaacgcaatc

SEQ ID NO: 1482 - DNA, 1031 bp, Zea mays
  misc_feature (1)..(100): optimal_loci_2952_G1, chr1:15140557..15141587, Cluster 9
ccggggaccatatcacaattcatagggctcttcagacctctgggtctctcccggcctcctagcgttgttcatgacatgggaccatgtcctaggccctctggaccttcgtagctcttgaggctaggaacaagctccatgtttggccaaggttggggcatcctatatgctaaggcttaaactagacctactagatacccttcaatatgcccctagggcaaaacggtcccagaagtagaagccttagagcataatggatcaggtggtatagccctaatgctatgtgtgcccccactcgagacgaccacgtggcacaagacgattaagataaggctcccatccatcagattaaatgtgatggatgacaatgtggtcaagaaggcacattgtttccacgatagatgcaataagtgtacccgccatcactgtgtgatacatgctattgtccttgtagccatgcctaaacatgttggcgtacctggaagtattataaggtagaggcggctacactatttaccaactacaccatacctaacggtgtgtgctttagtagctaccactataacaatacaggtcaacattgtagcacgttcaaagcatgcatcgtgtacgactccatgtttgagagaagacaggaatagttaagcttgtgttggacagggccaacaatccaactgtcatgtaactcactcctcacttgagctataaaataggagggtagagcaacatagaaagggcttgagacacaaacctcaaaccttgtggctagatatctcaagagacgaacccaaattccatagaggaaggatagtcagttaactacagaccaattggtgtagaactcttaacaaaacaaaagaacagtgagagctactcattcatctggctcaattgatatctaagcatttaatcttcttcatctttgtatttatgactcaaccacacacaaagaggacataggtattacacatttactgctcgaatctatataaatctctcgtatgctagtagcgtaaggttgtctccagcgttcc

SEQ ID NO: 1483 - DNA, 1045 bp, Zea mays
  misc_feature (1)..(100): optimal_loci_296259_G1, chr8:173826201..173827245, Cluster 9
gattacggataggaaaatgttcaaggtagatgagcattgtctgtctctggttgaaggcaaactaatggactgtactttgttaataatgtccacgaaatcaaagcaagttcatcgcaagcgtgacggcttcttggttactgctcatggtatgatactatgattgctcttgacgagcggatatttcggggttgtaaccagagattgagcagcaccatgccaccagccacccatgcgacactgtggcttgtgcattcgtttaaagactcgagcaaagatggttgtccgggtggaccacctgaagactgcaaaactggccggggtaaattaaaaaaaagtggagtttaccagcaaaagcaacaacagcgcgagactgcagaaatgcaggagcaatcaagggttttgggctggtccacacgacacttgatctgaaaaagagttgtgggggcatgaatgatccagtaggttgctcgcaaaaagatgattagggctcccagtactgtcctatcgtcaactaactgtagctaaccgtggacaaaatccatacaagatcgcgcgcgcagccgctacggctagtaggaggggcgccgtgcaccgggcaacagcacatctgcatgcattgcacgcatcgccttggcccttttcttcttctttttttctccgtccgtgtcctgggctcctgggacgcctacgccttttggcagcctcgtcggccaccagagcttgccgccagcatgcgtccaccgtgcactgtggtctctggtctcctctccctcacgctcgtcggcgtcgcatgactggggggaaaagcgagagcgaaacagagacgagcagagaggtgcagtgcaatgcaaagtgggacagagcacggccggggccgaccggcacggcggcacctactttgcccgtcgcgtgcggtcctaacagctataggtacggcggctacctatagctgctagggtgctcccgtgccgggcaaagtagggtgctgtcgtgccggtcctgagctataggtacgacagcagcagtacatcactctactttgttc

SEQ ID NO: 1484 - DNA, 1177 bp, Zea mays
  misc_feature (1)..(100): optimal_loci_297811_G1, chr9:4527625..4528801, Cluster 9
gtacatgcgctaaatctaaaatggtctatattagggaacaatatcaatagattgaagccagtgggttggatagagcatctttcagattgttcgacctttggaaaaaaagtaatgtaaatctaagatttatgatgaaacatatatttactagtagatctaggtattatagatagaatagatctatcagtagatctaagtattatagatctagagaattgtttagatcaggttttaaataacatagatctagagaattgtttagatcaggttttaaataaccggctatagttttcgctatagcgagcaggaaaaagctatgcactattgattcatttagccgctatagcccgctatatcctgatatagtcggttatttacatttttgagaatcacgccgctaaaccccttaacccgctattaaatccatggtttagatatacaacagctagcttcacatttacccctctcctttgttcgcacgtcttcttcgtccggagtccgaagaaaaaccggcgaggaattccatgacagaccttcttcgtgttcttcagccacctcgcacatgcagcggaccccggccccctccataggacccgcttcgaccacaccccatgcacccctcgcccctgctgcggagcagcgccgccgcgccggctggctggcaagccctagccgggcaccccaccccagtccacgctgtcacgtccatccggcttggttcgagagcaggccgccgtcgcgcctgcaggaggctgccgcggcctcccgtggtgccagcccctgtcgctggcccgtgggggcacaggtgcgccatgcgctgcagccagccaacggcagcctcatcagccggtcgtccttctccccacggccgagggcctttgctgagcttaatcagacatgatggcaccaatgtgaggttacttggatcacgaggcttcgaccaaattatgaggatttacgtttgttggctgttacaattggacagaacttatgattagctctattccttagacgcaaatcaattcaagcttgagtatagccttgggcatcctatgttttttgatggtacaaagacctacaggacgtacaggtatattaaaacgaccgaaagttttaaaaagccagcgagaatatacaaatgaaaaaaagggagaatcattttcagagttctgttctc

SEQ ID NO: 1485 - DNA, 1075 bp, Zea mays
  misc_feature (1)..(100): optimal_loci_299655_G1, chr9:11554674..11555748, Cluster 9
gatttgatatagcgtcttgtaagacttgatgaaacacgtggtagttgatgtaattcacatcggtaagtagacgtgtagcatgacgtagtgcgcgaatacataacaccgcctccacacaacagttcacacattcgggatgacactcgtgtaactgtgattttagagtgatcgagacgaactgcatgtgcggcaatatagcgtattagactatctcgttctctattataccttctactttaaattttaaaatacaaacagtgctatgtcagtattttatatgattatatacatgatatgctcgacataaccttacatggtgacgattaaattaatatatatataaatactgctaattttttttagcagattggactcgaagagtgtcctccgttgcgtctgcgggtttgctccatcgttttagttaatccagcaaaaaatacggaaaaaaacacgttttagttattccatcatcatctgcggccagatcgacataaccttacatccacgtattccgtccatggaaagagatcgaacgtcgccgtcgcgcgagccgtcccgggccggccgtgacgacactaccaaaggttctcggagtcggaggtgatggcggaaccgtgaggaactgttgcgcgtgacctacacagtgggacgggtcatcgtcgtacgaggtagcaagccggccggtgcaaccggtgagcgaatcatagcgcagcgccagaggccagagcaaagcaatcccgcccgtgtgcagcgacaaaacggcgccgtgcgtggcgtgcccagatctgtcgccgagccacctgtcgaccgggccgggcggatcgcgcgcgcgcggcgctttctagtacatccgctttggagttggatgcttttctttggtcgctctcgcctttcgtccggccgggctcagggttttattttactagcgacagtgtacgtcgtgacgagatactgacgtgcacacgtcctcatcatagtttattactacgtatcgttcaggaggtagtacaggccggggggaggggacctgtcacgtgggttggtggttctgccgaaagcatctcgcctctcgtat

SEQ ID NO: 1486 - DNA, 1056 bp, Zea mays
  misc_feature (1)..(100): optimal_loci_301176_G1, chr9:20326706..20327761, Cluster 9
tatagctagctgatcgaggaactaataacgcatcgatcgatcgctcaccatgtgtctgatctgagtggctagctcctccgatccgatccgatccaatcattcgagctagagcctctaccatgaatagtggtggacagtgaccaatgcaaatcctaacctagctatagctaccaccaaaaagcacacgacaagaccaccagccggccgggttattgcaggctttttacgagctctgccgcgttgcgttgcgttgcgttgcgtccatccattccatcacacacacaagcgcgcgccgccgtcggttcacctcgtccgtccgtagtggccggcggggagatgatcgagctagcgcaccgcgtaccgccggcacagaaagctcgagtcgttgtttcacccggccatttcatatatcctgctctggagctagctgtagcaacggggaagtgtgggcatgcatgatcgatgtctcgtggttgacctgctgcccgtcagttcagggaaggagcgagcttgctagctagctaggtaggcagagatggtgaaaaggaagcaacaagggcctgcattcaccacgagtggtggtgcaccgtgcagcatgtggtcgtcctgcattcgtgtccgagtgatttacagagctccaaactccaagctagcattgtgtttgtcgctgcatcaacttcgtcgtcggtataacctgattggtaaccatcctggggcctagagtccgccataaacacgaagtaatcatctaagacatacaagcagtgttctgagtcagagtcaaaacccgagtcagatcagggttcgagtcgatggtgggcgaagcccgagtttgagttagtagtgcggtgaatttgggtcatcctgactttgtcatggtgtatatcggatcatcgaaagcttgtccgacggacacagggaccgtcaaacaatccatggcaaacccgaaattctcgaatgaatccaacatgaatctgagagttccaaagaatattttgtccccttgcgtgaaacccatatatggttgctatcagatctctgatgattagggtgact

SEQ ID NO: 1487 - DNA, 1126 bp, Zea mays
  misc_feature (1)..(100): optimal_loci_301834_G1, chr9:23959203..23960328, Cluster 9
tgggtgggcgcttggccgtctctagcactgggtcaccggaaatgatggaaagaacgagacagatctctgcccggttctgttgattctgattccacgaggaatctgggtcacacgatcggattgtgccgtgctctttgtccgcgccctgtttcgccacacacgcgacgccaacggccgtggccctggccctggcccctgcccgcctgctggacccgctgccgggcgggcggcctggcctccgtcagtcacgcactcacgcgtcatcagcggtgtgctgcatccgggcgtctgcgtcggctgtgctgctgtccgtgtcgtcggaaagcaagccctggacctgtccgcccgtctctctacacgtaggcgtagcgctgtcgccgatggaatggaatatggattggaatggaagaaggtttactgctttctctccatgtgaataatagtggtgaacgaacgtgggcaggaatacccgcctgccgtcgtccactggcactggcactggcactggcactggcacgccaactaggcacctttactttttccctctctctctctgtatctatctctttgcaaaagctaactggcgagagcaaacaaacaaacaaaaagaatctagtcgcgtgccgtacttggctagttggcttcgccaaacaatggcttcaaacagacgattttgccgagctactacaaaaggaggagagaaaaaaacacacggcacaggtgatggcccatcactagacgtatgtacaccgcatgggcctccatctaactcatggtccatcaccagattttgcccagcccacgatccaggccgtcgaactcggggttctgggcctcttgtcttgtgccggcacatccgtcacggaagaaagagcagctgccgggatggagcctgaccgaaggccccaagcaggcagtcgcctccggctctggttgccgccgaccgccgggcgctggtccagcggccataggccacagctacgcaggcgcacgagggaggctgcacggatttggtccagtccaatcagctctcaggcgcagcggcagcggggctgcccacggcagcggtatgatggccgtgcgcctgctgccgtgttaggcgtgtcaagttgagctctcagaaaac

SEQ ID NO: 1488 - DNA, 1038 bp, Zea mays
  misc_feature (1)..(100): optimal_loci_302142_G1, chr9:26801296..26802333, Cluster 9
aacaacacctcgaattattagacggctagcgctagctatagctgcgtactacgtcgtctatatatcagatatataatcctaggccacatgattgcgtatggtgagtgacctcgacgcatgcacacacacacactatatagctgcccttttcttcttctttttggtaacgccgtcgttagcttttgttgccgttgcagccgccaccagtagcaccaccgcccaggacgacaagggacgatgtgaggctcattgtatgtgcacgttactcgctcctagccagcagctagcccccctcgacgatcagcttcctaataacaatgtgtacacgttattaatgaattcgatcttgttgtttcatgggcaaggagctaggtagctagacaactctctgtcgatcgatcgattcatctatcgaggcacacacatcatcttccacacactgctatcagagttagttggcttgtttgctcagctgcaacaaacgacgtctccttttcttttcttttttttaaagaagaatcacacatacgttgcaacaaactagggtttcgatcgacgtcgcgcaggtccctgctacgtacgttgttgttgcttcgtccgcgcgcgcgtggatacatcctcgatctcccctccgatccgctagctagctgaataatccttttcctcctggacgtgtgaccgaccagccgggcgcgcggagccatggatagcgcacacacacacacgcagcacctttccgacatggaaaggcagcggcgatggagaaacggagagacgatgttacatacctgtctccaataatccaatgcaaagaaagttccaaaattaatcctctggctaagctatctagaggccggcaaacggtatctctcaaagaaaaagaaaaagaaaaccaaaggatatgaaaacgtctctagcttgttagtttctccgatcctctttgatcttgtctctacatgttggcgtctacctttaatgccatttgcttaccccggccccttttctgattatttgtgcattcatccttcaatcaattta

SEQ ID NO: 1489 - DNA, 1331 bp, Zea mays
  misc_feature (1)..(100): optimal_loci_31025_G1, chr1:190534119..190535449, Cluster 9
ccactgaacgtgactgaagagagcaatgcagagatgattcgccttcacccactgcttgatccatcgtatcgtatcgtatcggtgactggtggagcgagcaggaggtgcttgtcaccgtcagataacaagctttgctgcatcgatgatcatgacacaagtgtctcagctaattgagctgtcacacgcacgacatttgtataaatgcattgagcacatgtaggtcttgtttggatactctaacattcacgccaatctagatgtgttaaggtatattaggttatagattagtttaatttaaaaaccaatccacataaatacatgtgcattggggtgtgagtatccaaacaaagccgtaattgagaattaaatccatcgtcgccgttgcaaattggaactcgcatacgcatgtgcatctcgatctgaatgttcatcactgatgggcataccgtacgcatggatgggtcagatgcatccacaagctaagcgaagaagcagctgcatgattggaactctgcatgctgttctgaaactacgactcttgagcggacaagcacatgctgttgcgttggagggagggagacgagtatgcctgctgcaacaccttgataacgccaggaaaaaattcaaaccgaacaccaaacaacagttgtaaaccctcgtcgttgcaaagactttgaacacgtcgtctgctttgaagcgaagtcgtctttagcgactcgccagagctaactttgccgaggagaactcggtcggcatcttccttttcagatagaactcgcgtgcggtgcagctgctcccggccgtcattctcattttgactagacgaagaagcagtacaatacatactatactctatacacatatgccagcagtcgtcatccacaggtgttcctagctctcctgtcacgtgctagctactctccacagatgtttctgctatagacagcactaattaataatgtggtcgcgtagaggttaagggcttgcttttgcagccttaattcggttcgggtctcgcgcctaacagttgttaagctctctgctgtgctggccaggccctctagttgacctgttccatcagctagacagcggctccactccttttttttcctcgcctcaaaaccttagccagcagcgaaaccaaaagaaaatgagagaaaaaagggtggagccgacggtggttgttggagcgtcacagatgttgcaaaggacaactgatgctgcaagccgtctccattccatgcatgattatccaatgattcagcaaaagaaaaaaagaaatcattccataggcactaaaaccaggacaggttaccacaaaagcatattca

SEQ ID NO: 1490 - DNA, 1196 bp, Zea mays
  misc_feature (1)..(100): optimal_loci_313012_G1, chr9:96087705..96088900, Cluster 9
catccatccaattggcaagaaggatgcattgcatgtatagagaacatgccagtaaccatgcatgtagctagctttgggagcacaaaggccgcgcgggcgggcggacgacgcggttgggaggccaaaggctgggccttttttgctgtaccctttgtccgttgcgcttggattggatgctcgccggtacgtgccgtttgcaaggctgatgagagatgccggaggggaaaaaggttactatttgttaggtaaaggagagcatgcacgacgcatgcatggtgttggacgacgacgattcgatccatggccaccatccgtatccagtgttatgttatgtgtggtcttttggcttactggcacttgccctgaacttttgcctttaacctcacatgcatatgcatggtttgttggcatgaagcttccgtcaggactcaggagtcaggaccatggctgctgtagtggtggtgtgtgtgttttactggggcagagatggatggcccaggcccagcggataggccacacatcagccatgcaggtacgtagtagctaggtgaaaacaggacgacgtgtgtcggtgtgtacgtacgcggtacgccatgcatggcctccacgtacgtataccaggggcagacggtgccgcgtgcacggaaggaccggcacgtacgtacgccatggccgcctccgtacgtgtcgtcacgtactgaaggtagcgagcgattcatggctagggtttaatgtttttggaagggtggttggttgcctgcctgcctgtgcaggtgaaggtggagcagcatgctggttgctggatatgcactagagctagaggagggagaaggtaaaccatacagtaataataatataattctggagccgatcgactgcctggcggggggaccattgccgtgcgcgtgtgtgtacgctagctagcctggagctggagggagaaatggctaagcgacgggccggccgcatgtcttaccggcagcggcagggacggacggaggaccactgctgagcactgagcagagcagtgcagtgcagcccctgcaggataagatttcaatttcccgcaggggatggtgatggtgaggagaggcagatggcacccctgcccctgtcccttctcctgtacaagtcgtcgtcgtcgttgtcatcgctcgatgcccgatagatagggaggaggacacggtagtagtacg

SEQ ID NO: 1491 - DNA, 1285 bp, Zea mays
  misc_feature (1)..(100): optimal_loci_313526_G1, chr9:98757919..98759203, Cluster 9
aagtgcgatgtttcccgctacgctagccggtacatgcataggggaacagggcgtcatgtcacgttggacgggaaaaacataaacaagtccacgatgttctacaggccatgaaatcagaagacctaccatgagtcttgtgcatagtattatcaaggttacaggggttaaagatccaattttcaaggacattctctgatgtagacacgtaatcaaagaatagggttatgtagacctattcccttaaacttacataaattaggtagttacattacggttagttttcgtttatgatggttttaacttcttgccatgtgaggctagcgagcttctcgcccatgtacacttgtttttcctgtttgatcgtcacaacgcaatatgtaaaatttgtgccggaactattaaaaatcgacacattcaatttcattgttcttcgatgatatcgattgtgatgccatgatgttctagatagggacacacgaaaacagttcataagtgatctgacggctatgacgaaagggcgtttttgaggtagctaattaagcttagagcacggcgtgtggaaatttgaggtgcgtcggtagtttctatgcaaagatattggtggttggcttgattagcacttatgcgtgcatgcgttctatgctagctagtcttatagtcttgccgcgtactactgactgttactagctagtagccactagccagtagccacaggcgcgcggcagcgtgcaactcgtgccgccgctgtgctggctaatcagccgacgacgaaacatagcagagcagatcagcaagcactgcagcagtagttaaactctgatgagtcaaccaaatacatgcagagaggagaaatggcgagcctgcacggcaatgtcgctgcggcctgcagagcacacgcggtgggtctgtattttgacaggaatagtactcacgtaacgtccactccgactccaccacgctttcgtcttcgtcctacaggatcaaatcgcggcgcatgtgatcaccgacggcgacacggctcacaaatcacagcagcagcaacaacaaccgactcgtgtgaactcgtgtgccctgcgtccatgcagtacacggtccggtgaggtgatcggacgcgcgcgggcccttgcctgtcctcgcgcgagcgaggccgccgcgtcggtcgccttccatctcccttgtgcgcacatgcttcgcactctccatccccaaaccacacgaggagctgcacttccacggcgcggcagcggcgccgccgccgggcctgcaggtcttgatcgtcttgtac

SEQ ID NO: 1492 - DNA, 1386 bp, Zea mays
  misc_feature (1)..(100): optimal_loci_313664_G1, chr9:99388930..99390315, Cluster 9
atgtatggtgctcaacaccaccagaacacatatgtgtgttttataccacgtacatgcacttaatcaataatgaaacagtgaggtgaaggactctcaggtggcacatatgtgtgttttataccacgtacatgggtgagtgcttataccaatgtcttcaagaagggaaacgctacatcatgacatcatcgccatagctagcattagcaaaggccagagaccaagcgaagtttttgcttgaagacctcaaaccaaacaccatgccatgcatggttgagatctgaagcatcggggcacagatccgccgcttccacaaagattagaaagagaattgagcagggaggggatacacatacacctctacgaaaaggtgcagcgatctgctagggtgtgtatggcggtgaccaagcccatgtttccgctcaaagcggcagtgcggtgatctgggcgcaataaccagcatcgtccagtgattgattattcttctcgtcaccaacacaaagctaagcaagcgctttgaggccgatccaatccgacatcccgacctcgtcctcctcccacctccatccactccagtccactccaagcacgccctttgccccccacaccaaacaaacagctcagcctgtccgtccctttcgccaccacgatccagcgcagtttattaatttaaaccctcgagcacgcgcctggcaggtcagcagtaacatgctcgctttgccaatggccgtccctcccgtcccgccgtttcgaagccgacaaatccgcgcgtcatcagtgctaatctcgccatcaaccagcgcctacgtgtcccggctcgctcgccggcgtactatagtagtggcaccgagcggcgccgtgccgtggcccggggtgggagcccatgtgcgcggcaggcagggagggatcattagccgccgacatggggcgaaagcacgcacgcccttgaaaaaaaagcgcccctaatcctatcatcatcgggggtctaatcctactagtttactgttcgccgccgcaccctttgcgccgacgacggagttttagcggcgagtgaccacatggtctgcgctgccgctgcgcctcggagatttggggcagctggcggcttggggcgcgtgcgtgcgtgcctctgccagactgcaacagtgggttgctgcacaggagttatcttggcgtacggtactacggttgaatcaatctgaatccaagccaaacccaggttactactccgaccaaatgggtcattggcaagccgcaaattttgcaactaggagtctatcaaagagtagagagatgtgcacgatctagttagcaacattgacatgatcacatgacttgtgattttgtccgtgtattacaaatgttggtcacatatataagagcaacgcg

SEQ ID NO: 1493 - DNA, 1131 bp, Zea mays
  misc_feature (1)..(100): optimal_loci_314893_G1, chr9:105343220..105344350, Cluster 9
tgttacattaattctcacatctggatagtctccgtagaattctgattggcccccaattaagagacgtgtactgcaagaataagatgtccacgtacaattaagccgctgtcagtgcgagctaacctagctcacgcgcacgtgcatcatgtggcgatcgaacgaaaccgatggagagacttggagaggtagcggcgcgaccgaaaggttaatttgcatcgctgctggctcgctccatgtgtcatgcatgcatggtctcggacgctgcgctgcgctggagggagggaggccaccatatgcgccatggacactggatgatcggacgagccgcgcacatggctgcacatgtcgcctcggcacttggcacttggcagcggcccgctgggcggcgagggccgagggggacgcccaggacggaggccgtgttgacggacgcgcatgtgattgggctctgcggacacgcaagcttagctaggcacacagatgctctattctgtctgtgtgctacaatgtacgtgctggatgatatatagcataggaaaacaagacttggcgtgtgtgagcagccgagtagcttggtaggcgtgtcgacgtacagtcaggcacatatatggatcggacagcatgcaggatgatcgacatagttttgcatcgtcgtcgttcgtccgtgcatgcacgtacgtatagtgtagtagtagacgccatctttctgggacggaaatttcctggaaacaagggcccggccggcagccgcagttcgtctccttttgcttgaaccgcggcgtgccccgtgaaaggcaggcagatcactgactcacatggcgaccacacatggatatgcggtcgcgcgcgcgggccgccgatcgaccgaggggggcctgcatgatggagtcgaaaggcggcgttgcgttgcctcttgccctacttcgacatcttcgtgtgccatggtatgtttcgctggtgcgtttctagttagcaagcacgtggtgatctcttaatgtaatacggagtacatactagtttaatactactacgacgacagtggatcacttttggaaaagagaaaaggagcatatatatttagcgacgcctgtagtacatcgcatacggactactaccttatcatatccctgc

SEQ ID NO: 1494 - DNA, 1232 bp, Zea mays
  misc_feature (1)..(100): optimal_loci_315720_G1, chr9:110312548..110313779, Cluster 9
tccttccacagcgtggtggctgcgcggtgcggtgctacgtccacatagcgtgcacgaaagatgcttggagtgagatcgataggtgttttagacacaaacccagtcgatccacgcaacaaacaaagaagaaacgttactaaaggtcgatggactttaatccctgcaacacagagtcattagttatgagtcattagttatgcaagtatgaagatcggtgcactcccgtgaataaatttgtttagtagacgcaaactcactgcacatatatatatacacctgttgcatttgataagaccagcccatcaatatgctctattgcacaatggcgcatgtgtaccaatgcaccacgcactgctaaagctggggacggtagcaacaggggcacgtgaaagaagatgaaggtgcgtgcatgatacggtggtcaatggctctggccgacgactcgcggtctgctctcatgcacgtttcctaaagcgtcagcccgcacgtcacggccggacccggtacccgtttctgcttcttctagatgtggacccgtcttcctggtgctcctgctggcccgctagctctgcttagtgcttgcttactggcaaaaccgagctagcaaatcagtgaagtccaagacgaaggaagcaagtggttagctgaagctccagatcactggcgacactaacactctgctttctcccagcagggagcacaaccgacaaaagcgaggtggacgtgtttagaaaccagaaccaggtccttaacgtagatgaatgtaatgcctgttactgtgttccaaaacgtttgcatactggcggtttgattctcttttttttttttgaagtaccttgacgagtttattaattagcacagcacgcttcggggttgtatgtctcgtttttatataacagcacgtgcaacgtatcgtccaggcatatgtcgacacttctgaatgtgtccgccgccaccttgtcaacaagacgtgcgtcactgcgtgcatacgaagtcacgaagatatatttgtccggctaagacagtattatcgtcgttgattccataacaaaaatctatttagatactgaggattaattgtttagtagctaaaaattagtttgctagctaaccggtaaggtatttttagctaaatcttagcccgcctaaactagttaggcctatctgattcagacaacgtctaagaaaattctaaagaaattttttctggagaaaacttttgttcacttggt

SEQ ID NO: 1495 - DNA, 1105 bp, Zea mays
  misc_feature (1)..(100): optimal_loci_319855_G1, chr9:132818766..132819870, Cluster 9
cgtacgtcactgcacgtgatgacgggacagttttatccgctgccgcccaacgtccccattgcaaaatgtctctgccgcccgcgggccccaactggtctcctccgattggttagtccagtctcggcgtccaagaagaaaaaaaaattcccgcgggccccaactgatctctctcatgttctagacggaaacctcgtgcactcacgatcatgatcatggcagagcgtttcttggctgctgccaataaatgagcacagctatcgcatctgcccggtcgatgaaaaggcaccatgcatggactgtactactactaccgtgtatgatcttgggtcctaaaaaggaccaggtatacgtgcctaccacgagcatcgcgtactagcttacaggtgcatggagtcgatcagctactccttgacccgccagccaacacagtccgtccgaactgccgcaacgtttgctctacttctctacacgtggtatatagatagcttctccaccgtgtcacgcatcttgttcgctcgtcacgcgcacattgttcacgtggccgtatttttttttactccgcatcgatgcacatgcaccccttttctgaccttgcgagtcgattgcgaggcaccgctttattggtcacgccgtagcgtttaaagtaagtacgtccgcgcatcaggaacgaaaagagttggaccaaaaaaaaatgagccatgtcctccaaggccgccgtacgtaccccgcagcgtgcaagcggttgccctcgatccggcgcgcggtaagacggggcgccatattatacgcatggtacggagtccaccatgagtgctgtactgctgctgtactgtagcgtgcgtgatgcgccgacggggggcgggccgggccgggccggagcagataaggtttggtggccagaggcttccaaacctacccttatttgttccagctagtagatcgacggccctagtatttcctccgctattttcccccgtggttagttggtaacgccctcactgtcactcactcgaggtaccggatccctcggtcaagtgctgcttgtacccgtgctacactacgaagaagtgatacgtcatgactgtgcaactgatccatgcatgcg

SEQ ID NO: 1496 - DNA, 1234 bp, Zea mays
  misc_feature (1)..(100): optimal_loci_319886_G1, chr9:133063381..133064614, Cluster 9
gcttggttcggttaactagtcgacgttctctccttgtcacttgtcagtgcttcggcgcagttttccattgcaggctggctgctgcctacgcctgccggccaaagggtatgcaggcagcgaaagaagaaaaaaaaactattctaataccttgtagcttgtatgggtacgtggaaacccctgccgccagtacaagatgatagtagtaacagaagatggggtcgggggggctcttgctcttgtccatgacgtactagtgctctcttcgatgcggcttaacagtttcagcttctcatacgaaagctcgctcctgtactcgcagattccctgtccgcgacaggctgcgatccaacagcacctggccgcacagtgtttactcgcgagcgcaccgtgacatcaacatgccccaatagatcaccggaggacactgcacctgcggcagagaacccatcaacgtctcggctctgcaggcaggcacacacacacacacgggacctaccctgcgcgaaacagcatgtgcccctgcgcggtgagtgttggatgcggatgctgccatctcccctgcctcgtcgtcgtcgaccggcctgcaaagagaggaccgagacattgagtctgttcagtagtagcagttagtatttctttacagctgcagtccattctcacgacctgttactgtgttactactgtgtgtaaacagcagcagccgcgctcgctgccaagaagcaagcagttgggcaggcagacccagatgcaccggcgcgcggcggccgtgcgcgtgctagccaagttgccggcgggtcatgatcgagctcgaccgaccggcacgcacggggcccctcccttcccgcgctgtccaggtagcactgggatctgggcgtgtcgccacggcgcggggcaccttggctggcaccgtggcacgacgcgactcgcgcctttcccgccgtggcttggctggcctcgtgggggttcttggcttcttgctcgtgccccgatcaattctttacgaggggtgcgtggtgtcatgtcacgaggtcaatctctgtcgcagcctttgcagctggcttccgtgcctttttctggccgcgttccacgatgtctctctccggcctccgtccgggtgtgggttaataccataaaataaacaacggccaccggcctacctccgccacatgctttccactttgacgtgaatgtatatatgtgcttgtaacaaagctcacgcttgtggcatcagttt

SEQ ID NO: 1497 - DNA, 1092 bp, Zea mays
  misc_feature (1)..(100): optimal_loci_320525_G1, chr9:135817412..135818503, Cluster 9
cataaattagtcatctgatactacatcatagtctatattttcatagcatgcatgcatgcatggccttggttgcgaaaatgatgcaataaataaattcaacatgcacttaaaatttgtgttgcttgctgggtcattattgactcgttgtacaaaaacttaaatagtagttctctgtctaccgtgtaaaatcattgtgcaaggtaatcaagtcacaccaagtgtagggtaccatcctaattaattaatgcaaagcgcgctaaggggtaccatcctaccggtggccccggccccgccatatatacacatggcatcaaagcacttctaatataagcacgatatatccagtttgcgtcgaaatgaagtacagagtaagcacggaggagctggcgagcaggtcaatggagcagcatgtacacaacaaagaactcgccatgcatgaatatgatagcggctagcctagcctttttcatggtttccccccttgttgtgctgcggctgcgagcaaaaccgcggtccggtcgatggcctcaccggttccatggctacgtctacgtgtacgtaatcgtagcggcggtgctccagaatgtctccctcccgccctctcgccggcctccgaccggcggcggtgcgcaggtgcctcgaagacagcgggaataaggattggtttggaaagccacgcgctgacgcgaagaccgaacgagctgggctcttccccgtgcgtgcatgtcgttgacgacctgctcctcctcctcctgctgctgctgccgccgcctgctggcatgaaaacccaccaaccccccacacagagagtcgcgcgtggcgagtcgtaaactactgctcctgcgccttgttcgccggaccaggtgcagtacgcgtaccaggctttgccattgcgataccacgcccacgttgtcagtgtaaaaaccccctttgcatgcatgaacgaacgaaccaaccgtgaatattcgtgccgaccaatcgtagctggacaagttctgagtgctggtccagcaaggtactcgcatcgaaggtgcagccgctgggtctaggcgtaaggcgccgtgggaccggccgtcaaatcgagaagatgca

SEQ ID NO: 1498 - DNA, 1372 bp, Zea mays
  misc_feature (1)..(100): optimal_loci_32088_G1, chr1:197064525..197065896, Cluster 9
gtcggggctcgttgtcgtgaacgttaagattgttgcgccgcgtgtggccgctgcggaccgggtctgctgctgttcatcggggctagggtaggccgtcggtacgtagcccgagtcatggatcggtcagacataatatcgagtgagcgaggcagttcggcacttgggctgggccgcctgtgtgaccgagggccttggatcgtcgctgtgtgggggtgggggcctgcgcgaggatcggcggcgttcccgttgcagcagcagacagcagtacggtatcgccatgcacggcccgcacgtctcggggagctctgcagcctgcctcgtgcgtgtttggtgggcaatcacccttccatcgcttgcaccatatccatatgtccatgttcatctgacctcgacgatggacgacgaggacgagccgtaagccgctctatcgcgccacgagagcgaagccagcccagcccccgggcgtggatgactgcacgcacacggcacaccgcatcatgcatgtaccgtgtgcctgtttcctggccggttgcggacgcgtgctctccggccagtcaagttggacttggaccatatattgtcgcgtgcggcgcgtacgccgtacgtacaggcgtacacgtagttctgtgcacacgtggcgaacaaaagccaagagacctttgcgttattcaagctctcttgtctctcctcgtcctcgatcgctagcatacgtacgtactccagactccactgtggcacgagtgtgtgtgtgcatgcatgtatatcatcttgaattgatgacaaaggcaaaacggcacgagttccaggcgcgttccacgtacgcacgcacgcacgagagacaaggccaataacgcggcgcccggtattgacgtacagcggctagctagctgcgaacagaagtcaccggtccaaaaaattctgacgactgatagatggagcgagacgacgactgcaatgcaagtctgcatgtgaaaggctaattgcctgccgtcgagttccgtttagctagagagacctatgcatacgcaaaacgaatgagtagcttgctgcccttgtggattggctgcgccatatctagccggccgtgcccgtacgtaccttgcaaaacatgtattgcggcacagcacaggcgcacagcaggctgctaggcgctagctgccgtgccggtacaaaatggtacaccgtaccaaagtctggcgggcgccagtccttgtccgcccccgttttttctgccttcgcgtagcgtgtggacgcagcatttgcacgtgtatcagtatcaccacgcatatgcaatggtactctatctgataactaactaactaactaactccctgtgatgtggatgtgtggcactggacttgtaatcaaacaa

SEQ ID NO: 1499 - DNA, 1191 bp, Zea mays
  misc_feature (1)..(100): optimal_loci_321861_G1, chr9:142815557..142816747, Cluster 9
cggcccggcccggcccggccctgttgtttgttattaatctcaaaaaactaaaaagaggaaaatatactgcgtttgttcgcgtactacgtgtcggatgcccgtcacgtactcatgggcgttttgagaggcaaattagtctcccaaacacttcctggtttctcagctctgaagaaaagaaagcacgacaggcgggcgaagatgatttctcttaagcgacgctaacagctcgatcaggcatgtcacttggtcggtttgtcttccttgagaaaccaggcaaagatgcgccaacctgacgccctttcctgcattgactgccctgttgttgtgtgagtgctagtacctgttattgcaataaggcaataataattagacaggacgtggtaaatttccacgtgtgtgaaagtaaacaaagctgagcagcgcggtaggtagggtggggatgcagtggaaagcgggttcgttcagatcatatccagctccagccgccggaaaagaggaggggatccaaagataccagtcgcagcaggcaccaggcacaggcagtaccccctcacctcttttctctctctctctctcgtccggagcaagctgcaaagccctgttcgactagcctggctctaggtctgtgcatgtgtccgtgacgtttttactccatagaccacgtaagcttagatacagtacatcgtcctgaagttttccaagccgtgtcaacagacagcgagtcagcggcacgtccccataaggcactcgtgcgaccatatattaccgtcatccataatctaatcggaatccgatcatatggggagacgcaaggagcgctagcggttgaagcgaacgtgtctacgcgcgcgagctagatagaactgctacgatgatttgccgttgccgagctcgagcacggccgagcgcaagcggccagattttgctctcagtagggtggcacgtattacaacctgctacacaacgccacttgacctaccaagtcagcgaggcgctcacaacgaggcaagggattcaatacaatcatccatccaaacgcggggtaagatatttattcacgcgtctacgattataaccacaaataaaactccgtactcatccgttgatataaacatctcacacttacatagagtttactatatttctcgtatctttgatagccacgaccttcatgtatcgatggatgatttt

SEQ ID NO: 1500 - DNA, 1004 bp, Zea mays
  misc_feature (1)..(100): optimal_loci_32267_G1, chr1:197986714..197987717, Cluster 9
gtccgtgcccacccttcactcgctcacttcatcctacatgatcgccacagtcgacctttgagctccgtcatcccgcatggatgacagtaaccctgcggggctgttcgttttcatctcgatccatatgaatcgaagaaaattaggtgagtttaaatctataacaaattcaaatccttattattattttttcaatttcgttaaatccacgtgacatagaaataaatgaacaagttctacatgtacatgtgtggccgcttccgggaatgatttggtggagctcatgtggttgtggagaaacgttggttttgccgccgccggatgacctcacctcatgtatggataattggatgtactattagtagcttttgagttttcaagcatcggcagggcagcaatgtctttttccttgcttgcctgggaaacaaaatgatggtaggaagatgagagaacagtgtcatcttgcactgtgtgcagtgtagtgtagcagacgcgtcgccgctgaatttttccacagttgagtcagtgtgcagagtggaggtggaccaactctccaactttgcgcccttctctctcatagagtagtctcatccggaagaccggaaggcccagtagatggctaaaaattattaattaatgggggagcttcaaagccttgttcactggcacgggacagccctgcacacaaacctcatcatcatccataataaagcccggccggacatgctcaacggcagcatcttgattatttggtagcctgtcctcgataactctcgagtatcaagtcacgcttgatcacctggtcggctacccaaaaacacaattatgtagctagatatgtgtttgttcaagtgcacagctaaaaatatatttatcgacataccctcttgtgagcattgtcattacttcggagagagtattatggctaatgttttgccacctagaaaataaaaaaaaaaacacttccaaaaagagtggtgtatagcctcatgtggtcaaatataagt

SEQ ID NO: 1501 - DNA, 1390 bp, Zea mays
  misc_feature (1)..(100): optimal_loci_323038_G1, chr9:148644238..148645627, Cluster 9
cctacctaagggagccacgctggttgattatgcttatctgaaccatactgaaaccggcaacaaaatgatcgcagtaaatgttttggaggctctactctttgttgaacgcttctatttctgttcttgctaatgcaaatgcaggacagcctcaatccaggaagaagagacaagattcatctgcaattctgcatcttcaatgtctaggatattctaacatcttagtttacatgttttgtcagtcatggcacgtgacatttaggtatatttgacttgggatactcaagattttggtaactaagcggcgtaacagtacacacttaaggtgcttcccaccgtctgcaggctgacaacaaaggatagtagcggagctagattgctttgctgttgtctccctgttttttgttagaagtggatttgttcttgcttcatttttgggacagttgaagtgcatctagactctctagagacagttgtgttgctagaatcacgaccaaaagtattggtccaatattaggtgtctgcttgctcatgtagacggtattggtagaactactgaagttggtttcaagattagtgcaacggtgacatcaaccaagcgcacgagttgcggttttttctgaaatcatttgaattatggacagtgaaaggataccccccttgttggctcgcttaaatacatgcagtgtagtgttgtttactgcctccttggggatcaaatgcccaactgcaaacacataattcaaatgattgcagcacgaacatacaacgaacataccacgaaagacacagacacccctatggaagggccactgttgaaggagaacgaaaggcacagtcagatggcagccgtgtacaggacgaacatagaacgaaacagtaaccaaacgtgaaatgcacacgtagcacgctgttacgaagaggtacactgcagctagccaagcgtgaaacgcacacatagcacgcgcaactatcctcgtccggtcccccttcccttcccttcactatcgggcggcacaggaaagcgaagacgacaggctgatctgacggcacggcacggaggagcaaagccaacgttgtgcacgcagtacggcggggttaggcgcatgcaatgatatggtaattcatgatgcagaagctctcggttagtgcaggagccactcactcatttgcgtttgcgtcgcggccggccggacgggacgatgacggatcaacgcgattggatgggcggcggttcagtcccgtcctgtattctgttgaattctgctaatcagcatccaggcttttcctttggaattggggaaaagaaaaaggggagcagcttcaggattagcttcacggcgagagcgcatactcccgcgtgatcactctgattagtggcttagtgcccgcg

SEQ ID NO: 1502 - DNA, 1325 bp, Zea mays
  misc_feature (1)..(100): optimal_loci_326460_G1, chr10:10381583..10382907, Cluster 9
tagtgctacgctagaagccacaaattcagaaaggattggagaaattaaaatctactccttattgaaaagaaggcataactagtctttcgtactagcttgaaagccacaaatttagagaggaatcggagagaataaaatctacttcttatttaaaattaaataagaagtgagttttagtctctccaaatcctaccgaatctgtggcttctaaactggcctctagagtatgaagtaggtcgcggtggtggttggcggcattaatattcttattcttcttcttctgcctctgcgtttctccataacacgcacgttttattattgttttttgtgtgtgtgtgtgtttttgtttcaccgagtatctactactgcatgttgtgtgatttcccaaagatggaggccgatacgtaagggagggggcgaaaagtggctgccatgcttgcttgggtgcgtagctggctggagcacgtactcctatattggaggatcgtgggagctggagtatgtatgaggcaatgagtggcgcccagggccagggcagatgggatggccatgccggagcggtggtagcaagtagcaacgtagcttttgcgcatgattgagagcagagtagagcggagcggagggaattgaatttggagggaggaggaagaaagtggggggcaggggcagcagctcatcagctttgttttggcctttgcgcgggggggggggggggacactgcaggcaggtgcggtgcgggggaagggagggagcatctaatgctgctgcttgacagctcatccgccgccggcctctcctactgcctcgtctactccactgtatcccatttcccccggcctctgtactgtatgtgtgtgtggtctcttttacagtgtcctggactactggtacttttcaccccttcttgtacttgacttttactttcaccctacgtgcaggtgaaatccaaaaaacaccgttacagatttactgaataaatctaagcgtacgtccgttgaaagaagtggctggtccgttgaaaaaaaaagggtaataacgcggggatcgctgcatttcttttttcttcttcttcttctttttaatagatcttatattttaaacatgccggccgcgccgattaatgtctcttgtacctgcgcataatatactacaactttgtctttgaaaaaataataaattcccagtgggtcagtggcgccgaagaagatgatgatgggtgggggaatttcggggtctcctgccagtcaactccagcctggcccacccgccccggatcgcattaaaacaagcagcacacagtactgatctggtctggtctgggctc

SEQ ID NO: 1503 - DNA, 1036 bp, Zea mays
  misc_feature (1)..(100): optimal_loci_329014_G1, chr10:24425623..24426658, Cluster 9
ttaacgtttgcttttctatcgcagagtggcctccaccgccttcgatcacgaggtgtctccttctattaggtcgttgtgattgagtctacgggaccctccccctcttcacttggagtattggggtgaccttgccgcttctcgtgcagccctggatgtggccgatgatgaagtaggcctacttcaggaccagttcaccaagtctgatggtcgagttgctggtagggttcctatactactgcccctatgtctcttatcgtccttaattctcttttcgtatttttccttcattgttcagttttggaaattgagttggagaagcttcgtcgttgggcggactaggttgtggaatatgtcggagcccgcggctcttccttggtggaaaatttgaaaaatatcttgtgtcacaactgggatatcgtcgacttcagtgtacagcgaggggtgatcaaagccttggtcatcagggagctcttgtctggttgcgatctctaggatgtcattggccttccttaggatataccgaatgatggactggaggatgtcctggagggctacgacgaggcagttagtcatgttgtggaaaggttgtccgcaaatgatatcatccgcaaagcctgatgagctcatgatgtatctcgttttgacattgtgtctttatgaaggaatataatttttattttagtttcaatcgtttgagttttccttttgttaattgtgattgtgctttggggtcacgagacgcctatgctgatctgtttcccccatcggggctcgtaggcctgctttctttaggtccatagggcatctttttaaacaggagcacatgctccttgttgcccattcttatgggcagacgtcgtgatctcttgttcctcgtgggttccttggtgaccctcgcttcctcccggtcgatcgctggctgccatgaatcagggaatacctttaacgggtgatccttcaaggcaatggtatgggcattctttccgcttttgtaaggtcttacccattcctctcatccctgttgatcccctttgac

SEQ ID NO: 1504 - DNA, 1152 bp, Zea mays
  misc_feature (1)..(100): optimal_loci_337008_G1, chr10:77259269..77260420, Cluster 9
catgacgtattgacgtagagctaaaaaaaatttgtactactaatttgcgcggctgtcggtctctcaatttggcgcgcgcgtgaccataacgcgcgctgtgcctgtgcggcgacggagacggagacgcggacggccgcgggagtagcgagcggacgggcctcggtcgagggaggcagacacacggcccggccgtgattgcgccatctctcctgcagcctaagattttttttttagccagggggcgggcgagccggccggcgagcagaggaatgatgatatggattgttcgtcaagaaatactcctcctgtctacggtgtaccatatctttttcgtttttcttatatatatatatattgctcagacggaacatgtactgctactgtttttcccgaataacaggtgttccaatccatcaatcacatgcagccacgccagacgacaaactccgtccctgtatatagtagaatcccatccgtacggaaatttgacgcgctttgcgttgctgtatgtttaccaggatctgcacaccccacgttaattaaccgaggcggtgcatcagagattcatctcagagtggcgcgccggccggcgcatgcatgcatggtgcatgcgctggtacggtgaacatttgatgatgcatgtgcacgaacaagattttactcagggaaccaaacacccgaacgcaactcaactcaactcaactcaactgagctgaactgaactgaactgctacggtgatcactcggccgagctgctggctggccccctgctgatgcacggtttttcaaaccgtgtgaagaacgccacgccgcgtcgcgttcctccgccgctcgttccacgtgcgccgggcggcgctgcggacggcggcggtggtaccaactaccaaaagtccaccaccagcagacacgcacgcagtcagcagagccacacacccacggtatatcatctttgaattgccttggcctactacgtagtagctgtggacagatggccaggccagatgcatgtgctgctgcatgcgcccacacttccttccccgcggcccttgattagtgtaatgctaataatcgcctgcttagttttccctccccgtcctgtcggtctgactctggcgggccacgcgccccggggcccggccggcgctgctagct

SEQ ID NO: 1505 - DNA, 1050 bp, Zea mays
  misc_feature (1)..(100): optimal_loci_345075_G1, chr10:121406311..121407360, Cluster 9
tcagggacgggtgaaagattcatcgccagggaccagcacggggggagccgacccctccacggttcatttgccatttttgttagtgggagaagcattaatattgcagtgattttttatatatctatcataagttcataaccaagaatggtccggacgtcgctaggatttcctcgtgccaaacggccgatacaacgaagcatcgttggtccagtggcgaggcaacttgacgttgcattcatcatgcagtatatgtggtattggctagatgcttgctagcttaacatgtcctagtccatgcatacgtacgaaactatagggaatcttgtaaaaggtgaactcttcgtgccacatactaccattcatctagagctcacccgtacacacgacacacagtccatgcatacgttgatacgtacgtaaccggcggctaatataacagcgcagagctggatcagccacacagaggggtgattggtttgaagaatgaggaaatctattatcttcttattcctcaaatttttttatttggtttgtgtaattgaataaattgatctatcatcatttcatttctcataaggtaataaattgatccatcaacatttcattcttagccggaccagtagaggccatcgcgtccctggcgcccaggctgtgctccgggaagaagagagcccgccggtgaggcctcatggatggcgatcaatggcgtcagatcggccggcatctgcatcggacgctgctggtggaggcggagaggaaagtgctccgaaggtgcggacgactcgactcctttaacgtgagtgcgtggacgggaacggctgtggcagtgcgtggagcagcggacggagggaggctgcccgctgcctcgctgcaggcccgcaggtaggggcttcagtgagtactgcttaagggcgggggagggataccatagaggaaaagtcacgttgcttttaggtttaacaagggcatagcttattttttatttaattaaattaaataaattctatgtatatttagatcctctttggtagggttcttttaaagtctccc

SEQ ID NO: 1506 - DNA, 1033 bp, Zea mays
  misc_feature (1)..(100): optimal_loci_347553_G1, chr10:135695637..135696669, Cluster 9
taataaaaatatatataacaagtgtagtctagttttatttgtaataatatcaggagcacataagtgaaatcattttttattaatacaattattaagagatacagtgaaacaaagtatatataaacaatatacaatttcatctcaaataacttttaggtcacgagataagttacaacggggttttcatggctctcaactaaaccaagcgcaccgaagtattgaggttagatacgtatagatgtaaaattacgcatgtgccctctaatgtgctggttcacataagcattagttggtgtttatcgaaggataagattgcttggcggtcggtgtatttggtgtttatattttatgagattttagtcctaaaaaacagtgtatttggtgtttacattctttttggacaaaatttaaaacacggattctatttgttaatacagagggaatataaatggatagtactagcaccgagcctcaagccccttcagtccttcacaaatcccccgtcactaaaagtccttcacaaatcctcctgcgcgtcctccggcgccagcgcgctcggccgcgtccaaagcctcatcgagcgggagcaccgggtcgcgcgctcgcgctccgtcgccgcgcacggagtcgaccagcggcggataagtccagactatggggctgggtgtcgttccagaagccgcggcggccttccgcggccgccgggtgcagggacgtggagctggagtacgacgacgcggtggcattggcgaagtcgatgtcggtgttgatcgcggcggcggcggcggccccggagcccaagacggcacggtgggggaggctcatcccatggaagatcaaggcgctgcggaaccgccccgccggcgatcggcgagacagcgtgagatggaaccgatcgcgttgtagcccgggtcagtctgttgttcatttcctcgatttaggtggcgttggctggtcgatcgatcgcgctcgcagccgcttgcgctaatttactgttttttctctatgtctgttgttttgtctccttgtactc

SEQ ID NO: 1507 - DNA, 1140 bp, Zea mays
  misc_feature (1)..(100): optimal_loci_347607_G1, chr10:136001767..136002906, Cluster 9
tacagtacgatgtagccccagctagctccgagcagcagtcactgttaatcattggaatcttgaacattcctctgcattgcattgcattgcgatggaggaggccacagcaaggttcaatgcaccatgtgatcgacgcgagcggagcaactagtgtttcttcgtcagggaacgggaccaaactcaccaaactggccggcgtcgctttcccggcacatgttttggaggacctgcaaatcctggggcgcgcagcacgctaaactgggaagcagtgttgttcttgcaatgcgattagttttgtccttgcatagcataggtgggtgggtgtgcggagttcctggccggccgtggtgccatcgacgaagcccctctttctctcggctcctgttctttcaggcgttgctgcctcttggaagaattagtgtggaggaccgaccgggacctatatatagctggctgtttatttggtagcttggccacacggtaccagctttctgagtctgcgttgatttcagattctaaccattttgtcctgctgggctctgctgtgctacctcatggcaatcctggagtatttgcatgcatggggccggttgcagcagcatccctcctttctgagtctgcgttgatttcagaagcgagagccacgttagttagcgacctgcgagcctgaaattttcaagctcgtaacgcgaccgagccgcacctagccgaggcaggctcgtttccggtactagacgtgacgtcaattaggccagcattttttttcttctgcacgttcgctagaaaaaacagctgcgaactttgaaagtccaagtcagactggttgactgtggagaccggccggccgatggatgtccctttcggtccggtcccctgcgtgcgcggcaccagaaaattttgaagcacaagtaggttaggacaacttttcttaaggaagcaaacaaaaatacggacttagaggtagtatttcgtaaacattttcttgcattcccaagacgcacactgagtgcaacgcaacgcatatcacctcacactgctgctactgttgaccggtactgcgagcgacaagcggcgattacctctacacataagcgacgttagcttctgtgaattatcatgtaaaagaactgcaccgactaa

SEQ ID NO: 1508 - DNA, 1141 bp, Zea mays
  misc_feature (1)..(100): optimal_loci_348706_G1, chr10:141602002..141603142, Cluster 9
attacgttattagtttttataagtcagctaatttttggttaatttttttggcggctaagagtcgccaaaaataacttattttttgtggcgtatgtcttattttcgatgacgattggccattaaaaatgaactttgtttctgtagtgccgttaggcttgtagctcgatgcagcatactacagctactcagtactagtgtaggtggcttgtccctgtcgacgcaggtagtcgatctgtcgtcctctttcatgggccggccgaaaatgaactagagataccggtgatcttcgtctatcccaattcttatgtaacaacatatagttagctagcgtcgacagccacctttcggctttcggtgacctgacgacgcccttaatttcctccatcgagacctggatcgactgcgtgtgcatgcatgcatgcatgagggaataaaattaacggtagtttagctaggtttttgttgccccaagctttgtttgcttggcggtttctgtttatgtatgtcgtcgtcgatctgcgattggcatgcaggctccaacttaaccaacgttttccctaattaatcgtcttcttatatcatgcatgcttgctactaatcgtgatcgacaatctcgatcgccttttttattagaagaagaagaaaaaaaaagagggtgggatctccgtctcggcctacatatctttgctggctgcccgtcttcgtcgccgccagcgcacgccacgtctccgatcccttttagctcgctgtaggtgcaggcgaccgatagacgatagatgatctggttcttcacgaaaccgagaaggtttttcacgccgtcgatcgatgtgctggccggaacggtcggccgccggcggggcgggtgtgtggttggcatgtcaccatgcgtatggctctggctagctacctgcagcaagtcacagctgctgtgctagctctatctgtagctcacgtacgcatcgcgtccgccatcgccaattcgccatgcaggtacagctagatgtacgagcacagtaggggtgatacttacacgattcctagcagctagcaacctagcattactttatatctgattgcttagacactcgaaaaatcctactttatttatatctgaatctgatgattgctaacacactctcca

SEQ ID NO: 1509 - DNA, 1099 bp, Zea mays
  misc_feature (1)..(100): optimal_loci_348891_G1, chr10:142775833..142776931, Cluster 9
atgaagattggtttggtgcaagaagaaccggagaggatccataaagagtgaggacaagcggcgtgtttgttttgtttcaccactgtcatgtgagctgcgcggcacgcagaggacaaacattccggttagttagggtggtggagaaggaaggagctcaccactcatctagacatgtgatacatctcgtgggcgtgggcctgattacatgggaatcgcacgcactacactgcactgcaggattttaatttcagtgagttcatctgaatactgatctccaaatcacataaacttgattttattcgatcatcatgtagtaatcctgaatacatttcgcggcgagaattgtcctcgcggatgattcagaggacggtgtggattgaacaaataaagaagacgactgcttcagctcgtactcttgcgcatgtgtgttgcagaaaatttcagaagaagcggccgttgagatccaaaatgatcaagaagctgctcccggtttggttacttctggagtccggacagctacaataatctagtattatctactagcttaatgagattggctcgcttatcatctcatctcatctcatctcattagcttggtggtagccaaagacaaaagagaaaggcatctagaccgaggtagtcatgtctcctttacctgcccatcaatcagaactaccatacctactgaatccgtcaggtacaagcagcaacattagataacacacttcttttgtaccatgttcgaaccctaataaatacgttgtcaccgtccgacgagccataagcccatacccatacctcaacaaaaatctatttatttagaaccccatcaacaaaaaaaaaaagattcatagtaccatgtgcaaaaagatgcactgccgtttggtaccctgtgggagtgtgggctgtggccgctcaggacaggtttggggatcacacaaggatccatggggagtaatcacttgttattcaaaataacaagggatcacacaaggatccatgactacctcccgaaaggccgaaagaaagataggcagtataatgaatgtcctgacgaagaatgttggcggacaagtgcaacagcaatcagcgatggcca

SEQ ID NO: 1510 - DNA, 1236 bp, Zea mays
  misc_feature (1)..(100): optimal_loci_3498_G1, chr1:18175470..18176705, Cluster 9
gtaaaccatatataaaccatatataaatcatccatatctctcattactcaaatatgtggctctcactgacaaaacagccgggagatgagactcaagtgcgcaggcccgcacggccgcagcaagagggtcatgtttgtataaatttctccattgagtttgtaaaaaggtatggattgatgaataaccgatgtcagtgagtcaatcaaaccccaccgccgatgaatataaattgtaaaaaaaaaaatcaaaagcttcgtccttcgcatgaatcaagttgaagatccacgcctgaaacaatggcagggccatcaatcctattgctgtagctctaccgatcgccgctgaattcaaaggaactaggccggccagcgctcgcacctgacacagcatgccgccatgccctgacctgcatacttgccgcttttatgaatgcgcagcataagctttctcaaaaggcctgtttccaagaaaaaaaaatatcaccaacaattgtccagtccagcagatgctcctgattagcacccataatattactgcctaccacaggcaaagactagcaaattccatccacaggaaaaagaaaatacaggacctggaaggcaattttgcatctacggtgagtatgttctcgtgccttccaccgttgcccgcagtcatccttttagtccagtactccaaggacaatgcagtgctagttgctagccttgtccgcatcgttgcggatccagggacccgtgacctggctgcctttggagggaggatcatgcaggcgtagtaggggaggcgcgtgggacggacgggagggaacccctcctgggcccgcgggaattccacggaggaatcgtactcgtactcgtcaggaaggctagctgtagctgcaccgcagagagtatattttttttatcacttgtaccagttatcagtagtctcgcctcggtaatcggaggcgatttgtttggttggacgctgacgtaggagttctgacatgcatgcccgacactcgccggggttgctggtcaagctcgccggccgtgtcgtgcgcttctgacggctggcgtggcgtgttacacgtacttgatctcctacgctatacgcgatgccttctgtcccttgccatggacatatgtgcttttttgccttctgtcccttgccatggacatatgtgcttttttgccgtgggtaggagtaggatagacgacgacgagtcgacgagctcccgtccctgagcgcaatgcc

SEQ ID NO: 1511 - DNA, 1284 bp, Zea mays
  misc_feature (1)..(100): optimal_loci_35552_G1, chr1:215194742..215196025, Cluster 9
tattctatggcccgaacatcgagcactcctagggtacagggtcataggaattcaacgacgcatgaaacataaaattaggattaataatatcattggacgacactgtaattttctgaaccactaatgcagctttcattgaaccctaacagacaaactgagccttaagcgcgcgaacgcagttgtttctgagaaaaaaaatagaagcccactccatagccaaccatttttttttctatggatgcggaggtttttgttttcattttcttcgaatagttttttttccttcttattggacgccattcacgtgacacgcctcctcgtccacattctcctcatcaatgatgccactgcacaagtgagtgacgaggagtcaaataatactccactctctatctcattgtcctcgtcctcgtcagatcccccccccccccccccccccccacaaaaaaaacattttagctagctcttgttttgtagcaaggagagcctatgtaataactctccaaataatttaatatctaacacaccactggaaaatatcgtttgaaattaatgaggcccgtagaattacccagactctatgaacattcgaagttacgagcgatgattaaaaaaaaagaatagccaaaagacagcaataccatcgtcagcaggtacgcgttcttccaagttccaaattcctgatgatggcgactgctaaatgctcatccctctcgagaaaattaaaaccttcatccttgtagccgcttcccaatgctgcttgctaggcttggaaggtgtgtgagtagcattaatttttgcatgcacgcatgcaccaacaacgtgctacgcagggctttacaaacgcaagtggtgaccttggacggcacacgcgcatctatactcatgcatatggaggatgaaccagccgtgccattcatggcatcatagtatgcacgttatatatcacaacggatcgatcgatgtgtcatgcatacgatgcttccattccatttgcaggcactacgtgatgaacctgctgcttcttgccttggaggatcagtcggcgactcagccctcaccatcacaaccatggatacttgcatgccggaggtcctgtaaataaatgatatatactactggcctatacagcacggcaagatttttcttctcctttttttaattctgataatgagcacggcaggttaaatttcgctacatatatagtgtgatgcgtatagcaaatctgatacgtaccactccggcacggccactactgtacgtatttcccaactcgcaaaagag

SEQ ID NO: 1512 - DNA, 1162 bp, Zea mays
  misc_feature (1)..(100): optimal_loci_35573_G1, chr1:215349772..215350933, Cluster 9
tcgttagataaccatatcattttcttactctcttaaatctaatatagaatgttatttaaatcacctcttactccactcgtgccgctcctgccgctgccgccgccgccgctaactcctcccctcggcggcatggctacatgctagttattcggcagaaataaaaaaaatactgaagaaagttgcatttcatatatgtatatatagctgccatcatctgttcggtcaaaataatcatgcgttagccattgttctagctactggcatgattagccactcttgttcacacaaccaatcaaagcatctgacttgacccagtccatgccgcccgtcagtgcaccgtgttccggtgtcgacgatgccatcgaggcccgcccaatcctcgactgaaacagacacaaaaaaataggcctcccgaaaactaacggtgatcgtcacgctctgctctctcctgtcatgcattaacacttcgtcaaatcattcctcggtcgatttggatgacaatcacggtcgatttggatgtcgatcgcgcgagccttttgacatgggatgtgaaaagcatcgtcagggccctggattaggagtggccaggtggcggcgggcggacccttcttgcacttgcacacaaaggaagagatcagatcgccacacccacgcatggcatgatgacggcgagagatggttggttggggtggccgaaagattgtgttctctcccaactaacatggccatacaacaggaagagaggaagatcttgcattgcatccggcgaggccattgacatgtgcagcgctcgccatcgcaaaaggctctctttttgcctcggccggccggcagtccctgcgcatccagtcgcaccggacgcgtgtgatcggggagggcgttagtgctcatgtaaatgtcatggattcgtggactcttgctctttcagtgcctcaagacggctaccgactacagtaggaaatgaaaatttctagctcacgtacggtgctgcgcttctgttagttgttggtgtgtgagagaacgaagaggtgcccttcacttcacctcatcatgggcaaggatcagggggctggatgaactgcccagcaaggcagcagctgccttgccttagaactcactgataaccagtgtaatctgacagagcaacccctcttatagtaaa

SEQ ID NO: 1513 - DNA, 1095 bp, Zea mays
  misc_feature (1)..(100): optimal_loci_37130_G1, chr1:223776229..223777323, Cluster 9
tataaaatggttaattcgcaagtaagtatgaaatataaatatcgaacacagacttggaggtgttattcggaagccgtaaccattacgctagaggttcttttgcaaatagaattggtgctagaatctgagcaactacttactaaaggcttatctaacagactaacacagcttcaccagtagatttataagatgtttgaagttgtcccccccccccccccccccggatcatttgcaagcaactacgccaatgaaattccttaaatcatggttacgtaggaataatgacatgaaatgaaactaaaaatagtttctttttttttcataattttaccttacacacttgtgtcctgtagaatctgaatacaactttattagctttataactcaagatactcgtagactccaagtgggaaaaaaacgttaagctgcataaaacggaatcatagatgtcgatatttgaatggtctcctggagctactgtggagatagcgaactatttctgaaaaatgttctgctgttgctttcttgtgtaattcggaatggctgcttgcttgctcagtcagaccttctctctattaatatcagcagctctcctatctgatacgttttggaaaaatagtactcaatcaacagttattttctttcctagctgtcacgctattgtgtgaatgaatgacccgttctctgcggtgcggacactggacacgtacgctaccggagcgcctgcgggtgtgggtgcgtcctgcttccggtttcaaccgctcacgctttcggggttgcctcacagcgccgtcgactagcttcccagccggcagctcccccagttctgtatctgtagctttcgcaagtccgtgtggaaacagccacacgatctataatggcccttttggttctaacgtcagtcaaggttgtggttgtagcagcctgccagacatcggatgcaaagccatcggtttctcgattgcctggtggctaggatcgatgcctggtttcttgaaaacgtgcctgatcagatcagtcaccaatcaaacaggccttaattatcttggggattggatctacttgctgcgcgtaagaaccgctacactagttcag

SEQ ID NO: 1514 - DNA, 1076 bp, Zea mays
  misc_feature (1)..(100): optimal_loci_37810_G1, chr1:226933796..226934871, Cluster 9
gcgtgtgggcgtgagacgcgggcgcgtggcactctcgtgggtggcaggcaggcacaggcaggagcaggatgatgggccggcgcaggcgcgcagcgggttggattggatggaccacggagaccagtaatcactgcgtttgcatgcgcgcccaggcacgcatgttgcatgtctcaactctcaccgactccagactccaccgattgactcgacaaattgtctccaccgcgcggttaacagcacagtatatactactgtgatagcggctactaactagcgcctagcggtgaggttcgtcgcgacatggctgtcccgttgttttgtttggtttggctgcccggcccctatagactactgattaattttttaaagaatctattttatgtatgacatatctatggtgttcgaataatgtttttgtacccctcacacaggcccgcgcgctaccgatgacagtagacctatataatccggcgacagagtttgttacatgtatgtactgtgtcgtccgtgaacgtccgcaggaatggatccaaaggctgcgcacccgtgtgcactgtacatcagtacacgcctcccaatgaaagttgggccacacgtgcaacccaacaagcatgttaacaaaaggatcgtgttctgtcggtctccattgtagctagtttcccacaaggaccgtgtcgactgggagatcgttgacagcatattatagcattagtggtgattttgttgatttgcccgtgatgtgtatatggatatgtgctctagtattcaatttgcgtgcacctttcatgatacggactgagtgaaagagaccgtcactggctacagctgagaaaatgggcgctgcgtgccgaagtgccagacttccagctccatccaggagtaacagacaatgggccggagtatttaactcgttgttgattagctaaaacaacaggaagatatgttggttggagtacaaagataactgcatgcaacgggttcattcacatcacatcaagtccagcaaacaggggcccgtttctttttcacgactgtcacttgtaaaggtgaatcggaggagggtgcacggatgtttt

SEQ ID NO: 1515 - DNA, 1207 bp, Zea mays
  misc_feature (1)..(100): optimal_loci_38544_G1, chr1:230827506..230828712, Cluster 9
atccctttattctagatttttgaactctagaaacccttagagcatttttactttgttttttaatcctctaaaagctctaacgtggagtacaattaaaacctctatctagtaaggtttatagaaggagatccttaattaaagctagaacccgtacacgagtgatgactgatgagatagatggctttgacccggcacatgggcgacgcaggttacgaaccgacccccctggtcctgaactcctgatgacgagtaggtactcagcttttgtctttggtctctacatactctctacgactgcaaagtgcccccccgcacgtggcaggtgaagctcatgtagtcatgcatgttcaatagtacacctttttcccgtgcctgccgtcttatgaaaacgcgccaccgaattcaggtggcgtgtggccgtgtgctgcgcatgattgacaccgaacggctgtacgaagatctctcacaatctatataaaaaatccatctgttgtttttcgtcacacgactcttcccctgatttgcttctggttgcgttttcttcctctgcttagcttaggacaggtcggcttcgagggtgcgcctcttgacttgaaggggcctctgctctactactagctagctttatatattacggaccaagttgcatggtgacccaggtagccccgtcatcacagttccaaacagttgccactctcaagcttctcatctttttagtgacaaccaccatgattacgacaagaagccaagtctaaaagcccttcgccgtgacccatggatttttgtttttacggctcatgcatgctaagttgctaacacgccctgaccgcgctgtggtcgtacgcagagtgtcggttgctctctacgcgggtgtagtgtaggagtatttttttaaatcagaatggtgactactggagtactggctcgagcaaacttcaaacacgccggtgatgtaataaccggacccaccagggaaggaagagaaagaaagaaaaaagacaaactgtctgtggcgcgtgcgtagatgtggggtgcaggacacacggaaacagacgtagatgctcaaagtaccgcagtcacacacaagacagcaggtgacttgtctatacgtctcatgggagaaagcgacatagcttgcccgacactgattccgattcgcgatcctagattagcgatactttctgtaagaaaatgatccctccgtcct

SEQ ID NO: 1516 - DNA, 1404 bp, Zea mays
  misc_feature (1)..(100): optimal_loci_4161_G1, chr1:21695526..21696929, Cluster 9
actaactagtaggggggctgacctgagccgtaggaaaacaacacaatcatggaactctggcgccttcccatgtccttgccgctcgccgtcgtctccatgcatttggcactagtcaaacagagctagaaacgaaaggaaggggtggatggagaggtagctgatcattggggggtggggatctgttcttgtcgtccaggatctgggagaatatgcaatgttttatgggcggtaccatttctgtacttgatgcctgtcagtctttcgttcgtgagggtgtggaatctttcttggattatttttgctcctaagtaccctcgcctgtctgtctgtttgtcaccagtgcgctattgcgccgattcactgctctcggacaaattgaggtcacatggtttgtgcatgatccgtgaaggaaccctggccggaccccggttagtagtgtagtagttccttccgtcacattcgttgtcgattgtcgtcatgttaggtcaaagtaacgataggtcaatttggaggcagagttagagagagatagctagaaggtggctgcgacgaccgtagtacgatctccgttgacactcgcagagaacgttggacttttggtagtagcacaaatgccaggtgcacgctcgcggcatggccagcacgcatgccggattgccggcgttaagactttgaacgggagaaggcagatccagacggcgggggacagtacacggacacggcgagcgagatagaagaatcttggcttgccaagcgtgtaacgtcgggcctggctggtggtccaaactcaccgaggggggagagcatgcggttttttgtcccgtttccccgtccgttgcatccatttgtcccgggctcgctcggcgtgccatgcggctgctgccttggcacatgtgcgcgcgctgcctcttctacctcgcttggtactctctctcagggtcccctggccatgcccttgcctactagttgccttcccgcacggttggatggatggaaaaacagacggtactagtccttcttgccgcgaggccatcactggccaaccacatcgttggcctgtaccgagtgtccagcccgtccatccgagctgaccctaatctccagctagtcttcactgtagcctcagctgctgctgacgctgcaataggtcggccggccggtcggtctgtccgttttttacagcaccctgatcctgatctccaccgtgagagatgggagagagatggcaatgggccaaggccaatgccaatggcattggcgcattcctcgaaagccaaggactcttaatgccatctagctagacgccctagctttacagcgccatccgcggcagccttttgtatccggcaagcactgcactgttgcgggaggaccaggataacgtggctgttttgcgtggatacc

SEQ ID NO: 1517 - DNA, 1187 bp, Zea mays
  misc_feature (1)..(100): optimal_loci_42334_G1, chr1:249530422..249531608, Cluster 9
aacacctcattaatttcccccggccggcacgtactgtcgatatcatcatttactgtactaccgcttgcccttctgccttctcctccacacatatatgcccgtcccccacccctagacatcttatccctcacacacagcagcacaatccaccagcgcactactgccacactgcacgacgcataggataggaggagcctgtgactgtgagccaggaccacatgagagcttcttggagagccatggcggcggggcataccggccggaacagcaaacagcaggccgccgaccggttcagccggccgtgctttggctaacagtggatcgctccatcatcatacatgcgctagctgtcgctgttgccaactttttctgtactgccgtgccggggcctctgctactgctagtgctagcttatctccaacgaccagctagcagcaatgcaagcgcgacgtccccatccatccatcacccacatttcctctttttcctctgtgacttgcccgtgcgccttgtgttctatggtacagcggccgtacgcaaaaccagcgccatctagctaagctagctgctgcctgtaactactaatacatgcacgcactgatgagagactgcatgtgcatcatacagtgccgcgttttttaatttaatcgatcgctaatgaggtgtttgttttgaggaataagccagtcctttatcttctcactcttcactttttttatccttggttcaatttgtatatatgtttaacgtgcaaatcatatatataaaaccagtggattcgctagggaaaggagtctctaatcgtcgtcagatgtgtgaatagcaagctgaatgtatgtcgtcttgtcagctgtcaagttaaagtttttttttctaatattgattccgtgtggtgattgatatctgttagattcttctcctttctcgctcgctcctctctttatcctttccctctcagctatccgattttattttattttattttatttgatactggcagcgactatctagctccacaggctggttacatcatcacgccaggcacacaagttgattaaataaaaagattttatatatagtatgttgcaattcattgccacatgcccaacttgagcgatgggttgagtacttggatggctagcctttcttcacacttcatcttaatatcacagacgcccaagttactg

SEQ ID NO: 1518 - DNA, 1238 bp, Zea mays
  misc_feature (1)..(100): optimal_loci_42511_G1, chr1:250876855..250878092, Cluster 9
gttgatcttaccaattgaaagcagagatgtcatatttcaaacttcttggtggttggtacccaactccattgtttcagaactgatgctatggcggcgctgcaaattggttgtgccacttgtgcacctcttttcaggctaccttagaccatctgttggactatactccagtgttcactggcaccacctaacttgttttgacagccctttggacaaacaaattttttattgttctttctgtggtgactaacggaaacacttatgcagtcaaagataaaacacaggaagggccgcacacaaaagaaacactcatctactgacatcccattcgtctcagttctttactttgttcaattgagtcatggcatatgacaaggatttccctttaggtcaccagataccctgtcctgacttattgggtacaaccatgtgactgagcaacagaccactggggagaataagtaccaggatacgaccacagtgtcatctgcagattgaatgatggccagtgaattacatctccatgtgcaactgcctagcctataacatgaatgaactgagcaccaatgcctctgatcatagcgtgcatctctccagttcacctgtcaacagctgagattggtttcgatagggacctttctggtttgtatttgtgcacccccagaatgtgagcattgattgattcctggtcctaaaggttcaagtccaagctccaaatgtatcttcaaggttgtgttctgatctcatagtttctgatttggtattctaaacgtaacatggattgacatttcacgttcttcttccagggttgacagaaccaccgatcagaggatacaacagaatgaaccgtttcttttgaaatttgatcatttaggtcatgacatataacgtgggtctccccttggagcaccggataccctgtctgtcctcactcgctgggcctgggcatcaccatgtgactgaccaccagactgctggtgctgtgcagtaactaccaactgatagatactatcacacagcagtgtctttggcagatagacagcgagctccatctccatgtgcagctgcctctcctctagcacggacgcagcatcaatgcctgctcagtcgctcagggcatattgccgtgtctccctacacggatacagatcaagcatgtctcgtgttcgtgtaagggtcccagcaagtatcttcgaggttaatgctgatgtcgtcaaggatctgaacatggctcatattat

SEQ ID NO: 1519 - DNA, 1390 bp, Zea mays
  misc_feature (1)..(100): optimal_loci_42936_G1, chr1:253146989..253148378, Cluster 9
ctcgtcactatagctgatggtcattcactctaaaatgacttagtatttatttatagcagtatgtaactattattattatatagccagttgaatttaggtctataataaactttatttagagatacaaaagctaataatatctttaataaatcttgttagaccttcaaaagtttaaccgatataaataagaagcaagggaacacgaatttactttacagatcaaaagcgggggttacggttgcacgcgcatgtgtgataggtgaaggatcgcttgcagggttggccatccatggaagacaggttgtacccagagctcgaccctggaagcttgtggaagtttcgcagtttagcagtgatgatacttgagctgtttgtacacgccaacgtcaagaagtagagggagagcagaggtgaacatattctcgtatccatccagggcactgcatcttcttattttgaggggcttttgaaacacgtatgtacgcgtacacgtacacgtacacgcacacgcgcactacgagaggaaccgacgcgtcctcgtagatgcaggcaaagcagactgcaaagacccattgacaaacaacaaacagcagtgtcagatggcccacaagggatctagcccatctggcccgacctatgcgggaggcctagttgctgagctcacaggtagccaggccggagagaaagtagcaccgcaaatgttgtgaaacaatctccaagctgacccaaccaaaccattatagctgttgccccaaactggaccagcccattagagtttcaagtttattcccacgttcccacccagaccgtatcagcccaattaggaaaccaaaccagtaaagcaggttttggcccaaaccattaccaacctgtgtgcgcgtttcgcacgagagaaatatacgccatgattggttcaggacttctggtgcccaaccgtgactgtatgtaatataccatgtttgtttgattggtcttgtttctcttctgcaaggtctagtacatattttaattagttggctgggtgattaaaaatgccggaaaaaataaaaaaaaattcatatagcaagtgagattgggtttgagtgcggttttggaatagcactcgtgggtgcaatcagggacgacattagctagacttcgctattgtgattgcgggcgggtttttgctttacccgatccattgtcattccaatcgggtagatagggtgccaaccaggtgctaagcgctcaaaaacataaggtgtggattttaaaatctatgcccagtgttacccttctctaggagtaatggattatacttttttactaatagactggtgcaaaagcaatggtgttaaactaaggtatgactttaagggttcatttggttaaaaggagaacgaatttccct

SEQ ID NO: 1520 - DNA, 1246 bp, Zea mays
  misc_feature (1)..(100): optimal_loci_42938_G1, chr1:253148940..253150185, Cluster 9
aaaattccaccgtacggcgtactacgcccgcttatgcctcgtgctcatgctgcagatgcacggagaagcagcggctgcgcggctgtggcagattgacgccggcggcggcgtggcttcatcactgatcggcgcggcggtctgtgcctgctctcctcgatcgcaacgcatttcggcgaggtccagaacacccaccgttccattacggatcaggaacacgtacgggcgggatgaacactgctctcctcatgctgcagtcgtccatccggcagccacggccaccgcccgcccgtaatcaattagctagcgacgcatcggccgctgcttgctggtgcgtgcaatgcacgtacgtgtgggtatgtagttgtactaatagtctactagtacgactagggtgtgcgcgcgcgcgtgcaggtgcagtgtgcacggagcgggtccagccaccgccgcagcggtacggaacgcccccgccggccaaacggagctagaagaggcgccaacgtacagctagcagcacctgcaccggcaccataggtaggcatgcactagctaggcggcacgtggtccaaacacgccgcacgacacgaatcgatgtctttagacgatgacgatcgacggcgagccacacacacacacaggcacgccaattggcgacgcacctaccactccccacggcccacggtgccatttaaagcctgtcagtgtcactacacgcacgtactcctaccaaaagatcgggttgcttcgcgcgtcgcgcgtggacaggattactactaattaagaccgtggcctacatacactgaccctgacgactctattactagtatgtctattgccaatcattagcgcaccgcagatgaattcaaatgcacgcaccggccggcaggtgatggaaaccgacgtactatgtacactgtgtgccccttcactagtactactacgagcaattgtacgttagtattacactaagctaaacagtgctcgaccatcatgaccaacctggatcggctaagattaaatggatatggattgggattgcacgtgccggataacatcatgggtctgagcatattaattagtaagctttcgacttaccactacatggtactgctcttaatttattctaaaatacgtataggtcatgtttttcttatttcagagataaaatacgtacggtttagtggtataaaacagcgatcggctgatcacgtgtgtcgccactggccccatgcccccatccaatcctata

SEQ ID NO: 1521 - DNA, 1199 bp, Zea mays
  misc_feature (1)..(100): optimal_loci_44649_G1, chr1:262184424..262185622, Cluster 9
tactctcatcttccaccacagcagcacaatcctcagtggccccttgttgcttcaccaccacctcctggtcttgggccacggctgcccccaactcatcaccaggtctctgtctctgtgccccctcctcctgaccacgcgtcgggaaacaatttctgttcgcagagcgcccatcaacagcaagaccctccttctcccgactgtcttcagctgtatcccacccttcctcggccggtaacaaccctagctcctcctcccactcacccgcgccacgcccagcaacctgatcatccccgtgctgccgctggagagcaggcaacgagggcaggtggaggctgctgccgcccgaggccgcgtcggaggcaagggggccgtcagaggaggcagcgggccccgcgtcgagtaggagcccgaggcccacattggtagccagcgggttggggccggagaagcggccgatggcggcggagagggtggcggggagaggaatggaagcgaacagcctcctcccgaggccaccgccgctgccggtagcggtcatggacttggaggcgggcttcggcgagcaaggtggcggatcggcggccaccgaggcgtccttgaactcgtcctcatcctccaccccagccatggcagcgtcggcagcggcgacggggccagggacgggggcgagggccgaggggtggagtggaggaagggagggagaagaaaccctaaaccctcgatcagtctggaagctcttcccaaccacttcgctcacctcgttcttctgtcacccacttcaggctttctcctcgttctgccctcgtggcctcgtggccctcgtccttgttggttcctgttggttggagacttttgtgtttgtgtatggcaaattggcaatcgtggcctcgtggccttcgtgggggactgggagtctgggactctgggagggtgggccccatgagctgtgcttgtttcgagggaatctgtatacgtccatttctatggaatataatgttgatcactactagtacgagattggctttggattgattgcgaacgcgtgcatcacatgatcagctgggaatccgggtccttttcaccgggatttggtagtggagtacctgggagcaggagcatgcagtaccaggattggaacttggaagtccttggatgcgtcggtttcagtttttttttcctgattctgatccccgtcccgt

SEQ ID NO: 1522 - DNA, 1145 bp, Zea mays
  misc_feature (1)..(100): optimal_loci_46254_G1, chr1:271001437..271002581, Cluster 9
aggaaaccaaaccagtatattcagctgcgaaaatacatagagagatgtgtgctcactggcagtcctgctgcttgtaatgatgtgtcaggccaactggatttcttggcaggaacctgcacaacacatgaacacaacttgcaggttgctttgtttatcaattgctagcacaatttggcggcttggttccacagaagctgcagcaattggctgccatgttttgccctagttgacagttgaggccacatgaacacctcattaccggccgggggggatatctatctagggcaaagtgtgatctgggtgggggatgccaaattggcaaggcaagtggggagcatggcaacagggcgactactgcagggtgcaggtgcagggctgttgatcaagttggccctcatgcctgggctcttggtggtgctcagggaaacgtcgatccatgtgccaaaagagaatcagtgactaagcatgcagctcatcaaggctgactggacgtgcattattactgaacaacctggaatctatacaaagacctgctgatcgatcgattagcaagttgttggtttctgactaattagaggattaaagcgagaggacacaaatggacagggacaatgatcaagatctagcgagatctgtttaggatggcgcgccgccagatgcttctttctcgaggcttgatcgacgcgctggcgattcacgcatgcagcacagtctcggcatgcattcagtgtagagctctggtttgctggggtacctcgcagtctctcagattgcactgtgcgtacgcgcagtctcaggatcttttttccggcaacatcatcgagctcaagattctgtggcaaataaacaggatatttaacaagcagattggaagcttataatgcctaacattgttgccttcaggatacttgtttttcgaggttgaaacttgtcatcggtagcccaccagaacagttgagacacaaaagcacaggagatgtatcgtctagtagtagaggtaaccacaattgtaaaatgattggaagtcaaactaaggctccatttagcacgactttgggcctgtttggatcctatgatctaaagcaactttagtcactttagaagttaaacatctaaaatgtaaaagctaaaagtgactaaaatga

SEQ ID NO: 1523 - DNA, 1011 bp, Zea mays
  misc_feature (1)..(100): optimal_loci_46393_G1, chr1:271761348..271762358, Cluster 9
gaggactcttacactcatctcgtcgagctatacatggactaaccagcattattagccagaaaataatgctcacgtacttgtgtacatggggtggcttacgttcttcgagattaggaaaaatggcacatgttttaattcgcctcaagcgtggctctaaagtgtaaaggctgatgtcaaattaattagctggctttacgttgttcgaaattatatacagtatagtgcttggttaatagtaagccggggtgatctgaccgggtcacatgaactttggaaaagttaagtgcagggggttagtagttgactgattatcggctcaccaaaccaaaagtttagcagcacgcgtccccacatgtcgctcctctgtcggataaatgttcgcgcccgcgttcatttggacctcgacgtgtagtagagtcagagtcagagtgcgccagcgccagttccaaaaaaacaaaacaggacagaaagagtctctctggttttcagaacgtcggcatgcagtcgcctcaagcttcaaatcctcaaccaactcgcaaccgaagaacgctagctgctccaccctactactaccactaccgtcgaaggggatggaaaacgtggctttcgatcgcttaccggccgttttcctagcgtcggtgacggcgcatagctgggtgtagactactgcccgctttcttcttaaggatcgagtagacgaccgcggtctgcgcgtactaactagctcgtcgtcgctgtcgtcgatcgtcccggcggccggctggtcgatcggacagacagtgcagtacatgcatggatggcgcgctgcgggtgcgggacgggaccatcaggatcgccgattacattacacgtcgaccaggcgtggcttagggccacacccaccgccgcgcgcgccaccccaacaggcgcacctcgtcacatgttcatcgggggggggggggggggggggggaggcggccggagaccgtaccagacctgacctgggtacggcaccggccaccgcatccatat

SEQ ID NO: 1524 - DNA, 1041 bp, Zea mays
  misc_feature (1)..(100): optimal_loci_46407_G1, chr1:271778543..271779583, Cluster 9
taggggtatttttattttttgaaaatgaataaaacataacaaaggtgaacttttaggtcctggtctgatcagcaagagatttggaatccagcttttacagtctctaggtaatccatatgctagcttttggtcaattccccttatgaagccgttttttttttcagtgctgctttataatccacaaatctgcaaagtagcttttactatttctactcaatccagatgaaccccaatggagtgatttatttacaaggaattttaactcgaggtcgaatcttatccaagaaactacttgacgaagggagtgattataatttgtagcgtcagatttctcagtaaatagtttgcacgtcatgtatttttttaatgtggtagtaaaattgattatttagattgactttataacaaaactaacgccttttttttttctcagttcggatcagagcatgtgctactgtattttagtgcttgtgggcgacgtgcacggtgggctcctcccagcggctgacggcggtgtgcgactggtcagagatacagatacgctcggcccagcgggcagtatggcttccgcggctcccctagcctcgtcacagtcgcacgttgccggcaggcaggcagcgccgagagcacactgccacgcacgcgcccatccgtgtcggtgctgtcgcaaccccccgacgcgcagagctgtgggctgcggcactgttgcctcgctggctggctatcgatcgccgttgggtgtgcgatgagatcgccgagacggcgacgccccggcgcatgccgccgcgctgacgccgatccgaccgcgcccacgacgcgggcacggctgcccgcgctactttttcgccggcttcctgcgctccttcttgccggtactgacttgtactggggacaggccagcgccgaccaggacgtgggtgctactgggcgcggatggtcggctctgctgtcatcttttcttctgatggcgatgacactggaacgaacgagagtcgagagaagggtttcactgccgtgtactagtctatactagtctattat

SEQ ID NO: 1525 - DNA, 1369 bp, Zea mays
  misc_feature (1)..(100): optimal_loci_46525_G1, chr1:272336364..272337732, Cluster 9
tggatttcgataattatagtaatttgattacatttccgcgcaataacatgctcgagccttcgaagcatgatgataataacatgacgaactccacagccgaaacgctctatatcagtgtcctggctagggctacggaggtggtttcgaagctgttagctctagggcaatgacgatgaactcctcgccgaggacgccaccgcgcggccaccagggacgagggcagacgatggaggggcaatgcaagcaagacggcgggctgcttctttgaaccggtcggtgcgagcggcgggcgatggaggaggagagcaagcagggaagacgaacctgcagttccaccatattattatttactgtacgggtggcggatcaaacgtaaaatagtctggagctcgtagatcagcgtcatcctaattaatttatacgtagtatctctgttagcttagctaagactcaatataggatactctagctagccttgtcttctcaaggcaacacggtaaaacaaatgtacgcatggagaagcacgaaggcaacatcgagagatgttttgctcaatgcaagtacctagggagatgtctccctagctaggtactccccggcctcggtctagctaaacggacccaactatttggtgaccgtgctattaattaattgagcgaggttttacgctaccccaccttgtagagatccgtatagctagctggtgtgggttcggattagttcgtatccttttgcgtcggccgggcgtgcgcggaacgcagcgcacggtcacggtgtcatgctgctccacgtgccgctcccttggatcctacggatccgccgcgatgaaagcaagagcagtattgctaatgctcccccggcccgctgcgctagctatccccccaccactcgtcgaaagtgaaaagggcgcaggagattatcccctccgtccgcgaggggtacatacggagatacgtattatgctacgagcggtacactgtatacacgcagtacggaagggaacaatacatacggtatcgtacgtatgagtagctcttgcctagcccaagtctacggttactggttcatgggcccacgtaattaagacagaagccggagcagtaaaagtttctccaagcgacattattttacgggccacgcacgcactcatggagcggtgtactagtagtactagtcaatttccggtttgctgcacaaatcccaacccccgcggggaccacgtcggaggaagaaggaaggaaggcgggaccgcacgcgagagagagaggcgaccggaccggacccgaccgaccgtgagaggagagggtaggaggaggaggcgcacggcacgcgtccccgtgtaaacaagccgagattcccatcccctctc

SEQ ID NO: 1526 - DNA, 1367 bp, Zea mays
  misc_feature (1)..(100): optimal_loci_46709_G1, chr1:273335641..273337007, Cluster 9
ccaaacatggccttatggcaaaatcaagagaagtgtatgtctttgacatttttttacatgcaattgttctatcagttcacaagtgcatatgtgtgagaagctccttagctgggcaacaacccctccccctctgaggtcatacgtggtcacatcattgctgatggtgatcgcattgcagaagagcggcacgaaccgcaagagtagattagcagctcgttagcaacagtggttgctctggagtagtttgtttggggaggtttgaggtgtccatagcggtcggcacgtgtggccgatgacaaaagtcgatttgatgggagaaaagaaaccgtcaagttacgacttgctgctgaatgcggacaaccaaatgacacattgcagcatcgagctacaactacaaccaatggcatactgtaggtaccatcggtctaatttcatcaaagacgtcgtctataccttgcttcatgacgatccaatccacggatggatggataggaatatgtcgggctagcttagcttggacgtgttagctatataggatgccgcgtgagccgtgagggatcgacgtggtcgtgagctccgccgcagcagcgcaagcgcatgtgcctttggcttggccttgacacgcgcccgaagccggcctgcatgctccgccgcctcgcgctcgatcccgggggaagggagtggcgcggccggccgcggcaacggtaccctgcctgcgcagcgtccgaggcagaccagaccggccgccgccagaggccaggcaggaccagtccaccacgcgcgtgggaaatctcatggccttgtcgtgtgcatcgctgctattactctcccgaaaaaactatcgcagctggcaccaaaagttacagccgggttacaacctagcggccgcctagacgccggcgcgcacagtcacatgccatcccacccgcgctctctctctgtctctcacctcttcttcccatgcatgcagcaaagcagcagccagcatgcattgcctcagtgcctctgccctagctgccgtgcctgcggaccgacgacgtcgtctgtcactgtgagacgctgatgagtcatctctgattcgtctcctctcctcgcacgcccggccgggccgcgcgcgcgtgtgctgtgggcgactgccgactgtaaataaaggcggtaaaactagacccggggcaatgtttttacccaacaacaacagcagcagcctcacgcaccgcgcgcggcggctccacaggtgagcacggccgcgtcctgccctcctccgccacatgctgccccgcaccacagtgagctcgactgcgcgccgtcgccgaggcccgagggcgaggacctccgcgcggctcgatagtcggggtcgagcacgacag

SEQ ID NO: 1527 - DNA, 1044 bp, Zea mays
  misc_feature (1)..(100): optimal_loci_4721_G1, chr1:24212305..24213348, Cluster 9
gcctgacggctccttatatggtcgataaaaacggctcttccgccgccgccgtctgcatttggtggtgctggtgcttccctgttggttccgggcggtgtcgtgggcaagatcagagtcagagaggccgtccgagacagcaagaggcatgccaaacaggaccctgcatgtttcgaacggtaaaaaaaaatgcaaatgctgcccaggtttcgacgttgccactgcagtacctgacccgagttggggagctatattccaattcaggacacggaaaggacgtctgttcacgggctccgatgagatggggggctgcaactttttcggcagggcgatacgagcaggctgcaggcgagcggtggtgcagggtgcagatctgctcggtcgcttcctgctccatgcgtcattctaggcttttttttttctctctctctctaccgtgccacggcacagagcaaagagacagagagagaccaacgatactaatcacacaccgtgcatgtcagtcaccatgcattcaccgactcgcgcacagtcaaaagttaaaacgcacgacgtgaaaaccccttgtccacaccaccagtacgtgcaccacacctctgggtcccaggcagcacgacacctcgtcgcggcgctgtcgatatgcagtatgcacgctgtgcagtgcagcgtgtctgcacactgccgttcgtgtactgtctagagactacttgcatgtacagtacagctccgtccgtgttgcccacatcaagggccaagccataccatacataatactatatggtagagggcatataagcaacgtacctgacggctctgtgggtggtgactggtgacaggcccgtctcgctcgcgtcttgacgtgcgaccgaatcgaaagcgcggccggggcgcattccggattgggaaacaacgagctttctgcgaggtccgccgctagctgctgtcttggttggaaatgctcggtcgggtcgtttttttacgtgaaagatacaagtcgatcgatcgtctcgtcacgtccgacgacagccgcagaaaaagcattcgccc

SEQ ID NO: 1528 - DNA, 1131 bp, Zea mays
  misc_feature (1)..(100): optimal_loci_52572_G1, chr2:4290711..4291841, Cluster 9
ggtggtgtgatactgaagtttaattcagtactggttgtaaataaaccggtattgatgacctaggatgaaagctagcactaatcttcaataatcgtgatcgcaaaaaaaaaagaactactatattatttctctcattttagtttttgtcttttaatttgtttttcgctgtcgtctatttcattgcgacagtgagcacaaggttgtagagacggtcaggccattcgacgacctagggcagtctattgtcaccttctttgtggcaggtccctcctaggagcatgcatggtttatcgggcttcaaaagctctcgtcggcgtatcttatatatatatatataacgcaaaatggtcgtctctacaaattgactgaccagagatgatcacactgatcacgccaccactaatgaaagaaaaaatgcataacgctgcaggccatctagcgtgattgttttgcactgttattggcaagtgcccccttttgtgatgtatatagttcccgcataagacaaactctagcaaccaaaatctgattgggacaaatatatgtgcatataacacagtgcagccaccgaaaccctatctgcatgcaggttagctaccattgagctcagctggtttcagagagccaaaccacgtgcatgaacctgcaccctgctagctgctgctctttccgagcctcctgctggtgaagcaaaagtcagggcaacacagtatcgacggtcagttggcttaaggaagaggtccacaaaatctctatcatgcagactggggggaaatcggcccatcacgcctcgtagctcgatcggacgccgatcgagttttgatgagcttttgtgggtctgaattctgaatctgatgcgctgccatgcatgcatgcatgtgtagacggagcttttggcatgcatgaacaaggacgccttgttcgtcctgcgccattccaataatttgttcggccgggcagcttttgagcaaggtagggtagggtagggggccggggacccccgatcgatgatccagtactctcactcttttactcgctttcacgggtacaagcatgtgcatgtgaacaatcaagcgcacagaagcggtcgttttgccagaagatctagctgagaatacggcgcgacagcaa

SEQ ID NO: 1529 - DNA, 1176 bp, Zea mays
  misc_feature (1)..(100): optimal_loci_52758_G1, chr2:5290113..5291288, Cluster 9
gtttcaactttttttcgttctaacgagcttttttaaaaaaaatctggttgaacggagaatataggaaaatgaaggcctcctcctcggatcgtgtggctgtcgccccgggagcagatcagaaggcctggttgttccgttccctccccatcaggctctcgcacaattagctgtcccacgttcattcgcgctgtgacaccctagctattcttatggctggctctgtacgtactgtctttgactcgacgcctgcaaacacgcgccgactttgttttgactacattcccatgtgatgcgaacatgcgatgcagagccacgacggactcgaggccgtcgcgaggcgccctgcaagagtcaaacgaacgaacgaaccgggcgatcttataaatgtgcgtcaaacaacatgcagtgagcaggaaggagctcgcgccgccaacggcgaagaagatcgccggagccactgactgggttgttggtcgtcctctgtgtggctctgtcggcgcgcgcgggcgtcaaaccgactagtattcgagttcaattggtccacgcctaccggacgctgttcctactatcgtatattcgtatactagtatatacagtacgtacagctgagttggcacaggtggccagatgggaatagataaaatacggctcagaagaccgtccgagaagaatcatgtgttgttttcattagctagctcactaacaaacacgcgcggttgctatatcatcatgactcgctgacacatctcaatatctcatggatggaagtgtcacagactcacaacttcctcgttcgaacaaactcgttttaattttttccccctttctttcgtcaggaataaaattaaaagtctattgtcctcgttgtacaccaaactaatagttcgtatgactactgaattattggctggggtcgcttatgcattctttattattcgcatacgtatacacatatattttttccccattggatcacgagtaatctgcatatattcccttctcgccaataaccgaaacaaacatataagtacgaacacgacgggtcaatgtgtttgtttgaggcaaaagtgggataagtcgggggcgacatcgtaccctcaattttttggaatctcgctgccaccaaaaactatttctgggtttacttcgcccctacgggactctcatccaaatatt

SEQ ID NO: 1530 - DNA, 1092 bp, Zea mays
  misc_feature (1)..(100): optimal_loci_52821_G1, chr2:5557796..5558887, Cluster 9
aggccctttggcgcatggtatccgctacatttcccctcgacctcaacagaggatagactttggaaatggagatcctattgccactgccctcccctccccgcactagcagccactccaagccactagctcgcgcgatcgaggttgaggtatcagttcagtaccggcgccgtagccccactagtacaacgttattgtccacctatagctatagcctctcgtgcgtgtggtccagcgaggcgaggtgaaggcctggtctcgggtctgccctcccctcctttttgatctgcccatgccgcccggccggccagcgacacgtcgtgttggccgtccctgtgctgccgccgctggatccaaccccactccagtcttgcccgcacacaaacacatgcatccacggccgtccgcatacgccgtcgtccactagtctagtcctcgctagcgaacgaacgtgcatctgcacgtacgacctgccgacgacgtactaacctgcgtagcatagcacatgcgcatcagctgctgctggccgggcgggcgcgggtggctggcgtggcgggacaagacccgaatccaggcgcgcgcgcgcgggggccacggcgcgtactggccgatgccctggacgtcgcgagggcaggtcctctactggccaggtccagctccagctcgccctcgcttagattttgcatgattttgggtttggattcgtccgtcgcgggtaggaaagccggccagctatccgacccccccccccccccccccccccccggagcggcggcgctcatttgcccacctactaaaaaaaagaaagcaattatcgggactgtcatgttgccatcatctgccatcacagataaacagaaagtatcggctgcggactgcgtagctataaaccgcgaaaccgtgcatcgtcgttcgtcgatcaggctcctctgtcttggccgagagaccatcgaaacatcgcccaaccagcacacgagacggcaattccttcttcctggacccaaaacgtacgcggtagctcatcaacccgtcacgtcttttctctctctctcttttttttttgtctttggcgaggcacgcgcggttgaactgaga

SEQ ID NO: 1531 - DNA, 1201 bp, Zea mays
  misc_feature (1)..(100): optimal_loci_53447_G1, chr2:9098834..9100034, Cluster 9
agttttttcttcacagtaatcacacagcattttactgtttgacaaagttatcctgatccctttctgcgctgcacgagtagtatagtaagaactgtacggcggacggagattaagaaagctaatccctttcctggagatgtgtgcacctttaccacaccccgcagtccaaagctccaaactatatactctcccgtactagtagtactacagtatggtggtcaaacagcagtccgcgccgggccatctcatctcatgtcatcatgcgccagtcacgcacctttatcctctcgttcgttttcggacgctgcatgcctgcatggcaggggcagccattgactatggaattgaatgtacttttgtcctcactccccgcgtctgcagccggcatgctgcaccgtgtcacgtctggccaggccgggtgacctcatcaagtgggattttgtggtgactggccaaggctctcgccggtgtactggaggttgcggaatccggaaacgcgatggagcggcgatctgtttcccttccctctggctctgagtgtggaggagattgacatgtgagtagatgaggcatgcagtccccctgcacatacatacgtgggtggtacgaaagccttgcgcagcgcaaggatcatcccaatccaatgcagccagccatgcccatgcagcagagtgaaatggaacagacatgaccacgatgaatggctgaatggatcttaggaccggcccggccgctacaaataaatgattgactgtttggcgcacaaacccacggcggcatgggagaaagacagactagactgtctcgagcgcagcagagtcgtcgaggcgaattgcaattgcaacagccaacaggttgggcggcacgcttttgtcagcaggtactctagtgcccagattactggtggtagtaagcacgcacgcacgctgtagtgtagtatgagccaagtttgggcgcattccgacgtagtacgtagtatacggcaagggcgaccgttggggggctctcggtttgaggaattccgtctccccgctccgcccgagcagtagttatcgcgttgtaattgcctccctggaaagagaatctttttttttttttttttgtttgtactaggggggcaccgcactacaatacgagcgacagtgtttctttggcccgcatgcacccaccaatcatgggtttccgttcggactcggtatgg

SEQ ID NO: 1532 - DNA, 1214 bp, Zea mays
  misc_feature (1)..(100): optimal_loci_53522_G1, chr2:9369121..9370334, Cluster 9
acacgcacaccacgcatgccagcgctgttgttgcctggaaatgagcagatctgcatggtacgttgtggttgcctcctgccgctaatgggagagcgcacacagctggctaggctagctgtggcacgacgactcggccggccgcccgggccccagcgcggccatatgcgttgtgcgtgcatgctcctgccgcgctccactcgatccctccggccctgcttctcgcgtgcgtgcatgcatgcatgcatgtatgtgtgtggcacgttcagtgaaagccaggcggggggctttacgccccggttggggctcaaacgaggctacagctagctggctgctgaatcggccctcctgctggccagctgctgcgcgtactacctgggaggtgggagctagagagagaagagataggagacttgatgggtacgcatctgcccgcctgttgcggtacaacgtataggccgggcccgtgcttgatgggatcgggaaaaaaagggggggccggggggcagcctcgctcatggcacgcatctcattcggcctcatcacgtacatacatacacccaacacacagcgtcgcatctaagtaagccagagccagctacgcaaatatgccgccacgcataccatatcatcattatatcatcgcgcatcgcagcagcggtacacgcgcgctggattgtggaggtggtaccggtgtacgtacgctagtagtagccatatgccatgtgacgtgccataatgtagatctaagcccgccggccggcccccttttactttctctgctgacagggttcactaataactaattaataaagcgcggcgtgcgacgtgtgaacaaaaaaaaaacccctctgtgttagtacttgagtacgtacgtacgtacgtactggtgctgcggtgctgccatttccctgaggaccaaaaatacgtgtcggagtgcgtacaaacggcagtaccaccaaacttttccgccacgtagatgcccgccataactcacggataacgactctctctctctccatgcctgttttgctaaaccggcggctaggcaataccgctatgcatggtaactagtagagtagtacttagtatgcattagcgtcccaagtgaagagctcctcttgctatgctaaccgccctgtgcacacagtaccgctagtagtgtagtgtagtataggcgggcggagtggctgccatgccatgccaccatactctac

SEQ ID NO: 1533 - DNA, 1037 bp, Zea mays
  misc_feature (1)..(100): optimal_loci_54064_G1, chr2:12137873..12138909, Cluster 9
ctcgagatggacatcgtcgttgggcccacgtggggtgcaggcccgtggcctatgggcgctgggccgccggccggctggcctccacccggcgccgcttcgggtgagaagtgagaacagctggagcacgacgtcgaaacggcctcgagttgatgcaacgccaagttattccgtctctcgtcgtcagtcgtcacacagtactacccggaacttttttgtcctacaagtcaacaaaaaaggtaaaggtgcgtgtggcaggcttcgatgccacgaacgtagagtcgctctcggcgctcctgcagggagcaggaaagcaacgcagtcctgtagctaaggttcgatggggataggaggagcatggggatgggagttgctgtgtgcttcctgtacagtccaagacccgacgacttgctttagaaccaccaccaacttggtacgtgatgccacaaacgcacgctaacgaaagcggtagaaaaatctcgcagaactactaggcaattgtaaaccagtgatatgcctctgtccgcagccggagcggaagcttgcctcctcccggtccatcacctgtaccagctgtcctacgatgcccaaccagcggcgaacgccttctacacgcgcccggcgccccacatggtcgcggaggcgggatacacgcagggggaggggcccgtcccccgtcgcgtacaggtgccccgaccggcgtaccagcgatcgatgaggtggccatggccatggcgtacaggtgccccgaccggcgtactggaccatgctaatcccacatggtcttctaaataaaactttgccattgcccgttatctgctccctacgatccattacccgcctgcgtcgcagatgttttcgaggcgcggtgtatagaaactagaaactggcaaagggaagccatttctggagaagaaataacacatgctgctgacccctgactagccagtcagccctgcttgatagtgatataccttgcaatttgaatatgtgtagggcccgtgccaggtccagctagcagtagtagtactggggtagca

SEQ ID NO: 1534 - DNA, 1152 bp, Zea mays
  misc_feature (1)..(100): optimal_loci_54319_G1, chr2:13554993..13556144, Cluster 9
ggtggtcgatgggcagcgcggaggcacgggatcccgccgtgcccctgcgcgtgacgctgccgtaggcaacgccgccacccacccaccactggccgcccgcccgccccccgggaggcacgcacacgcacacgcacgccgaggactttctgccgccgcgtgatgtcactcgcctcctgcctccccatccgtcgccacggaacggagcacatggacacccggttcggcctcggcctcggcctcgcacccggctgtccgtaacgtgatgtcaccaggccggccccctccgatgggccatggcatgtagatactagtacccgtagttgtggatcaactggctgaagaagatttggatgtggattggatcgaatcgctggcgaggcaagtcatgattccggggggtaggatatttgtggagttctgctggttttgcccacggcgaaagcgacggggaggagggacaccgccgtacttgctcatcggttccttttttttcccgcgaagcgttcggccttcggcgtacgagcttccttccctaccgaattctgccaaacaatggccgaggatcggggcccctcgacgcgggcatccctgctgtggtggccggtgttcacgagggcgtacggttcgtgctcactgctcactactggcactgcctcctatcctcctccactccagttcgccgttataattgagctgctgctgcctagtggtatcgtgagagtgagtactgccctccccccaccccactccgcttttgatccgaaggagaatcacgcgacaaaaaacaagattttactaaaagagaaaagaaaaataaaacaggcgacaacgctagctgcgtacggagcatccgggcacgagagagattctgagcaaatctcacgcgacgacgagtgcggccctggctagcacgaacgaaaggaaaagggcgtctgtcgtcgtcgtcgtctataatgcaccgatggacgcagcacgaatcggtgccctttcgagcggatcagatggaatggaaccctaacgaaactcccaccaaaccacccttttttattttattttcgcggggcgctagcttttcctcctgttcatggcgcatcatcgagatctatcgctttcgtcccagcagcacggttcacagggcacaggtctcgggtt

SEQ ID NO: 1535 - DNA, 1319 bp, Zea mays
  misc_feature (1)..(100): optimal_loci_54857_G1, chr2:16632574..16633892, Cluster 9
ttggtactaggatcacgtacacagcgggagactggtccatacatgggatggaatggatcatgtggtgatcgccgacacgattaaaacttttgtttttacttttccggacgggtgagttagcgcagcacgctgtgcagctgaagaccagagaaacgtgcacggtcgccggtggcgctgaatgtttcttcagaaggaaccaattcaccggtccagcttcgccgcaccaaggacgaccgtgggcgtcgtggcggccgcggcccggccggccgtttcttcaatgacttcgccccgcccgcgtgtctgccgtgccgcctacccccgcccggggccggaggactggacgtaccaaccacgggtccacggcggatccgaactttcctgtccgaccggggcggggcggcaccggtgccgtgcatgcagcaccgcgcggcccagagccatccacttcgcttcggctggcagtgtcgaggcgtgacgtgacgcgggcaccacgcaccaggccgccttttgcccccactcacccaccacccgcggccccgtgcacgggatcggattcgcccggtgctcccccgccactagacacgctccccccggggtcacgatcgtcagcccgcgtcgcacacctcgcgccgcgcggcttccggtgcgaaacccgcccgcccgcccgggcgaacgccgtcaggctggcggcgtgcgtgcgtgatttccctttcgcctctggccctctgccctgttcaaaggggaagccgagccagccaacgcgtgactgccgcgcccgcgacaaggaggtgcacacgtaactggaacgtaccgggggcgggcgacgagtagagtgtttcgttcgccggccgcgccgacggatcggagcggattgccgtgccagatttgaccgcgataattaatggcagctagtgttttaggcaccagcctctctgcctgcctgcctgcctctcgcgtgcgtgcgtgcgtgcgtctgcgtcgtagtcagccgatacgtctcggaacctgaaaccagtcgccggaagccaatccatctgactggccagctggggcgctcgtgcgtgcggtcgtatcactccactaggaggaagccgttccttcaagtgttctcccagttgaaacttgcgacaaacccaaccaagtgacccgcacgcacgcagtcgcgacgagcgagccaggatcattcacatcagctgcatgccgaccagccgtgtgcactggagaacggaggaaagacggtcaattgcgttcgatcggcgtcgccggcctttacaggtcggttggtcggcctccgtgatcgcgaccgcaaatgcacggcg

SEQ ID NO: 1536 - DNA, 1148 bp, Zea mays
  misc_feature (1)..(100): optimal_loci_55312_G1, chr2:18747830..18748977, Cluster 9
gttttaaaataaaaataaaaaaacctgggaaatttcaaaatggagaacttaagatgtccatgtcacaaagtcaaaaccgcataaggaatcggacgggaatgatggggatcgcgtggtaaattaggctctatgctatgcccccggccccccgcctcgtttttactggccgtggtgccatcagcgtcgagataaatgagcagctggcaagtggcaatctcaatcgagcttacgacgactactcgatgccatcagatttgttttataggaacagcgtggacttccctgtgcatccccaattcccatatgcattcatgcgcctgttatttcgcaatttctgcttagtttattgacttccttcccgatcgatgatctcatttccatgcatggtaacggtcagctaaggttacttttgcgcaagttctcgagcttaaactccacaatcatatcgataacaacggattaactgacccgtccgtctaccgcgtcgtatgggatctttgagctgagtgctccgtatgtatcgatctatacattatatatactgctccatatacattaactataccgcgtcgtatgggatcttcaagcaagcatctgctgtcgtagttattagtcaaaacatataaataaacagcctgcccatggatgaattatgacttgacccgaacgtttcacaaaacacggggagaacatacggtacataccgggcccgagggtcgtccaggccaggttcactgaatctcgataccgttaaggaaatcccggccgcccatccagagttttcttttttattcgatttgtcctaaacagaaactccatgcgagtcccaaaggtcaactcatgtgcttgtttgatatgatctacgactacgggaagatgcgctacgcagttagctagggatgcaggatactgtctccatctgaatcggtagtgaagatcattgtcatggcggtgccgccggtggccagttaggtgacctgatgtccatattaattagccatgtgactgtttgctttgtcgcacctcgcacgcgttgccagcaattaggttaggttaacgtttaagcagagtatgccgttgcaactgggggagagaaggatcgcctcctacatggtcctgcattcggccatcaccggtactgtaccccg

SEQ ID NO: 1537 - DNA, 1259 bp, Zea mays
  misc_feature (1)..(100): optimal_loci_5551_G1, chr1:28458733..28459991, Cluster 9
gttgtagtactgaagtagaacacttgtgcggggtcgtcgaaccaaagagattgaacagacagacaggcagataaggtttggccgtttgggctaggggcacgaattgttttgtcgggcacaccgtacgggcactgttgctccacgtggggctacaacaactagcggctggcgctgtgctctcgtggtgtggtcaccgcgtgagcgcaccagcgcagcgcccgctaacggctcgcgagcacggcactgttccggccaacccaacttgccgctgcgccttgcacccgcgccacagttgcacccacgcattcaaatcggttcatgcacccgcctggctgagcgtccatgtccatccatcattggcctggtgctgcggcccgcaggtggaggatgaggcggaggaccacccagcacgcaccaggcagcagccgtgtgcgtggtccgcccagtgccatactgccaagtctgctgccatcgcgagcagggtgggtggcgccggcgcgccagagccagcatcggtccaatcccgaccgtcatggatccatccaacggtcaggaaatcaagcagcgccggttgagtagttacggaggggataaggtggtacgcctacgctagcttggcattctcctgccggatcatttcattttggggtgggggcatggtttccgtttctagatgtgaaagatttttgctttcgtgaccagggagggcagtcggggacgcaatttaaaacctgccgctaccgttcctctccccggtcccgatcgctacctgggtgcgcgcgtcagccatcgccgtcgcggacgtcgcgtcgactgctgccacggcattgtctcgtttgcacatcgaaagggaaacggacgccatcgccatcgatcgttcattagcagctccctttccactgatcaaacagtaacgaagggcactcaagtgtcgtgccctggttcgaatcgagaaggatttttttgtgtgtgtgtgtgtgggtggtggggagggaggggcagacacgggagcgtgtgatgtgacgatgggcctggccacctggccgtcaacgcgggggtcagatcggttggtacaatgatccgctgatcacgacgcctcaatttctcctacagaaaattatctatttgacactggtaaaacctctccttctctacctatctatcgcctagcgtcttttgttccctgtttcagcactcctgtcacattcgtctagctgtagcgtaaaattccctcacaaagataaaaaaaacatattagt

SEQ ID NO: 1538 - DNA, 1373 bp, Zea mays
  misc_feature (1)..(100): optimal_loci_5552_G1, chr1:28460099..28461471, Cluster 9
agatatataccacagatcaaagaaaacaaccactcgacctggctctctcgttcgacggtgcgtctcgcgtcctaggccatagattgggccgtctgctacttgctgacggcggccatgacgcagtggttgtcgcgacagctagtctagtggcgatggcggtgtcaaagtctagcgtgtggcggcggcagtgcgccgtgtcgaaggtgccatggctggcgggcaccagatgctaaagtggcgggcctatatatgctatgcaccgtgtcggagcagttattaccggccgtcgtcagcacatgcatgtggtcgcgaacaccatgggtcagcagctcgtgccgagtgccgacgccggcgggcgccgtcttcaactgctgcgcctgcgtgctaggatggctcgccgtctactgcgccaccagcctgctctagatgctcagctctggctattccgaatcacgagagaagataagcagctaaaataccgagacaggttatttattgtctgcaaacaaataaataagattaaaaaatacacagcagcaggaaccacacatcaagctacaggaaacacgtacgagggtaccgtgggtaattggatttaacgccgttacgatcaaaactcatcagtgaacgaggattggatttttttaaatttcaggttcaaattaaatagggaacgagaaccttttccgctgtcggaattttttctcgtccaactgcgagtcccgtgggtgcgaatacgcacgcggtgagctacctacctacctacctggacgctgtaccgtttcaggcgtgtgtgggtgcaatggcatgccatcaggtccaggaacctctctcggttttgagcctgattacatgattcatctatggaaatcgggctcgaccggtgatcagtcgttgtctctgggagcatttgatgaggatcgagactctctcgcgccgatgggttcagataagattcgcatctcgcgtgctgccgttttcagcgcttttgttttgatttttccagtgtcagcctcagggcaagcaatatggcattctagctagtcatggaggatgggcgccagccgccagcagccagcaggtcgagagtacaccgtcgggcgtcagcatgtgcatcgggctgctttttgctactgttggctccgacaagcgcacagtgcttatcgtacaataatgtctccggatttaatccacgtgtcgtgctcttagccgcgagattagtcgctaccactgtcgacggtgacatgacagtgtagtagtacccttttttttcaggatattttgctgtggcatgtccagtgtcctcatatcccgaggcgcgggagtatttcgtttccctatgtgttggagaaggcgagaagcatttctctatt

SEQ ID NO: 1539 - DNA, 1137 bp, Zea mays
  misc_feature (1)..(100): optimal_loci_55855_G1, chr2:21801214..21802350, Cluster 9
cgagatttggtctatccttgattcgatcagcggggaatattttggcttcgctctactatatatgtaacaacaaagcgaactcctcgaaaaaattgtttgcagccttgaactgttggtggtattgaattgaaaaaaaacccaattatttcgctgagtccagacacaccaggacatgatgatagttatctccatgtagaaaggtactgatatacttcttttcatcctctcagtgatcttcagtggttgcagatgaactggataatggacaccaactggatagcgtagtaccttcaacatggcaacaagttcagcgccaagaatttctggagccattgatgagcatcctaaataaaatattggagccacagtacagacttttgcaagtagtgagtagtgacatactgacatgcatcacaaactgcttgcattttacagtggggattcaggggggggggggggggggggggggacaggcgcaggcccatgcccatgccttatcaggtagaaatcttataataatgatttccacatctctcatctgatgcatacatcatatcggctgctgcttttggagttggcctgtgataaactagtgtgcttagcttggcatctgagggagagtgatgctttgatccaaagtcagcatcacatgcgtgcgtgcgtgcccatggaactcgaatagctgggctcctccgcgcgctggtaatgtgagttattagctgccatcgccgtcccttgacagcatcaccaggggcggcatcgggcaataaacaaagaaagccatctggtggcttcttttctgcttgaacgctagctctctctccttcttttaaagtcgggcgggcatgagcggtttgtgacgtcgacgatgcgtccccgtagtgccgatcggcggcaggcaagcaagcagcaactccaacatggaagtgccggggaaacaattgattgccctcgctttcagcgtcagccagtgcatccgcaactgagttttttatatatgggtcgccggactgcatgggtgatgatgtcaacagattgatccgtcgctgcgtggcttcttctgacattgacagatctgctcccccccctttttttccaatttttttatggatctgtcattttttttttttttttttt

SEQ ID NO: 1540 - DNA, 1240 bp, Zea mays
  misc_feature (1)..(100): optimal_loci_57382_G1, chr2:30562307..30563546, Cluster 9
tctaaggtgctatagtaggacctaggagatgacaggatgaacgggacctctctacgaaagaaaagcagtagtatgtgtcaaattaagccactagcggggttccgatctgaaaatgagagggacagcaaaccatcggataacacaccatgcatgctttcaaaggcaggcagtattccaacacttgtacgcgtcccatgatctttctttgctatatatcccggcgccttgatctatccatccatcccctgatgcattttagtgggcattcaccaacaaacaaacctaaaccccaaggacaatcaactatcgcgtcgcagactcgcagcatgcatcaacagccgccaaaaaaaaacccggatcatatcgtatcgaatgaaaccacatctctggagagtcagttgcgtcgcaaacccgactccacaaagccgcagaagcagctgactactttgcgccaatcaatccgcgcacgacggcgcccaaagtctccagccgccgtcgtcgtcgtcgcgctcgccggccgccacgtaccagtaccaccaccaccgccggagacccagcgcggccggcggctgcctactatgtactactagtctactaatatgtaccacgtgccaattagcggccgcagcatgcaggagcgcagacaaacgctgccgggtgcccgggtcgcgcgggtctggatggcgccccgctggctcacgctcacgcggaaaggtgagcaaaagtggcgttgcgctgcggcgaaagctgtggggactcagggcagggcagggccgggatgcctgccgtgggtggccgtgagtgggggcgtggcgtcgatcgccccgctgccttttcggatcggggctcctcggtgctgggctgggcgcgcgtgcccgtgaggttgctttcgtccgcgctggtgaccaaacccatgctacacgcccccgtcgccgtcgccgtcgccgacgagctagctaggcctgtgatgtatccgacctgtgctcacaagcacgcatgccgtcgccgtgtttgatcgccgactgcggagggaaaaagaaaaaacccggttgcctcgttagtctgcctgcccgtgctctctctctctctctctctctctctctcgccagtcgccagtcgccagtcgccacagttttccgcgaccgctactagtggagactcaacagcaaaacggccggtgcaatgaacctcgcttcgacggccgacgcttgctaatcgagccggatagctaggtagctag

SEQ ID NO: 1541 - DNA, 1160 bp, Zea mays
  misc_feature (1)..(100): optimal_loci_5757_G1, chr1:29391529..29392688, Cluster 9
aaaggtcttgtaatttggatctcgagcgagcagatgttaatacatgtatttatatataagttgacgaattgtagcttgaattatcggaaacttgccttgtgcttctcttgccaactgctatactagtcgtttttgcctttttgcacagagggggtgcgtgcgtcgatcgtgcgtctgcagacagaagacaagcagctagcgtcaaacactattagctagggtgtttagttggaagaaaatagaccctggtcagcggtttttcttcattcatcaaatagaaaatacgtacacaataccctactagatgaaatacgtacgcatgcatggttggtggtacacaactggcgcgagttttaaatttccaatgaccgcctgattccaaatccctggactggacccatccaattttgtatacataaatgcgcttacgtcacagggaccactgagtgctagtacttgctagcacatgacacgggcaggcatctcgcgctcctgcggccctgccgcatcgcatctccaattctccaaaaatctgcccaagaattatttccaataacaaaacccaccgtaaaaaaatagccgagcctcgcgtccgtggctccgagaccgagctgcgatcaggaaacggacgcgcgcgcgagcaggtggcgccgcggtgcgatctaaaccagactgccggaccccgacatgggtttgcattgcatgcgcaggattcgccgcgcccgtgacgcgcgtgggcgtggcggacgtacggccccgcaccaccgccgccgctgaccgctggcgccgtgacacaagccacgctctcaactggacgcgtgctgctgctgctggtggtcgtacacgtgagttggttcgggccaggcgcacggtgcggccgtcgcgacgtgcaccatgcaccgtgggccagcaccagctgcatgcgtgacatctaatgttttttcgtcgtgtctgaaacgctgaatccctccagcttcattattccacccatggtttcatcggtttggcttcgatcctacctgtcgccctatcagttttcaaaaagaaggaaactgtgccagctagcgactttccagtactgaccccgccggtcggctaacctgatgtgtgaataccacgggcgctacgagttgtttgagtacgaatctatgctgtgtagt

SEQ ID NO: 1542 - DNA, 1105 bp, Zea mays
  misc_feature (1)..(100): optimal_loci_5791_G1, chr1:29549608..29550712, Cluster 9
ctacttactcctgtgcctcactattgagtggcatcgcggagcatcactaaaggaatatagtataattataacaataaaaaagaacactagtatcaagctggagatttaagacctgtttaggagggtttctctaggtaccaccctttcctacggtatccaaggggttagagctggtgagaccaaaattttctagtttgacctgcttcatttcagttcaattgaaaggaaagataaaaaaaacacagttttctgttatattctataaaatttcttagaagctaaagctattttagagaagatttctattctaaatggcgcccaaccaagctaataagctgtcgtcaactggcgtggctgccgctttgtcgcagcttggtcacacaaattccagcgggttggactcggcctgttgccctctttccacaccacctcacgctcacagcaactgctttccacatcggacaccgaaccctggctggctggctctggaaaatgagaggaacaaaagaaaaaaaaagagaacataggaaaaggggcggggcttcgggactgtggggcagggcatgttgcttcatcctgtgacacccttttccaatgattggtctggagttcacgttacacgcatccttgactgggctaaagaaatagtaataatctcttgtttggttggtctgcaggggtcctgctgcgttgcgcgtcgcccctgttcaccacatggcctgccggggatgaacaggcggaggcggcagagtaacggaacgggatcgatcgagcgatcggactgccggtgcttgtcatccaacaaagtgtgcgctttatgtgatgatggtacgtgcggcatgtaatctagggtaactttttttttcttccaaacacgatgttgcaaaatatatgtactctagtctagaatagactatattttctaacaaaacagatgcagctccacaggattatttgctaaaaaaagtaagattgtgagagcgtcagagttttttctggaaatttcatttttttgtgaagttgttctacggtgaaatttattcagcaaagtttgtgagcagtcccaaataaaaccttaattctcatagtttttatctttctcaat

SEQ ID NO: 1543 - DNA, 1182 bp, Zea mays
  misc_feature (1)..(100): optimal_loci_58039_G1, chr2:34670136..34671317, Cluster 9
gagttctcatcaaaccggtctaaaactccctcctctctctctctagaaacgttctttgaagttagaattcatcaaaaaaacgtactccgaagacggggtttaaaggatgtataacttggtacatctccacatatctattttgttttaaaaactgagattcagaaacattgcagattgattcttcaaaaaaaatgataaatttcgattgcacacgcagaggacaatctgatttgttttgtacgaaacagcctacaacgagttagaatttattcttcgcaacaaaatataaacctgtgtccatttacaagtttttttttaaaaaaaaactgagagtacactttcggatgaattttgttcgaatttacggcggtatttgcacgatgtttctatatacatatacacatgagtagtaggtgaaatggtagtcgatctcatccataccagataccacctactagtaccactgcagctacagagctactctacagttcttctactatagcagtataacacgtgacggcgtcgtctacgttgcgttgccgatggatccaatccagcgttactgctcttgtgacaagtctctgagcgcgactcgccagacttgtcgtcgtcgtcgccgctgcagcctgcatgcagcagggatcgggttgtgcttgtgcgtcgtctggctagttccgatcgattccgagaccaaacatgcatactatacttgcgttgcatccgtacgtgatcgtctgtctgtcgatcgatcacagggctaccaaacaacagctcgcgtccatgactgcgtgcctgccgctcgatcggaaaaacgtcgcatgcagcccccttctttagcaagtaaggagctctgtcttctgatattttttttttaaaaagaaaacactacaatgaattaaacttggtttagaaagaaattaaaactgacctgaaaattaaacctcctcgttccgagaacaactttgttcttcgtttcagaacgaaagaagtactagtactcggtgtcggccggtacgtgtgagctatctagctggttggtgagtactgtagtacgtggtagcgctgccgggatcgagattttaacgcacgtacaacacaccgagcacactgtactaccaaggccgtgtggtggcgtccttggctatagttagcttagctagtatagggggccgatcgccccgc

SEQ ID NO: 1544 - DNA, 1114 bp, Zea mays
  misc_feature (1)..(100): optimal_loci_58638_G1, chr2:38126726..38127839, Cluster 9
gaatagagctcagattttgaccatgaggtataccctactcaattcaacggagatatctactttatcattttggtggttggctttgcaaacgtatcctcgctcccatttccctctgctgactccgtggccccaagcagaatgacacacggctcagcacagcagcccgatatgtgctggtgccaaagtgtttggctttatccaggcgtgggagccccggtgatgtggccctgcgagcggaaggggtacacaggtggggccctgacgacgtggtggtgccgtccagccgggaatctcatgggaccgcggtctgtgcaccacgacaattgttttggattccgcaccacggcgggcgggcgggtgggcgtgtcgacggtgggtcacggtcagagctgtggacttgagagtgggtgggtggaggtggtgactagcggttgctcctatcaggctatcatgcccgccaaactccgatcacgcagcccccttatcgttatccgcaccgtgaattcgtctcagtctcacccctggtgtgatctgagtctgaccctaatcctatggcgccagctaatcagctgctacctgctatgctagtagtagtatttgccaagttggagcgcacagggatatatatattactagactagagagtggagaaggtatatccttgccattttgttttcgatttcctcctttgtctaataaaaaaaattgaattagactagtacattattatatgggtcgctgtccgtgtgttcatctattcccactcatacaaaaggcggatcccatttggcttctaaatttccactcaatcaacattattgggaggcgtataacacttccattggtcataattaaggttgaactgcagccactttagaaatgggcagaggctttcctatgtgccattataaaaaactatgattttatataagatattaaaattttgatcgcctatacatgccgttaatctgatttctctctctctccataccgcttcaattgtatcgtatttggctctagcagtacaaactacggtacaaatagtctaaaacaccctcaactctgaatatactattgttctaaagggggaaaaatatataccaactcgagatcc

SEQ ID NO: 1545 - DNA, 1307 bp, Zea mays
  misc_feature (1)..(100): optimal_loci_58888_G1, chr2:39595577..39596883, Cluster 9
tagtgtgaagaagaacgactagcgctccctctacgatgagcgtatgactcatggagtcatgagcccatgatttcgcgcctcttttcccctcaggtactaggtcatatcgccgctaatcacacggccgggccggcaatgatgctcatcagctggtcccgacgtcccgtagtacgagtccaaaagaaagtggcccgcggaaaggatgcactgatcggggccgaggcaaacctgttgaccgatcgaactcgaagagcggaggagcctggatcggagattcggtggccggcgagagtgacggcgccgcaaaacgccatgatctctctcgcctctcctctcggcacccgccgtgcgcactctacttgctttcggtcatgctcatgcctctcagcctgagaattgactaatcacgacgcacacatgcatgatcacgtcgtacggcggcatcacggcggagccggcttttaagctttttagttcaccgaccgatcggcagattggcttcgtaatgatggctactcaggtttgttaggacggcctagctagctagctagccatgcgaccactcagctcggtggagatcgcgctttatttccatggcggtttgacgtcgacgagagctagcttttgcttgaccggagctaatctacgccatagctagcatgcgctggttggagcggccgcgccggtgcccccgcgcgcgctttgcgtggcgtggtcgaaccccaccggcgcgccgcacgcaccaacattcctcgagccacgcccgcgcacgtcgtcgccgccgccgacggcggccacggctttttactcgctcggaccctatctagctagcgcggcagcacgcacgcaggcgccgatcgatcgattggccgatgatgaagcagtgctgcatgcatgcgtgcacgcgttgctttcggtcgatggttcggttccccacacgtatactccactgtttgcagcggcgcaggcgtgcgcgcggcacgtcgtcactactcactggtgctgtctgcgcggcgcgatttcatcagtgcatgcatgcatggttccttctcgagacgagctagctagtcacaccggccacaactcttgtgtcatccaatttctatagcgttgtcacgtagcctaaaaaaataatgtgacaaacaattaaacgaataaagagtaagaaattgggtcttgcacaatacttagtttcaacacaatatctaagacacacgagagaataagagtattaaattcagtttaatctatactagacttaaagtaccagtttcaacggtcgtcacacagtcatctttttacaaata

SEQ ID NO: 1546 - DNA, 1166 bp, Zea mays
  misc_feature (1)..(100): optimal_loci_59830_G1, chr2:45200927..45202092, Cluster 9
tgtgtattactttttcccaccagggccaatacgacatccatcaaagggaatgtaaggtactgcccagtataaaaaatatatatatatgtaaacccctcttatgtatcatggctttataggggaaatgacacctcgctctcttgctatcctttgctccggtagccttgtaacttggtgccctttgcgagggcagcgtactgcgtacgtgtggttttacaacggagcgcgcgcgtgtaccgtgtgcacagagaaaactatgcatctggtatgtgctgatgctaggcacgcatgcatgcatgaacgttgacggccggttcccggtagaacttctcgtatactcgatcgtgcagacagtcggtgtgttttgctttcattgacccgtaagtacgtccgatcgacatgcgggtccgctcttccgagctagcactagcagtccgtccggctgatccaagtccaacccggccgggcatgcgcatgtcgcatggtatggtacgaccgaaagcgccggccgccggaagaaaattaaccataccgctgcttttctcagtccatcaccattaacgaaacctaaccgcggagaccgcagcggaagggtggtcatcgtttccagttttctatctaactacccggtcaaacgaaacaagcgcgcgcgcagcagcgcaacggcagccgcggatcggacctgactcgtgcagcgtgcactcgcagtaacatagctaattagctacccatacataagcatggctgcatgggggcagctgcgcggaatggaacgcggacatacgcagcgtgctggcaggcagtggcggcgctcatggacgtcaggggcgtgtcagcgtggaacggctgcgccgatgccgaacccggaatatgcgggtgacgcgacgccagagcccagagatcactggggggaaaaggggcttcccgctggtttcctttttcctgctggcgcgcggggccatttggtagcgcttccgcagcactcagctaggcttcctcttttcccaaccaaacggcgtccgtcagaaatttgatgatgatgctctactctacgaatggaggagcgctatactactagtgccttcccattcgcaagcccgaggtgcctagctactagtctgtgtgtactgtcaactcgtcaacatcctcctgcggctgctccccgc

SEQ ID NO: 1547 - DNA, 1064 bp, Zea mays
  misc_feature (1)..(100): optimal_loci_60386_G1, chr2:48416191..48417254, Cluster 9
caccgtcgcgccgtccccacatggcagccgtgcacggctcggcagtggccagtggcgtcggggccgcgatgacgcgtgtacgcgccgccgtagttacgcctcggattgtccggaaaggaaacgtggcagggaccgccacgcgcaccgcaccgagggagaggagagctaggagcactactctgctacgcccacttgcctcagcggaattacggagttgccctctcgagcctctgacggcctgacccccccccccccctcacgctgcacgtgttggtatcgtcatcttcgcgtggccagcgtgcgcgcgcggtgtgccagtatgtgtgcgcccctgctcgctcccctcgccgggagcacgagcagtcggggtacctcgcatatagttgcatgtgcaaaaaattgagcacaccctctataccggccgtgcatgcaactacgtacagcgggggcaccgcattcttctgcgtggtgacaactcagacgagcagtgacagtgagagctttcaccgaacgagccagcgagcctctctggtcgcatgcatgggtccagctccagtctccagcatatgggtcagcagagtgcgtgtaagctttatactcgcttcgaaccataaaaatcagtgcttgccgcagcgagaaccataaaatcagtgtgtactctgtgtctcgatgctggctgctgctttatttatttattaatttgtggtggtggcgtggcgtggcgtggcgtggtgccatgcgccgcggacgcccaccaccaagcacactgcacacggcgcgggtaacagcacttacgtctccatgacctcgactgctgctgtcctttatatatggtaaggaatgaatgggtacgattcttggacagagagagatagagaggggagacgccatgcccatccctctccgggtacagacgacccggcgagatagagaggaggacagaggacacaaacacacaagagggcagtggcgtgatgagccggaggccgcacgcgcgcacccatggccgaccacgtcgctgctaacactcgtgcactcattcgtcgcgcgcggggggggggggg

SEQ ID NO: 1548 - DNA, 1068 bp, Zea mays
  misc_feature (1)..(100): optimal_loci_61010_G1, chr2:52324114..52325181, Cluster 9
gattaaatccttcaaatgctattatttactaggtctcgatcctaggttcggagctcggttgctccccctgtcgatgggaggacggggactcccccgcatgtcgcttagcagaaaactggagcaatagagaaagttgaaataaaggcaaggcaaaaaccctgatggaatgcaagtgtaggtagggcttaccgcgagaggctcgctagtggcatggcatcgaatgaagaccatgaagagggcaagggatgttcgtggaggcaccgatgcatgtcacctgagcacatctaactctggcagcattcatcctagacaacaccaaggaaaggatgtcttcaccagacatcacttctgcaaagcggatgaaactatccaccgaagaaggcaattctcccagtgctttcacgaagatgggataactagtccttcaccgataaacaggtatgttagaggaagggtcgggcggatcctctcgtaatcgcacgacgagcccaagacaccccccatcagtgcctaccctaaggacatgtcagcctcggctcgcagctccttctagcatgaagcgatgcttgacaccattgagcggcaggcagcaatagcatgcctccccccaagatgactgatacaagtatcgtttattagtgatcctgccctttacactaggcaaaaacatcacgtctccagctaagaggagcttcatatggaacctctaggatgaagcctagaagccctgatccaggcgaggtcccttggcccgcatttcacaaataaaaccattgctgaatctagcctttatacgacaatgagaatggaactgagatatattcgtgcaacctcccattgcaaagatgaatactcacgcatctaatcagctacacctccattgccctcagctctttcctctgttgtagcagctcgacgcagaagaaatactgccatatgttaaaattgtgctctacacccaaataacctttgcatagcgtgataaataaatagtggcaatgtgttggatctcgttcggattcaggtagtgcagttgtacttgtagataattgagaagagacgcgacaa

SEQ ID NO: 1549 - DNA, 1179 bp, Zea mays
  misc_feature (1)..(100): optimal_loci_61500_G1, chr2:54756344..54757522, Cluster 9
attaggcatgaatgttcggcgaagctacatactactccggtatggctatctctgccggaaatgctagtagtgctttatcgtttggtttggtaagcagcccagaacacacggtctgttgcacttgcacctaaaggccttggacactctagtatcttatctacgagtcactacagctgcctggatctgaaacgtaacgctagctttttgcatgtggaggtgtcccagtagccgctaggaaggatatcgacgattcagagacttggcgtgtgtgacggtgcaaggctaatttggacgcagatctgggtggattatttatttatttatgggccagaaagaccgaaaccacggcgcgctcggcatgtgtcccggtggctctcgggctcctgatagtacacagctgcacggggcgccggcgcggccgccggactgctccattgcacatcgcccgtttcccttcgcgggccaatgacaatgattgcacgttcgcacgcaccggacggaactgcaagtatatagtactaatattagatccgctcaagcagattatctaaaatttaactatatgtactatttttacaatggtctgtactgtagagtgtgtactggataagtaaattgctgagggtagtcttaatagtggtagatgagagtcgaggatattaaccattcagaccttgctacagtaaacggagctgaaacgctgttgagtggacaaggacaactcacgcaggcagctggctggcgtgtcctccctaggaaactcccctagcagcttcgccatccctactccctagcgcggagtctcatctcatggatggagcccgcccatccccgatcgcgagctgtcggcttctccgccatccacggctcgctttcgctacttgccttcccccactccactccactccaccccaccaaaccaacccaatcagcgcaccgggcccggtcgcgctcgtttcattctccgcatcgcactcgtgctgcttcctggtgctcgcgtcgcgtccttctgtcgtgaccctcgcgcgtcgggtcgggtgtggatcggaggagccgtgttccccggtggtgtcggcgtaaaacgcgacgcgctcccgggcggcttcggctgcctgcctgcctgcgggtcaaaggctcaaagctacggggccccgctcccgggcgccagttgccatcaca

SEQ ID NO: 1550 - DNA, 1153 bp, Zea mays
  misc_feature (1)..(100): optimal_loci_6470_G1, chr1:33278066..33279218, Cluster 9
aacagctcgacacatggacagacatgcttaactgaaaccaaacaatagcatgaaggggagagcacgtcacatggactgctgatgctgtcctccgattccatggaacgccatgattaaaaggcaagagaagagacggcgaagagcctgccgaggtgtcaacgggtgctggcctttgttccgctaagattcctctcctgccccctctctgttgaaatcgaaacccatcattagccagccattgcatcaccactgccccccacccccacctttgccggacgatcgtgcgcgtcggaccgggcatcggacggctccgagcaccaccacaccgcgcagagtccgccgcgagctcctttcgtcggcgtccccaccccatgcacggtgatgtaagtagggcggcctagcagcgcaggccatggcgcacacgctgccggtggaaaagcaaacctcaaaacgccgcccgtcttttcggcgcctttttttgcaaggaacaggcggacgtacgctttgcgaattcggccgggggtgcggtgcggggctttgcgtcggccacgcggctgcggccctgcgggaaagcgagggtgatttgagccttttgacctcgtcgcgtccggcggcggggtggcgacgagcgggcggagccttggagcgtgctctgaatcttggggccggccggccggagagagagagagtgtgtgtcgcgtcctcgctcaatgtgaaaacatcaaacattgcgatgtattgctcggtaatcagtagtaacaggagatgtgaaagtgtgttacagcggcgcgggtgaccgaccactcactgccatgtctgtaagctgccgccgtgacatcatccatgcccggcaaggcggcaacctgtatgcaattttaaattccagctaattttgttattaatatagatggtgttaaatttatcttggaaggctattctttcaatcacggttcacgacgtgtatgtcaggacaacgagattagcttgtttgtttctatacttttttttcgatttccaatataaatagatggctgatataaaaagtaactagcacaggaggagcccaacttcttatgtctaaggtcagcgggagtttcttggattaaataacaatatataagtggtagcttggctgtaatctgatatgtagacc

SEQ ID NO: 1551 - DNA, 1149 bp, Zea mays
  misc_feature (1)..(100): optimal_loci_7699_G1, chr1:40242253..40243401, Cluster 9
cgataggtataatttgccacggcgatcaaaaaaaaacggtggtgtaataactaataacagagcgaaagcaaatggccgccgtccctttctaggaacgcttggcatctcctgctgtccctgccttttgctctcttgggcgcaagcaacgcatgcagaggatcaaaacccctggccctggccctgggacgtactacgcctcttctgcgcgctttacgtgcaagcaactgctgcagcctcctcctgcagctagcgcctccatcattctgtttcccttttccgttttcgtgttagcgtctcctacgtacggcctggatcgatggatcccaccgatacaaacaaacaaacaaacgatcagacatacagatccagcggcgcattttcgtgacatgtcacaggacctcgtgtatcgggttttggttcggatctgtactcccgattgagttgttttgtacggcacgctgcgcacgcagtttttttgtcggtggaagcaggagtatagcatactagcatgcaatcaagagctgagagccggtcgtggggcgcgcggcatcactttccttgccacgccggcccactgcgcgcagcgcatctactactagcgggactgcgtgcgtgcgtgacgcacgttgctgaatgctgatatccgtgtttggcccaccggccgccgcgtcgtgtgtgtagcgtgcaggcagtactgtacgtttgaaacatcgatccgaacggacttggcctcaccgtgcgtgcattggacgggacgggctctgccacccaggcccccaccctgctttccctgtcccaatctcccccaaatgcatcctgcggcattcagttttttgcgtctgctgcgcgcatgcactgggtctgggtccctcctcctcctctctgcctacgtgcgtgaatgcatgcacgcagcacgcagcacgcatcatgctgtagtaccaaattggtactagtaggctgatgagttgagcgctcatgattggcgtcggtcatgggagacgtgccaatagtgtcaggtcagcgagcgcatcctggagcaggatggaatgcagacgggtcattcccgcccggccgcccccaccccgttcgtcgtttaccacgcaggcatgcatgttcaaaatcgattttgatcgaggcaggttgctggcg

SEQ ID NO: 1552 - DNA, 1110 bp, Zea mays
  misc_feature (1)..(100): optimal_loci_7723_G1, chr1:40397581..40398690, Cluster 9
ggaaaaaaaaaaacaaatctaccggcagcagtccaggccggtggtagtatgtagtagatcccttgaagcatatgcacgcccgtctgtcgtagctagctgctccttatactgaaagaagaatagcgcgcgtgatgatgcgaggaccgatcgaaggctagaatattcccatgtgtggaaacggtggcgtataaacaaaccaggataggattagaaaaggcgcaagcaagaacgaggtcgtcgagcgacgaaccggcaactactatactaccaggatggatgcgatcgctactagctagctgttgcttggaagcgacatatagatcagggagggagggagggaggggaacaccgacaccatgcgttacgttgtccctgtgccattggccacaaaaaaacaatgtcgtcgtcgctagctcgacgcgacccttttttgtgggccagatgggtgaaccattatagctagctctgggatcaatcagatgagacgacgatcacaccggatcgtcatggagtgtgctgctagctagctggtccggacctatcctaatgcgcaggcacgacgaccggctgggccccggctcttctcgcacggccgccacgggactgtgtgtggtcgagacggctactacatgtattcggcgcgcccataccaacgtgcatctgtcacacctctgcgtgtccgtctatccttttcctccccgcgcattatttgtatttgattaaacaaacgcggggtggaacatgcgagtgttctgagggcaggctgattgatccgatccgatgggcagccggcaccgcacgccatgttcgcctccatgcatgtggatgggggaccgcgatttaggtcgcgctcgtgttaatccccggccgggcggcaaacgccaacgcacgcgggccgccggctgcggtttgccggtgacggttcgtgttattaggcctgccggtcctgtgagtgacgtctcgtctctggcgacgcagccgtgatctggggttcggcgggaggggaggtttgagtttgacaggtttatatactgctgttgaatgttgatcgatggggatttggcgttcgacaggtgcaggctcaggctcagtagatttgatgctgcaata

SEQ ID NO: 1553 - DNA, 1200 bp, Zea mays
  misc_feature (1)..(100): optimal_loci_7724_G1, chr1:40398749..40399948, Cluster 9
gcgtaaatatttttttccaataaaaaaagcatacaggcctaccatctataggtcaactggtcgagcgtagtagtagttggtggcggtggtggtgggtgacgacgacggctacagtggcgtatgcttaccacattaccaactgggtccgcggtggcgcttgattgcttgcttgctttctttctttctttaattgtcgccaccggccgcgttggtgcggtcgattgacatttgaatctgtctcgacgcgagttctaccccccaaaaaaatagagaatcgtttctcctgccatgcacgaggatgggaccttgatattcttttcagctagctacgtggttctccggcgctattattccaaaggaattattaaaactttgtagaagcaggtaaacgaggtcgccacctggttcttctgcatcctgagaaacaggagcggagagatattatttcttcttagaactctgtcagcaagtacatttgttggaacggagccgcttccagagctgtgtgaggaagcagtgaagcacacgtataaactgacaagacgcaacgcaataccgagccggcggcaaacctgcgcatgcgtgccgccgagagccactgccgcatgcgttttttgccggctctctctcgctctctcgcgtaggatgatacaagtaaaacacgctactaatctaattgtagtagtcttccatgtttgagtccgggttgggcaggtaaagagagctggcgcggcgcggatggaggggacacgtgaagaagacaaactccgtgctggactttaactgacggctgctagtagctcgcaactccccaaccaacgacgaacccacgagcgaggtttacctgctcgcccggtaacctatagcttgacgcacttaaagataagatgaccacgcgcgaactaataatgctagcgcacgcgagttaaaaccaggtggcgataggctttgaacacgatatcttttttttttcttttccttctggctaaccgtccacgggggatggtcgctatcagttgtgacctctagatgaggcttatagatagatagacgatagaatcgtagtatagctaagctttacgtgatttttttatagatataattcattatttattctatcaatattaatttatcctatgttattttttaaaaaaaactaaaactatagatttttttttacttctcttgccatttctctac

SEQ ID NO: 1554 - DNA, 1046 bp, Zea mays
  misc_feature (1)..(100): optimal_loci_81004_G1, chr2:177115468..177116513, Cluster 9
cgattgggcagctgcacgccggtgcagcttgcgcgttgcggcagccggcagctagctactacaagctggtacagtacgtacgtaggaaagcaaccacagcacagcaagtaacttcacctgtgtatctcatgatctgaagcatgcatgcaacttgctgcccggcccagcggcctcttgtcccttgtgcgctcccaggaggcggcgggcgcggcgaaggcaaatcccaaatcccaatccccatcggagcagcaactgcgatggagaaagctccaccgcagcaagtagctagcaggtcgcgaggtcgtcgccgtgcaaagaatgcgtaccaaaaaaaaaaggcttcctggaaggaaaatctgagaggaacctgcggatgcacttgcctgtcggtgagccggtgacaatggagtaatggactgccatgacgacgtttctgcgttgattggccaccaggctgctgggaccgagagcgactcgagcgatgtgaagggggcgtggtagcggcaggcagctggcgttcgccgttcggtgatggcttcgtcgtttttccacgccctgcagccccgctcctctctctcctcctggcggctgcctcgccttgcctgacggagacaccgcttatttgttatattatatgagagaggaagctagctcttgcttgatgattatataagaatatatataatcgtatgaaaaacaacagcaatctagtagtcgacgcagaaggcgccgatcctgctgttcagttcttggcggtcagggaaatacctctggtgccgcgcgcgtcggcgaggtgcttgcttggaccttaattagtgcccttttgttcgttctcatcagagagtcagtcgccattcgccaagctcgatcacattcaattcctagccaagccaccagcgtggcagagacgcactctgatccacgatccataaatgaggtactctagatcacatatcagtgctccctctgtccacatgatttagtcgttttagttttgttctaagtcaattagtattaaatttgaccagttatgcatgatgtttcat

SEQ ID NO: 1555 - DNA, 1336 bp, Zea mays
  misc_feature (1)..(100): optimal_loci_81602_G1, chr2:179833126..179834461, Cluster 9
cccccttagttcccaagtgagttctggttaacagcaggatgggagaccttgcaaacacgtactggagctttagatatgctgtttggagttctgcactgcacctgtaataaacagcttatatataaatgcatctctgcaagacgcgacaataatgtctctatcgattctatctccaaggtacgagagcagcactgagcttttctcctagctatcatgtcaactaatgagatagcatgcgcgctcgttcgttcggcctcacgtgccttttctccaccataccagcagaaaaccactttgcagtacgagaattggctcccaagtcaacatttcgcgcgcacatcctgcaatctagcttgtgtggtactcgattggagatgtctctgcctggcgtggaaaggcacatccaggattgtgtgctggtgtggtgccagtatatattcgccaagaacttgctaggttcatgctcgagaggccgggacctgtcattccaattttgtcatccttatccaccatgttgtagctaggtcacctttaatttgtcgacgtatatagtcctgcttttatttgctctatctatgtactatgagatgatatgcatatatatatgtatccacaatgtgatgttcactttaaagttgcttattatctccaggcatccctttggtcgggagatcaagtcacgttctgcaggcacctcttcccctgcttctatgttctatctacgcaaagccatgggcggccgcgagctgcatgcatgcatgcgcgtcgctgttgcctgcttctttttcccaccccggcggccatgatcgagcacggcgcgggcttgtcagataggacgcacccgtacgtggaggaggatcgggacgagatctcgtgcacgcatcgcttttgcttcggccgccggcatcgtggaatggttcaggtgcaccgcatggagtttgggcttccacttttacaagtctacaacgcatgtgatgcgagtggtcagggggtgatgcatgatgtcacagtgctatcctggtccacatgtctttgctagggcttctttgggtagatagagaataacgagattggtgccacatgcccgaaatccttcacctctttgtggaaggtgttgcaggcttcactacaagacctttaccaaggatctttattgcgtattagactacgacagaatactaaggcaatctcttgtaatatctctacaccacatcccgcatgtacgtactaaggcaatctcttgtaatatctctacaccacatcccgcatgtacgtaggcccttggcatcccacccaaggtcagccttcctctgtcccatctttcatagctaatgtc

SEQ ID NO: 1556 - DNA, 1305 bp, Zea mays
  misc_feature (1)..(100): optimal_loci_83639_G1, chr2:190863378..190864682, Cluster 9
tactatactgtttcatagcatcgattgagctgtacccatgcagctcaattggttctagaaaaaagaaatctaggcaaaacaagctacagaaatgtcctaaaaggagatacatacgcaagcagcctattatattccgagccgaacaaatgtcaaaaaggacggaatttttgaaacgccggcggacggggtggacgcggcaacgaagacgaagcagggagagcacagccacaggaagctagaacgggaagcaacgcacagccgcacaggacacgtgcgggtgggcccgagcgccaggtacggccacgtcggcagtggcccacgctccccttgacccggctggacgacggtgagcggcagggccgcaggggcgccgggcctgggttccctctcgccccaaccaacgcgtagaaaataaaataaaataaaaacaattggagcaggaaactgttgacaagcagcaaggctacgtactctaggattatctgttccagtttgtagctattctgtggtgtcttttcctttggtcttccttaatcattggcacataaaatataaatgttcagccccagtttgaacgattactactgaaatgttggaagcagagcataccgaactgtcatcgatcttgtccacttgtgcaagccagaaaagacactactgctactgctaccttgccctgtggcggtccagccctgatccagggtcctgcgagaatatcaagacagtgacagcaattcaagcaggttctaatagcctgaatatcggtcatcactcacatgccacagcagtacagcacctcaaattattcccttaagaacagttcttctttaatatatatacatatccttgcctagatcaagggctcttgttcatcatgttgaccgcccgaaatcgcagcgcgcgcgcgcgctctctctctctctgaccagctctatcacacacttacgttcgtcgaccaaaacaaaagggggcccccggttgtgtcatgcttggaccctctcattttcttggcaccgatttgtctgggggtgcagacgccgatagttgagtgaagctgaatacctgtgcattgactaaacctcccctcctctgaaagttactggtttttttgttgtgcgtcaagtttctgaatctctcgtggcaagaaccgatctgacggctcaagcggtcggatcatgcatggaatggacgaagaagtgtgccccccccccccccttttcccttgatgaaccatgcgtggctctcatgcacatcatcaaaaccagcgagcgatggtttgagagtgagaagcctggctacgaacca

SEQ ID NO: 1557 - DNA, 1164 bp, Zea mays
  misc_feature (1)..(100): optimal_loci_83950_G1, chr2:192802097..192803260, Cluster 9
ctgcaaatgcaacggttcttcgttgctagcaggtactatagtttgaattgaaaatgctgcagctacagccactggaattagttgcagcaatcaaggcactactccatctcttttgttttacagttacagtgtgtatccatttagttaggataagagcttgttttcattttatgtgattgttttaaaaaaactaccatcgtgactaggttttctagtataaaatttaatggcagcattgtcaatcactattaaaaagtagtagtactcacatggatggaaacgacaacaagtttcctgctttcagacggagcgagtgtggctacgaaaatgctcctacatttagcggtaccaccatattggactagccacggtttggcgattcagcgtgttcatgtaaaccaagctcgtacacgtacaggcaggctctcgcgtccttccaaaaccctgctgctctcgggggtcggcgcatgcggcatgcatgatgcctgcacctgcaagccaaggctgcactagcacgcacgcagccccggccagacgccggctgaacgaggacgacggtcacctcgttgtttccttgcgattaactccggccatcggcgcgcgcatccacccggggttcggttttccctggcccccgatgtgatgtagccatggcgccggcatccccaactctgttgtcacctgtcaccaacagcaaaaaaagcttgcgcagccttaatggagttgtggcatgcatggctcttcatcggatcatcagcggagggtgacgagctcgttcaatctgactctgcagcctacgcgaggcaaaagctgaacctaagcatcttgctcatcagaatcagagagcatgcaggtatgcagctttgctgcgggcaacacacgtacagctacaacagtggaaaacaaacatcgggatcagttgttcgtgctgtataggtggtgtccatactttttttttggtatctgatctgatcgatcaagagaggctgcagacagacatcaccattttcaccaatcaaattattgcagtaaattactttgtatcagacatcgctatatgtacatctgtcgcaacaatggcagccagccacttcccaatgaacgctgcaacatcggcaaacaagggcaaaacaacttgcaaactactacatccacgacaaacag

SEQ ID NO: 1558 - DNA, 1213 bp, Zea mays
  misc_feature (1)..(100): optimal_loci_84195_G1, chr2:194493196..194494408, Cluster 9
gagaaagactggttggggaaactttttagtgctggagttcgtgttggtgctagtcttaatgttggacttggtgttggttcctgtctaactattcgatttggttcatcgtctaggagacaaatcagcaaagtgctttgctgcaggcagcatattctagtgctaaccttaccttgacaccatcaaggatggcaccgcgccgcacatgagttgtatagctggggctggcccgttaattagtgcaatccattgcctaagacaacacggtttggcggtgcacccatgaaccgtgccagcacgaccacgccttggagctatgcttattagaatgtgctcaagttgtgccgcgtgtctccggaccggcgtacaggactacgcgggacatgcgagatccgtgcacacatgcatccagcagcagcgaccatgcatgaaaccgacagctgctcgctctttacgcagaagctagcacacacgacgacgacgacgaggaaccgtaggcgaccatgaaaccgaataacgtactactatactagcttagctgccatcgtttgtaagaaagaacgcactcaactgaaacgcgggctgtgtcgaggacatcaccagttcgctgaagctctcagcgaactctgaccgagagaagatcagcctgctatgtcttgtgacataaaactacacgtcgtatgcggccgttacacagtctagtgtccacacccgacgattcgccatcacacagtcgccccggcgtggagtcacccgccgttcatcgtcatcagcgcggtacgtacggcgtgcgcccaaaattcaggggtctctgaccgcgacgccgcccccgttgttgtgcgattattttaatttacgagatcacgggatcaatcacagctgcgatatgcgacgacgcgaggcactcgtattattggcagggggggcgctggagtatctgggattgatcccatgcatcatcatgggatcgaaaactgggacgggggattacaagctgcaggacgtcaatgacttcgattggcgcggcgcaagatggatggatggatatatagtactagtagccgcctaggtcaactctagcgccctatacccacacccataacgtacttgtcaaatgtatgtaacctatatcaagaagaactagcagctagaacgaagggccaacaacgtttgtgtacgtataagggtcaagatgttgcgaccagctggtgtaagg

SEQ ID NO: 1559 - DNA, 1197 bp, Zea mays
  misc_feature (1)..(100): optimal_loci_86403_G1, chr2:208065627..208066823, Cluster 9
atagattccatggttcattctcatctgaaggttctgtggacatggaaagaagtttattcgcctgtgttgacagttcatgaccgctccagtttggggacaacctagatttgaagaggtgatagtaattttcaccggcatgagaatgcagaggaagacactgaagaggtgtacacgagaagaagtgaagacgcgcgggagcaaggttttgaggtgaaagcgttgaagaggtctgggcttgcgtttgtccaatctagttgggcttgggcagaattaggcctgcgcgcctgcgactacgagtctccctatttggcttcttctacctctgatacatccttttccaaattgattgagcatagtgtacaatcaagcaaggaactgtgacatccgggcggtcgtcgccgtcgatcgagcagggacgctccggcgttttctgcggttacgttacgtgtggcggcgaggcgtcgagagccgaaaggcggtcgtccccggttgcatggtccgatgattggtgcgacgaaacggcaatgccatgtgcaccagccgccccccgcgaggacagatgcggccgtggtgctgcgctgtaccatcactgcacaggcaccgtgttagcgctacgcgagataagcgagggtcgtgtaggcatgccgtcgatggtcccaactcccaactgtcctgtctgtgatccaaaatggcacgcaaagcatcatcgatcatcagaatctacctatcgactatagaccatagaacgatcgtacaatcgtctagtgtttcagagcgacataccgctacaacaaattgagatatggtgcgaccccaaaaaaagtatcgttttcgttttctgaaaaaaaaatagatacttctaattttaaccccaagaaaaaacatacatagttcttaatattcataacgtatgattactatagaccatagaatattttttaataaatatattttaaaaatgcaaatgttggtaatatttttttttttttgcataaatccaattaaacttatcttgtttcggaccggaggagtacacagcgacagcgtacgggtcgttaagcgttcccatctccctccaatcaatcaatcaggactcaggacaaaacgaggctacaatccaaacaggccttcagctcgcgccgtcagcatttatttgtttcttccccgcttcgtcaaacgttcaatcacgacggcaga

SEQ ID NO: 1560 - DNA, 1339 bp, Zea mays
  misc_feature (1)..(100): optimal_loci_89230_G1, chr2:222975471..222976809, Cluster 9
caccgatggaccacggcgcgcgatcgtcggcgtggtctgttcccggccggattcgcttcgggcaaccttctatctactaaaacaaagcaaaggctggtctgcgagccaacgcatgtcatgactgcataagtgagtgtattacccaatacccactaacgcacgtaccgtacgtacagattcaaaaaaaaaagcgcggtactagtatattgctcccggtggcataacgcaggctgatggtaatacatatatacacaagcggtggtgacactcctgaaatacgactctttatcaagtgtttagcgctttaccgagtgttgataatgcagcccgttccattagtgtgacttaggtgacacacacgtttgatttgtactgtgcattttttttaaaaaaaatttaagaataaatgattttatacaaacaattactatataaacaacagataaaccatactcatgcacacatccaactgtatatggagcgtagaactagacatatatataacatagacccgtcttataatttaagcaatccctacgtagtggggctagaaattaaagcctacgtaccctgcagctggcttcagttagcagtgcatgcacgagtagggatacgtgtttggatatatgccttttgtcctctctctctctctctctcactctgttctctctctgacgtgtatgctctttgagaatttggcttggcgtcgtggcataggcagtgactacagtcctgtgtcctcgacagcgactctgcccctactacatctgctgttcgcgctgcacctagtacaccgtgtgtgtgtgagagagagagagtgcacccaggccggtgctgtcacctgtgctgtgcctgccgcgggcgggctgcgtctctggccggctcggcgccgctgcgcgtgctcgcctgtgtcactgtgcgtgcgtgcatgtattgtagtcctacgcacgtagtagaggaggctgccgatactgtgcgcgctggagaacgagaagcaaagcaacaggcgcaagagccaacaagcatcgacgagagttttgtatttctcccagtcccagcaggcggcgcccctctctattattctcggagagtgtgtgtgtgtgcctgtttatccatcgcgctactgcatgtttatccatcgcgctactgcatgtttgaaatagtgtagtgttatatatactctcgacatcaaccgctcagtgtttgccttctgcatcgtcccatagtgcatgaggggaagtgacgtaaaaaatgcatgggcatgcatgcatcaatgtatgtttgttaaaaaaacaaagtgacatgcatgtctacaagttagcaaggggtacgtagtaac

SEQ ID NO: 1561 - DNA, 1132 bp, Zea mays
  misc_feature (1)..(100): optimal_loci_9236_G1, chr1:48650500..48651631, Cluster 9
cctttcgcgacggcgcactgtgctacgcatgcagcgatgcccgctggcggcaccaacttagtagcgcgcgcgcgcgccgcacacacaggcacatgcacgttctcgctcgggccgccattggttctagatggcatagacgacgacggcctctggatcgatcgcatgttttggaagcacgccggttagcggctttgtcgacgcgtgaggctgtttggtttttatcggttcgtcctttgcgctgcgtggcaggcgcgaaagcgaggttccatcgccaaaccaatgcgcctgccacagccccagctccaggcggcaggctgcaggctgtccatccatatcccactgccactggccagtgggcacgggtcacgcacgcactgtgggtgggggtaggccttgtggcattggattcccggcgtcgatcagcgtcgtcgcgcagatgtgggccttgtggcttgggcgcacaataaaggaaggcttcagttccagcatggcatcaacctcgtcagtcagcaggctcacggccggccggtctctctcattcgcacgcacgcagcgctgcgcccgtccctcgtctcgtctgtcatctgcgccaggacaccagcgcaccgcacagaggccacgcacgcagcaggctagaatagaacgagagaatcatcattcgagaggaaggggtcaacaagagctacagctacctatagggtgtggtgcgtgccgcgagaccgacgtgccgtgcgcccgtgtcattggcgctggtactgaccgtcgtccgtcgtccaagtagcctctgattattccggccgcttcactgtgcctggcggcgaaagcacgagctgagcaggctcgtactactactagtctactaccactaccacagcccacgccgcatcccataacctggtgtcgcgttggctcttgaaacccacgtcgtcccctgcgccgcgcagcgctgcaggccacttgtcctgtgcggcgtgtgacgtgtcgaccgagcgcgacgcaacgaccaacgagaggcaggggcaggcaggcaggcagggctccaattgcggccgccggcgggtcggtgtgggggtggtggccaggtggggtgggggcgtccagcagcggcgcgtcccccgcacgcaggcaagtg

SEQ ID NO: 1562 - DNA, 1398 bp, Zea mays
  misc_feature (1)..(100): optimal_loci_92768_G1, chr3:3470352..3471749, Cluster 9
aacgcccaggggccagggggaatgggagctagcgcagctgtacttgtgtagccatcctccactccatccatccccagatctctcccggcccggccggcctccgcgcgcgtccatgtgttccattggcttaatttgtttggccccccatcgtacacttcggattgtttggttgcacttgcaccaagctagaaggagatcaagagtcatgagtcatgactaacaagagagattacatgtctctcaatcactctacagccagataagctctacaagggtaattatttattttaggcaaaaaggtaccccttttttctcccgtcgtcgtcgtgcacacccgtcgccatgagaatcgacgcgcatgcccaatcattcacgcacatgtaaggggagtacacgcacaagacggcctagctttaattcttcgaggcttccgccacctgcatgcactgcacggcacccggcagccggcagccggcacatgtctgtccctccgccaccagcagcagcagcagtcctggcggctcctgcacgtccagctagcgcacccatgcatgattgatccatccatccatccatctgccgtgttctccgcatcgctgctatctgcggcacttcacatgcatgtcacactcaccgggagcacgtacgcacgccgcaggtatgccgtatgcatatcgccgcgcctcgtgcatggtgttggctaccggatatcgacaggtcgtcgatggccgtgtggcctctgttcgatcgatcgagtctgcgcgtacttatgcagcatgcacacaccggccggtcggtcggttgttgctcgatcggccggccgcgcggagtttcctatgcaacgtacacgcatgggtatatatggcgagcggtggcttacgtgggccgtctaacggccgaccgccatcgccgtcggggagtagctagatgagacgacgagtcgacgacgacgacacggaaagaacaacaacaagttgatgcttttatagtactactagtatactagctagctagaaaggcggaggccctagcactagcaggctagctagctagtgccagttgcacacacaaaaaaactcaccgtcgacgggttcgacgatcgatgcataccaccgatgcaggcagcgcgctagcacgcacgatcggccgacctgccgcctggatccaccgcatgcatgcacctagtagttcgttggtagagcacgtgcgtccattatatactgacgctaacgagaggctggtaggctagtggagacagacaggttaacacaagcagcaggccggattgccaaagatagatagcagcatgcagtacgaagaaataatgctagctactccagataagcacccctgtaccctgaattagcaaccaaaccaaagagcagtaaataataatag

SEQ ID NO: 1563 - DNA, 1169 bp, Zea mays
  misc_feature (1)..(100): optimal_loci_94042_G1, chr3:9562743..9563911, Cluster 9
agcgtgcgcacttaaaaaggaattcgattacgtgcatgggtctccaacccttgtgcgaacctctaaagcttatattgttagccattatactatcttcaacagcttatctattatatttctcatattatattttaaattttacaagaacagtttataatgtaaatagaacattgttttggatgactatagataagctggacacggtgccacggaggggaagtgaaagactcgtccgtcctaatccgtacgcgggaccgagatccgttcatcccgatggagccccaatcatgcagagatggcatgcagtccctccgtcatcatcaatcagaacatacaattctggacgaggacgacgcatgcgcagcgcgaccatcggatgatgagatatagtgtaaaaatcacacaccgtgccctgcccggccggtcggcatctgcagtgccgttgccgagacgtattattattaattattatccaaacagctagaccgcctcggcggttcgtgttcgtcacggcgcacgtcacggacgacggcgacggcgacgacgtcccttgccgccgtcgagtccgccggcctgcctggctgccccgatccaatcatatgctgtctgcaggctaggctagctagctaggagccacacgtgcggcaatgtagtatagtatattcggagcagcatctatatgcaactcacggagatgtatgaggtcgggcggattccgtcgccttcgccgacgattgggacggggcggcgggcggcggccctgttgttttgttgctaactatactagcggactagctaggtaggccagccgccgcagcccgcagcgggagttcggagttcttttccttgtccggttgtccctgtgcgcgctcgcctgccttctagagcatggccgcgacatcgattggtattacttaatttaatttgttgggatcgaatcaaaacgactagtagatctctgggtatcgcagtatcgtattttgaaggcatttaccaactgtgttagggctcacctacgttataatcctagtgatatgcatcttcagactccatccaatgcaacgcaacgcatggggcaaaatcttctctctttgttgcgcgaggagagacggtgaaaaatgtgacaaagaacaactaatccaatacaatgtatctatgtagtaagcgcc

SEQ ID NO: 1564 - DNA, 1077 bp, Zea mays
  misc_feature (1)..(100): optimal_loci_94627_G1, chr3:12825319..12826395, Cluster 9
cacaaccactccgcccccaccccctgtgaccagaattcaaagggactgttccctcctacagtgcaagtgtaaccttgaatctgtaccgcgaggacccatcagctcagctctcagcacaatatttttccctcctctctctggcctcagtcccatgcatcccacacagatcagacacagccatagtgcatgcatctcagttttcacaaatcttcacacgccagctagagctagctatagcttattagctacctggtactttcccatggaaataacctacctacctgttctaactctctctctctcttctcttctcttttccttttatttcctttttcttttcttgttttaaagaaaaataatctacttatttgttctaaaagaaaagaaaagaaaagcagagccgcacatttgaaaaaaaaaccaaaacaaaacaaaaagaaagaaagaaagaaaaaccaggccagccatgcatccaaaacattatgcctatgggctatggcggcatgggctacggtctgggaagctacagacaactctactagctagctagctagctgctgtttccactgaaagatttgcgattttgttggcgacgacgacgactgacgggcgtgagttttcagcacttggatgcaagttggctcgatctagaggagaggacacagtcacacaggcacagccacgctaggtcgtgaacctggggaaaaggctgccgccatgccatgcatatgcagacaccaagcgtcgtaggccgggactagctagccctagtagctagcttagctcagcacccggcctctcctctcttctccatcggcccccctcccgcgccccggcccttagtagctgcagcagctgctgctactagctagctaggtccaacgatttgatgcctgtggatttcaggatcgaattaatgttggtgtactaggatagtggcttgcacgcaccatatctatatcttgtgttcttcttattggggatatcttagggagatctgttggcctttttgtaagttgcatttttttccttaataattattatctttactgccgcaaaggacgatcgattttagtc

SEQ ID NO: 1565 - DNA, 1363 bp, Zea mays
  misc_feature (1)..(100): optimal_loci_94779_G1, chr3:13718082..13719444, Cluster 9
ccatctagttttgtcgcgcatcttaactaagtttaaggcacgtcactgcccattttcattcgtggccaaacgtactttgggatctttggttttcatgtcatgtcataccggtccaaaatgaccagacccaaactttgaggtatatagacgtacgtagccagcacccagtggctacggtatgcacgtcacccattgaatccggctccgaccgtagctagctgctctgctccctccttgtctaggcaactatatataaccgccggctcggccatcctgtcggatcctcctcccgagacgatagcttgcgaggttggttcggcgccattttcatgcatggcatgcgcctgtcggccggcggtgaccgcccggcaacggcgagtccgcgagtggcagcagccggcagcaggatggatggaatggaaacacggcaccgccaccacgggacgatcgcggcacccatatgctcagggagacgatggacctttccaacgacgaccgctgcacgcggcggaagatgagaggaaggatgcattgtcgtcagacgaacgccgccgccgccgaatggccggaacggattcgcaggacgccagcaaacacgtcctccaagctagtccacgccagcatttggatagaggcacacgtcagcacgtgccacagctagctcttggattggcggctagctagctagatcctagatggacctgattttaacgtcattacgcgcgcgcggcagccagagccagccatctcgatgcccgcccgtcgaccgcatcgaagcagagaggaaagaaataaaaaaaggtcgtcttgcgaggagacgacgacgactcgctcgcggtcgcggcaatcaagaaggccgggcgtgcgcacacaccgatgctgctgaacggtgagactcgaaaggatcacggccggggtcagactgtcaaaacagaagagaacacaaggaaaaaaatgagcaagtactatcagattcctacagcagcacttctgatttctgaagcaacgatcactgcgtacagtacgtacagctagcccaacctcggcgtgcgtatagaccagtgaccactgaagaagaagtcactgtcacgctgaccactgaccatccacgacagatttaacccaacggccccgagagctgcgctgctcagaccagaccgcacctgtgtcatgcattgcatggtagtactagctagcccactagcaccgtacgtgaaatttcaccgtactggtcctggcgactggggcgtcctccactcgtccggtccggtccgtccagctgcgccggcccctgcccagtgacaggcattcaaaggcgcaggcccgtctggacggtgacgcgtccacctagctactcatttct

SEQ ID NO: 1566 - DNA, 1002 bp, Zea mays
  misc_feature (1)..(100): optimal_loci_95425_G1, chr3:17441085..17442086, Cluster 9
ataaaattcagatacctctgtatttgtaacctcttgcatttatcattatgagtactacttgtgctcaccagtatgaattcttcaactacttcattaataagcttgcactcattgccccaactgaaagaaaattaatgggattacagagagctgcaattctatcagctctgttgtcacgagctttggatgctcctcttcttccttcttatcccaggtactcccatactaaggggcctatcatctgaagtctgctcctagtattgagtacaaatcgctacttgtccaaatgaaatattgaaatatgtgtttaggatgagaatcttacaattctacctaattgtcaagtgcacatatctacagctgcctagatctatgtttgctcctagtaatcaagatctttttttttttttttttgcactcaggcgaatccagaacatgacaagccaccggcagagttcttcgagcagatcgacaagagacgcgtcgcggcggagcgcgcggggtcttacccggtcgagctcccgaagaagggagaggccgccgacggcgaagtaggagagggtgaggtggttgacctcctgggaggcgtattcgtcggggagctccgtggccatggcctcgaagaacgccacgtggtgcaggcgctcgaaatcgcgcttccccatctccggcggtcggcagccgagagcccctggtcgccggcggcgtcagcgccgccgcggtgcgccacgatctgagaaagccacgcggacgcaaccaatcgcccagctatgcgctaaactgtttttttttttggccccacttcgcagagagcacttcagacgttgaacatgtaggtttggagaaactaagactgctgaattcggtgggaattttgcatgtcaatgcaggatacgagtatttgtctcggccgaagaatttcccaccccttcacacaagcttttgctgcgtgctgctcgccatggacacggtccacatcaggatgtcgagccacgtaaactc

SEQ ID NO: 1567 - DNA, 1200 bp, Zea mays
  misc_feature (1)..(100): optimal_loci_95526_G1, chr3:18042365..18043564, Cluster 9
aatactcttcacgatcataaaaaaagtatattcaggtgagctgataaccacagtttattaacctgggctgattcgctccttaacatgtagcgtccaaccgtctgttcgcactcgcttgcttatggtcacaaaagacaacatgcaaggaggacaattgcgcaacgcaagcgaaaacgatttatcctgcgccgatgaaaaccaagactttgtctaaacaggccaaaatcaagacgaagtagagggagaaagaaaaaacgaagtctcaaatagttgcaagctaaacaaatagaatttgaggaccgctagggaaaggtaagaagaagacaataaaatcaaaggagatcttaaaaaaaaaactgacgcccaaatcacgagattcacaatatctcgatccacactgacagcgaaagcttcgtaggaaagaagctaaacgggcatttattttactcttatcgtctcgatgaccatgcagcgtccgggaaagagacatcggccagtttggtctgaagtggacacgagagagggagagcagagaatgagaagaagggaagccgaagacacgtgtggttggttggtggatgaggacgacgctgcaccggcacgctagtcaccctctcagatgagggtgtaggagattgatgacctttgacagcggcagagatccaaaacagaggctgacctctagaggtctgtgcgtttctcttcaaaaggctttgtcgagacaggctgacctcttctagttctcgcggacaccgctgaaaacgccactgcggcgtcacagtcacagacaacagcctccatcagtcgctagcgcgatggctagattagacgccatacgtggggagcttggagctcccgggtaagaggaagacgccgtccatccgatcaacggcccagatccaagtcaactaggccagcaaccgatcaatcaacgttatagaaattggtcaactatgccacatttgcagaagcaccctgattttttcccctacagtacaagcgagaggttgtgcgtaggcaaatttctagaaggtcctaaaaacttgttttcttcacaaatataccattaaaagaccctttagatgatattttttctctactatctactatatttaaagcactagtttcatatgtcatgtgtcctgcgtcacgtgcgaaatattctctctctctcccgcttctcgtctaacgtgcgaaata

SEQ ID NO: 1568 - DNA, 1331 bp, Zea mays
  misc_feature (1)..(100): optimal_loci_9693_G1, chr1:51412643..51413973, Cluster 9
cataaataaaaaaagagatgaccccacgtgcatgcatttggattcacccgcgacttttcctggctggtcgcggagatagatagattattattcgaatttcagcgtaagagatgcatgaactctccactcataactgattagttatgcgcgtaacgcagaatggaccaacaacgacggctaatacagcgtactgcgtgcatggtctcagctaattgctcgctagctagctcagagccgaagaatcgtctttgactaaaccagccttaagtatactgccactagctagtaatctttagaccttgaactaatgtgtatgggagcgtgtcatggaccggacgactcgtctcgttgggcgtcggcgtcgtcgcactcgcacgtactgctaccgaccctttggaccggacgcgaccctggtcgacccatggtctgagggtgtgtttggttgttggggccgagatgtgccatgtcgtcgggggtattttttttccacgctagacaggtcgagacaaaaaaaatggtagtaggggctgcacgtggggtccacagtgagcgccactgggcgacgtgctgaccttcgggagcgggcaggcgcagcgttaggtgccagtgccagcgcggctgatgatgcatcatgcatggcatggtgtggtgccagctgcaaagtagtagtactagtacaaaacaccggctgacacttgaattgggttttcatactagtttgatttgacatgtgccggttttaagtcctttccggtgtgtgtctgtgtttgtgtcagtacatgcaactaactggggggtctagaaaaacggagacatgttggaagcatgcatggcttctagaagacatcacgtaagaattatgcaaaataaccagaatatcaactgcctcctcacttcaattcctagttgtatagtatagtatccttcaggtcttcagcctttcttttttgtcctgcgaatattttttcccctctatggaaaaacgccgccagaagaaataaagtggactcctagtcctagatgtgctgcatccgtttactctacactagtataattatatttatagcaattaataagatacgattaaggaaatgaatgcaacgtattcacgggtccacttttcttttaatcggactcgtaaattattaacaaatgcatgtgtgggactatgtccacactttgctacgctaatatatttgttttaacaatctttctaaagacatggattaatttggaacgagtcaagcagctcatcgtcgtaacattatattggtgtaataatatatgcccactactgtacgtaactcaaaggcaaatgttaatatcgaatg

SEQ ID NO: 1569 - DNA, 1355 bp, Zea mays
  misc_feature (1)..(100): optimal_loci_97772_G1, chr3:30209253..30210607, Cluster 9
gagagaatacaagtatttacaacaaagtgtttgacaaaaaaaagtgtttcatctctaaaacaaagtgttttagtttcatctcttttcacacatagagctacttttaaaaaaaacaaagtgctttaaaaaaaaactatttacaacagctcgtaaagttgttgatgaaactgtaccaccgaaagacgaccaaacagtcctgcaggagagagagaatacagcagcgccggggaagagcttcgctatctcgttttccatgcgggttggcgtgcgcgcgacaagaccgtgagtatcggtcgtcacaagcaccgcgacggacgctctgatgaatcggtggtcacatcatacatgatcgctggccgctgtctgcccatctcgcttttggactgggataggacaggaagagcgaagccgagcgagacggacaggcggccaaggaattgttagtcgccagagcgtggggacgacagcacacttgcattggtcaaccgcagatgtcgagacttcaaaccacatgctgttgcacatgtttcttacaatcttacttgtcctcgggcgttgtgctaagaattaagattgcagcagcgtttgtttctttccagtctatactagcagctgaccgatgctatctatgttcacggtcacgcggtagccaagcaggtccaacatgtgctgggaatcgaaggacacacaggcacccagtccaaactcgtgggtacgaaaaaacgtacgtgtcagctgggacggacgagtgtttcctttaatttgtccttaacaactttgtatatacgacacttcttcttccgtttttttcaatgaacacgtgtattttttatgccgtcgagtgaccaattcactgggcgtcgatatatggttttgttattgtttagcaagagatactatcttcaattccctgcaacactattttattcgacgttagaagcctgagcataacatatgcaagagagtacgtgttcatatactagtgtgtaatggctgctaaggcttctaataaataacctttttttattattgttgttgtttttttttattgaagtctggaagatacctaacgacgttcgtccagtggccaaggtatagactctttccttccatcgatctaaaagggcatctttattgttgactgaacgtgcacacatggtactgaaaaccgattttgtggtgacactgacacgttgactcttcattaaaatggcatgacgatgttacattgttctggggagccagcaatcggaggcctaccaaattggtattgcttatgacatagatccacagtgagacgggaatttaacgtacggaggcctaccaaattgtaaatgattgagagttagtgattt

SEQ ID NO: 1570 - DNA, 1227 bp, Zea mays
  misc_feature (1)..(100): optimal_loci_97776_G1, chr3:30212031..30213257, Cluster 9
ccaataatgatggttaggtcattcaaggaacacgtcctttggggaagtcatttgtctctatccactgcacacatgcacccgaaataaccgtctcccgccggcctggctgcgtgcgagctggttgcgctcgggctgtcaaccaatcagccggagtgagacgggaatttaacggaggcctaacaaattaaacgattgagagctggagaatggtttggatctgaacaggtcaagctgagcagccagagggagataggtaggcagacatcacgcctgaggatagagagcgtcgtcgcatggcttaacaacagtcgatgaggggcaagaagccaagaactagctaacaggctcaagagggagatagataggcagacatacatcaacgctttagattgtgctgacgaggatagagatttagaggatttaattgccgatcgggcactcgatctctactgtaactgtagtaatataatatagtattaattatgtagctccgtgtagagatattgctctcccaaataccattagtccattattctggctactcgtccgatgatcctgagacgcacacctggactccaagtcagtctccgcacccccatcgaagcgagtcaaaaaggcaccatgctttcggttcatgcgaaggcactgcacgcacgcagtggatcggatccacggcatgccctggttagttaatcctctgttctaatcacgcttactgggagcacacgtgtccacggacacaggggtacggagacggagagacggagggtagtgagtggcagcagggagttggcatttgctccggatcagccacttgttaggtagccggccgtctcctgtggccgaccacgcctttcgcgctgcctagtgcctgctatcaaaacccaatcatatcagacaggggtggaacgactgaatattcctatttaaccttgtctagtgcactgctgccccccattttcatcgcccgctagcgtgttgctgttgcccgtgtcggttatgtgcggagtccgctatatgtgcgtgagaatagtaaattttacacctttatttttttttcttcttcgtcctcatgattttgcattaaaccttttgtttaccccttccgcccttcggcgaggcgaggcgtgcagcgtacgtccctgtctcggcaacctagcctcgtcgatttgggcaccccactcgccatagttatgccgtcctccatcctccaacaccaccggcaat

SEQ ID NO: 1571 - DNA, 1370 bp, Zea mays
  misc_feature (1)..(100): optimal_loci_156393_G1, chr4:154313884..154315253, Cluster 10
acggaagttggcgccgcgagagcaggacgtggtttggaccagaccagatcagagcgtcggtcggttcctgttcctggtggtatggcacccatggaggccgataaactaactagtcaaggcattggatcccgcgggcctggaaaagcagtcaccggctctggacctgggactgggaggcaagccctccggcttttgcaccacggagcagacacgggctccaggaatcgattcagtgcagcggcacgccgaggcgcctcacatgattcctcagcacatgcctgcctgcactgcacagccgggaagtctgttcacttgtactgcgtcgtcccttggcgcgaggatgatagctaaggctcgcttcccgcgacacacgtacccacgcacgcacggaaccagaacgttttgccgacttcgtgtgatcaaggaccgttgatcacgccgcgctgctactaaaggatatataaaaaaaatgacagcgctcggcgtcttcaggcttcagaaccgttgatcaaggacgatgagcttgagagctgaatccggacggatcggactgcgtcgacgacgataaacagcagtgcctgcatgctctgttgtgcagccgtacgtgccgtgcgccggtgtatgtctgcatgcgcagtacttattttctgaagcaggtatatacaatatactagctagtacactgtggtatctgcaacgtagtactgatctggattctccatgttggcgtgtatactctcttttcttcacaggatcaagttcatgcactgagcaccagatcagattcagccaccgatcgagggagagggagtgccggagccggagcaggacagggggcggcgacgtcccacgtgcacggcgatctcaattatattctcatgcatgcagcggacaccggatcgaggaagcgcggcaaagcctcgtgatttcgatcggacgccccgatcgcatcgcatcgcatcgcatcgcatcgcagcagtgcgcaagggcagaaccgcagggcatggcgcccgaacggagcccatcagcgcccagtcgatcggcaagcccagagcgagcttcaaagttttgctagcttcgtgccgaattcatgtccatggatatcggaatgtgcatgcagcagttgttgccgggcaattgatgcagacaactcttttttttttttcaaatatccgggtttatttatatatatacgagatacaatagatagctttggccacaagcgattaaatgacgctggtcggtagggaagcttctggtggagaccagacttgagaaaaaaaataaacccaagacctataaaggcaagacaatcatgcgtgctctgtcctccgggaagataaatggctgcatgaagcagttgaataaaa

SEQ ID NO: 1572 - DNA, 1107 bp, Zea mays
  misc_feature (1)..(100): optimal_loci_1044_G1, chr1:5342001..5343107, Cluster 10
agacacaggtgccagaactgctgtcgtccagcgcaatgcgcacgcaactaaaccttgttgcacctgttctctcttctccgtggcgttgctgcagcagtcgctccctttgtcgtgcgtggtcctggcctgggtgtttccgtttcatccatccatgatccatggacgcgagctgtcctactgatttgcttacatgcacacgatggcagaggaatgccgtccgcagctgtcggcccaaaccaaaacaacccttgctaaatctgctactcgccaatccaccatggcatcggctcgctctcgccctgctccgggacacggcgcggcgatcgccgtcagtcccacgtgaaggccacgcggccagggcggtcgacgacggcgcgctagcccgcggcggaaggggacaccgcgggcacacgccagggcgctcgattcgtgcggcggagccgcctccgatccgtcgccgcaggctgcagctgcacgccaacgggccgcgtgccggccacagggctgcgcgcggacaaaccgggccttaaatgcccgctttggcgccgcgcgcccacgtcgcgttcgcgttcttgccccgcggacccagtgaaatatatttctgtaacctcctaccttatcacagtttgatccttaaccttttctacctcatatgacagtttgacttttaattatgttatcagtaacttgcgaagtatagaaatattgtagtataatttctatactatacttcctctgttcaatgtcgctttgggacgtgtaattgtcaattttttcttaagtttagttttaaatttattacagaaatagattaacgttctattcaataatacaaaaaataggttaacgttgcatttgatctgcagaaaaaggctgaagatattgcactaaaaggccccagtgggctagaattgaatgccgttggagttgggctggcataaatgatgccgcttcgcacctctcgacccgtcctgtactcctgtgacctgcatgaccgaggccgctgaatcaacatgggctgcaaccgcaagcctggatagcccagctatcacagcgggctccaacgtctcttcatcaactgtaggtttttctgtacagtttgtttta

SEQ ID NO: 1573 - DNA, 1041 bp, Zea mays
  misc_feature (1)..(100): optimal_loci_11170_G1, chr1:60149693..60150733, Cluster 10
atgacctgatcagcgtgtccctttgctgtccttctagaaggcatcaagcaattttgacctggagcagggcaccacaccgcgtccgcgtgccggggctgcccgtcagcgtcacctcaccggcgtacagaggcgttcgcggaaggtgatagaaacaccagtccagcactccggctccagatccagcagcacatcgaagcccacgagaacagtaaaccgccgcaagaagcacgccaatacacgcaaccaaacaaatcatatagcctacacaaagggaacaaacgcattagtacccacttaaaaactgatcttaattagatcgattctaagactagttgatttttaatagtaatccaccatgacgtttgctcctacgttcattcccgaaccgaggtggtggagtacataaacaaacagacccagtgtcccttcgtttggtctccttctggcttctagaagccagccagcccatcgtgcaaaatgccaaacgctggagcgcttctagaaggtgggggtgcgcctgcgcctgcgccgcgccgcgccggaccggccgctgctgccacggcgtggcgccgtcagcgtcagccacgctgtctctcctgcgccgtacgtaatgcctttgcattgcctaaacgatgccaacttgccaagtgacacctactggctaataccacctgcacccaccgattagttagtgctactgctctcagcccattcgggtacgtaccttatccggccccgcctgtgggaccgagcctgtaacggaacggtgctgtctgtgcatgtggcacagtagcagatcatatacgtacgcctcaacgtcagcggtgaagacggtgaaatcgactgtagtatcggtttttcttttttttttccttctcctccttccgtggatgcatccgcacccccaggcatcaatgtagctttgccactccatacctaagtctccttttgtattttgtgagctagctgcttcatttttttatccaaacaaaacgcgtcctatgtattcatataatgtaaacatttgtagccacacgtgga

SEQ ID NO: 1574 - DNA, 1078 bp, Zea mays
  misc_feature (1)..(100): optimal_loci_115620_G1, chr3:146657842..146658919, Cluster 10
agtaccgttattaccagcaaagctcccactgtcaaaaagaagaaaaaagaatccaattctgtccagaagctcagatgtttcagtgaagaatcataaaaaagttgtgctttaaaaaatgtcatgcctggctaataataacccattaaagcataagcgtcgaaccaaaggatccactgaatcatcagcaaaatattggaaactcaatgttagctcgaaaatgctctcgtctttcaactaaagatataccgtctaagggcccacccatcagcattgtacatatgaccaaccaaaagcatttccagctaacaacaaaagctctatttaatcaactcagatccaccaaaccctcaaaaaagccaaggcaggcttccaatttacatctcacgcagggcccagaaccaatgcaccactacaggattgaatgctacgactgcagcatcccaaaatgcagatgtttttaatgtggagacagcttttggtacaagaaaattttggccacgacttttggggctttgccctcaatattgatcagggatgcacatcggacaagggtggctttgacaaaccaaattctacggatcctaaaaagagaacactcgccccaaataaactatccactttgacagctgacaattgctgggagaagcccgcaccttgtttgcatcgaacagctccccaacagtacacctgccaacaatcccttgtccaaaacgctataagatttcacgaaaataaaatgtacgcagcgcattcagatccaccggacatagcagcagaccccagtcatttagaaattttctcaccctgctaatggcaaccacgaagtctcgaatttttgttccaaggatccagagagcgcaacggggcggtcgccggaggtaacgccgcacccctcgaaacatggagcatttggcagggaagaagagatttgcgcggaaatatcgacggatccaaaagcatccgcccccgctctggggctgcgaggaggaaggagtagcctcggtccccatcgatctcaccaggggaaaggaaaggaaaggaaaggagaagggaggaaaagcagagcattcgtgcaaac

(The sequence listing continues in the following parts.)

The invention claimed is:

1. A maize plant, maize plant part, or maize plant cell comprising a recombinant nucleic acid molecule, said recombinant nucleic acid molecule comprising:
a nongenic nucleic acid molecule of at least 1 Kb, wherein
 a. the level of methylation of said nongenic nucleic acid molecule is 1% or less;
 b. the nongenic nucleic acid molecule shares less than 40% sequence identity with any other nucleic acid molecules contained in the maize genome;
 c. the nongenic nucleic acid molecule is located within a 40 Kb region of a known or predicted expressive maize coding nucleic acid molecule; and
 d. the nongenic nucleic acid molecule exhibits a recombination frequency within the maize genome of greater than 0.00041 cM/Mb, wherein said nongenic nucleic acid molecule has at least 90% sequence identity with a nongenic nucleic acid molecule selected from the group consisting of
  SEQ ID NO:387, identified as loci_137693_G1,
  SEQ ID NO:463, identified as loci_265551_G1,
  SEQ ID NO:560, identified as loci_128078_G1,
  SEQ ID NO:573, identified as loci_168286_G1,
  SEQ ID NO:1268, identified as loci_3733_G1,
  SEQ ID NO:2030, identified as loci_203075_G1,
  SEQ ID NO:2053, identified as loci_232484_G1,
  SEQ ID NO:4425, identified as loci_136086_G1,
  SEQ ID NO:2033, identified as loci_203704_G1,
  SEQ ID NO:2709, identified as loci_127268_G1,
  SEQ ID NO:2731, identified as loci_204637_G1,
  SEQ ID NO:3230, identified as loci_291068_G1,
  SEQ ID NO:3357, identified as loci_232222_G1,
  SEQ ID NO:3428, identified as loci_43577_G1,
  SEQ ID NO:424, identified as loci_204726_G1, and
  SEQ ID NO:4529, identified as loci_232228_G1; and
a DNA of interest, wherein the DNA of interest comprises a non-native exogenous sequence, and said DNA of interest is inserted into said nongenic nucleic acid molecule to produce said recombinant nucleic acid molecule.

2. The maize plant, maize plant part, or maize plant cell of claim 1 wherein said DNA of interest is inserted within 1.5 Kb, 1.25 Kb, 1.0 Kb, 0.75 Kb, 0.5 Kb, or 0.25 Kb of a zinc finger target site specific for said nongenic sequence.

3. The maize plant, maize plant part, or maize plant cell of claim 1, wherein said DNA of interest is inserted between a pair of zinc finger target sites specific for said nongenic sequence.

4. The maize plant, maize plant part, or maize plant cell of claim 1, wherein said DNA of interest comprises an analytical domain.

5. The maize plant, maize plant part, or maize plant cell of claim 1, wherein said DNA of interest does not encode a peptide.

6. The maize plant, maize plant part, or maize plant cell of claim 1, wherein said DNA of interest encodes a peptide.

7. The maize plant, maize plant part, or maize plant cell of claim 1, wherein said DNA of interest comprises a gene expression cassette comprising an insecticidal resistance gene, herbicide tolerance gene, nitrogen use efficiency gene, water use efficiency gene, nutritional quality gene, DNA binding gene, and selectable marker gene.

8. A maize plant, maize plant part, or maize plant cell comprising a recombinant nucleic acid molecule, said recombinant nucleic acid molecule comprising:
a nongenic nucleic acid molecule of at least 1 Kb, wherein
 a. the level of methylation of said nongenic nucleic acid molecule is 1% or less;
 b. the nongenic nucleic acid molecule shares less than 40% sequence identity with any other nucleic acid molecules contained in the maize genome;
 c. the nongenic nucleic acid molecule is located within a 40 Kb region of a known or predicted expressive maize coding nucleic acid molecule; and
 d. the nongenic nucleic acid molecule exhibits a recombination frequency within the maize genome of greater than 0.00041 cM/Mb, wherein said nongenic nucleic acid molecule has at least 90% sequence identity with a nongenic nucleic acid molecule selected from the group consisting of
  SEQ ID NO:387, identified as loci_137693_G1,
  SEQ ID NO:463, identified as loci_265551_G1,
  SEQ ID NO:560, identified as loci_128078_G1,
  SEQ ID NO:573, identified as loci_168286_G1,
  SEQ ID NO:1268, identified as loci_3733_G1,
  SEQ ID NO:2030, identified as loci_203075_G1,
  SEQ ID NO:2053, identified as loci_232484_G1,
  SEQ ID NO:4425, identified as loci_136086_G1,
  SEQ ID NO:2033, identified as loci_203704_G1,
  SEQ ID NO:2709, identified as loci_127268_G1,
  SEQ ID NO:2731, identified as loci_204637_G1,
  SEQ ID NO:3230, identified as loci_291068_G1,
  SEQ ID NO:3357, identified as loci_232222_G1,
  SEQ ID NO:3428, identified as loci_43577_G1,
  SEQ ID NO:424, identified as loci_204726_G1, and
  SEQ ID NO:4529, identified as loci_232228_G1; and
a DNA of interest, wherein said DNA of interest comprises two or more gene expression cassettes and said DNA of interest is inserted into said nongenic nucleic acid molecule to produce said recombinant nucleic acid molecule.

9. The maize plant, maize plant part, or maize plant cell of claim 1, wherein two or more of said nongenic nucleic acid molecules each comprise an inserted DNA of interest to produce two or more recombinant nucleic acid molecules wherein the two or more recombinant nucleic acid molecules are located on a same chromosome.

10. The maize plant, maize plant part, or maize plant cell of claim 8, wherein at least one of said two or more gene expression cassettes comprises an insecticidal resistance gene or herbicide tolerance gene.

11. The maize plant, maize plant part, or maize plant cell of claim 1 wherein said nongenic maize nucleic acid molecule is selected from the group consisting of SEQ ID NO:2731, identified as optimal loci_204637, SEQ ID NO:4425, identified as optimal_loci_136086, SEQ ID NO:2053, identified as optimal_loci_232484, SEQ ID NO:2030, identified as optimal_loci_203075, SEQ ID NO:1268, identified as optimal_loci_3733, SEQ ID NO:573, identified as optimal_loci_168286, SEQ ID NO:560, identified as optimal_loci_128078, SEQ ID NO:463, identified as optimal_loci_265551, SEQ ID NO:2709, identified as optimal_loci_127268, SEQ ID NO:424, identified as optimal_loci_204726, and SEQ ID NO:3357, identified as optimal_loci_232222.

12. The maize plant, maize plant part, or maize plant cell of claim 1 wherein said nongenic sequence is selected from the group consisting of SEQ ID NO:2731, identified as optimal_loci_204637, SEQ ID NO:4425, identified as optimal_loci_136086, SEQ ID NO:2053, identified as optimal_loci_232484, SEQ ID NO:2030, identified as optimal_loci_203075, SEQ ID NO:1268, identified as optimal_loci_3733, SEQ ID NO:573, identified as optimal_loci_168286, SEQ ID NO:560, identified as optimal_loci_128078 and SEQ ID NO:463, identified as optimal_loci_265551.

13. The maize plant, maize plant part, or maize plant cell of claim 1 wherein said nongenic sequence is selected from the group consisting of SEQ ID NO:2731, identified as optimal loci_204637, SEQ ID NO:2030, identified as optimal_loci_203075 and SEQ ID NO:560, identified as optimal_loci_128078.

14. The maize plant, maize plant part, or maize plant cell of claim 1 wherein said nongenic sequence is SEQ ID NO:387, identified as optimal_loci_137693_G1.

15. A method of making a transgenic plant cell comprising a DNA of interest, the method comprising:
   a. selecting a target nongenic maize genomic nucleic acid molecule of at least 1 Kb, wherein
      i. the level of methylation of said nongenic nucleic acid molecule is 1% or less;
      ii. the nongenic nucleic acid molecule shares less than 40% sequence identity with any other nucleic acid molecule contained in the maize genome;
      iii. the nongenic nucleic acid molecule is located within a 40 Kb region of a known or predicted expressive maize coding nucleic acid molecule; and
      iv. the nongenic nucleic acid molecule exhibits a recombination frequency within the maize genome of greater than 0.00041 cM/Mb, wherein said nongenic nucleic acid molecule has at least 90% sequence identity to a nucleic acid molecule selected from the group consisting of
      SEQ ID NO:387, identified as loci_137693_G1,
      SEQ ID NO:463, identified as loci_265551_G1,
      SEQ ID NO:560, identified as loci_128078_G1,
      SEQ ID NO:573, identified as loci_168286_G1,
      SEQ ID NO:1268, identified as loci_3733_G1,
      SEQ ID NO:2030, identified as loci_203075_G1,
      SEQ ID NO:2053, identified as loci_232484_G1,
      SEQ ID NO:4425, identified as loci_136086_G1,
      SEQ ID NO:2033, identified as loci_203704_G1,
      SEQ ID NO:2709, identified as loci_127268_G1,
      SEQ ID NO:2731, identified as loci_204637_G1,
      SEQ ID NO:3230, identified as loci_291068_G1,
      SEQ ID NO:3357, identified as loci_232222_G1,
      SEQ ID NO:3428, identified as loci_43577_G1,
      SEQ ID NO:424, identified as loci_204726_G1, and
      SEQ ID NO:4529, identified as loci_232228_G1;
   b. selecting a site specific nuclease that specifically binds and cleaves said target nongenic maize genomic nucleic acid molecule;
   c. introducing said site specific nuclease into a maize plant cell;
   d. introducing the DNA of interest into the plant cell;
   e. inserting the DNA of interest into said target nongenic maize genomic nucleic acid molecule; and,
   f. selecting transgenic plant cells comprising the DNA of interest targeted to said nongenic nucleic acid molecule.

16. The method of making a transgenic plant cell of claim 15, wherein said DNA of interest is integrated within said nongenic locus via a homology directed repair integration method.

17. The method of making a transgenic plant cell of claim 15, wherein said DNA of interest is integrated within said nongenic locus via a non-homologous end joining integration method.

18. The method of making a transgenic plant cell of claim 15, wherein two or more of said DNA of interest are inserted into two or more of said target nongenic maize genomic loci that are located on the same chromosome.

19. The maize plant, maize plant part, or maize plant cell of claim 1, wherein said DNA of interest comprises a gene expression cassette comprising an insecticidal resistance gene, or herbicide tolerance gene.

* * * * *